United States Patent 11,913,074 (METHODS FOR ASSESSING RISK OF DEVELOPING A VIRAL DISEASE USING A GENETIC TEST) - sequence listing, part 22

SEQ ID NO: 2213 - DNA, 286846 bp, Homo sapiens
  source 1..286846: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagt

SEQ ID NO: 2214 - DNA, 421178 bp, Homo sapiens
  source 1..421178: mol_type = genomic DNA
tttttttgcaaagattgttggaaataatccttctcttgtacctagaaacataggtgcaaatttctgatatctttgttttatctgcattcctgcctttcatgaaagtccctcttgattgtgctgaggctgtggctcagcgaagacactgaataaatacgatagccactgttgcttgttgcttgtccaagtcttcctggcttctgctgcaagagggggatatggagaaggtgggccagggtgtgtggacccgggcagaatctggggaagaagcctgccattcgtctttctttcccacaccaccgaacccactgcccttcccacccccacagcccttttatgaaatcagacaacgtggtaggtggaaaacagcagggcctttcctctgggttttcaaccagaagtgatattccacagttttaactggttactgtgaagtccaagcggccagaattgtgaaaatgtccactgaaacactgcaagcggtgtacttaaagacagtaggccttttagattttgttatatattttttgtagtgctcttcacaagtggaaattttttttttttttttacttttttttaaaagatttttttgtaaagaagggttgtatttagaggccagtagctagagatccaaccagtggacctcttgaagcactaccaggccttaaggccaccatccgagggagactgggaaaactattattcacccaagcctccggaaatgtaatgtaccagcaggcaaaaaacagttcttcatgtagtacaaaatgaaacgaaacaaaaacaaaaacagaaagtaaaaatgaaaccaaaacatttcttaaattctagtgccatagcttttttgtttgtttgttttttgttgttgttttgttttgttcataagaaagagagaaagatactacttatccgtcagacacatgcatcctcatgtggtcgttgaactgctcgatttggtcaaactttgctgggcagacggagcagacgtaagtggtcccctccgtgcaggccaccacgcctggggggccagcgcgggcacctgggggtgtgcctgcagggggggtcccattgctggcactgtgcagggccacgtgtcgctccaggagggtcttgtgagagaacttctttttgcagatgtagcactcgtaggacttctctccccggtggaggcgcatgtgcacgttgagggagctcttctgggtgaagcgcttgttgcagatactacactggtatgccctcactcctgtgtgtgtcaccatgtgcttgataaggtaatcctttaaggagaaggagcgccaacagatgctgcattggtggggcttctcacctgttgatgtaggaagagacagcaagcaggacagagcgagacatagcaagggatagagaatgaaggacaggaaaaacaagacaacaaaaaagaaaaataaaacaattaaaaaataaaatttgattgcttaatggatcatcctcgtttggaaaaatccaggccctcctagcctctcatgtgcagagaaattttgctttatggtgatgccaggacagttttgttttccatttccctgtgccataaaacggctttcttggaaagctaccagatattccccactaaaagtcttcaaggtcactccgtggaaaagggagggctacttttgaagggggtcactttcagtgtcctgattaggggatttagtgtttcccattaacattatcaaacaaatagaagaaataagagagaagaaagatcgttggagacatggggtgctctagaatccttgagaactaaggatattggtcactatagcttggttccttggggtaagtccccacttctagtagtctaagaaatacacctatgtgttgattgtgagtttggaaaatatttgccaacacaggaatacgttattttgaagagctatactttcaagtttatctattttagacagaaatctttctaaaatataacttaagggttaattgcctgttctctattgactgtagtgagctgcagattggcctcatcgggtgtagaggctgagtaggcggtgggcaacatgatgatatcagactcaaatgatcctattcaaatctgggcaccaacacactacactccactctgacaaatcaccaaatgcctctgaggtatacagtcctacttacctcattgtgctggtgttgacataaaatacatatgaaatcactttgcagaccaccaagagcagtgtgggaatacatgcatggtattcttattacaaggatacctcccacccccattaaatgcttccatatgccttttgaactcttgggtcaatttttaaaatagttttcctgcgtcctcctttgctctcagcctgttggcggaaacccttgtttttcctcagtttactgctttggtttggcttagaaaccaaatgatcaagtttgttacaaacagtaaggtaaataataatactcagtgcatgaggtattcttaaagtccatgggtccgtgacatctctttaagatgattacttaaagacttgttttctttgtgctgtttgttctcagctctgctcctgacaggtgagatgaactgcgtgtttggtccatctctaccacctcattcctgactgcccagtgtaggccctcacctcagagaaaaaagtccttccatgatccaaactaaaactgaaagcctctgaaactccttaggataatatttcaacatttggactatgcatcaaggtaagaagtcttttaaaatttgagctaacttccacttaaaatatatgccttgactgtttttcattttttcccattatgaaataggagagctttgatgtattatggtaatagcagcaatgaaaacaatcaccatgtattgagtgcttactatgaagcaaggttggtattaagtgctgactatgtagcagggttggtattaagtgctgtatgttcatgatccattttattaaactttctctcatcaggaatttgttgttattgtgttttcaaacataaacagatatgttttgaagcacactgaccagacagtatgctgcgtaagatcacatggttagaagataattttacttttagattaaaacaggaaaggttagggaagcctcattgctaataatctcaatttgctgaagacttcagtctatgcatagtgtttacattggtaccttttttttttttgaagtaagagattccctaagagagacagtcatgcatgtttttagctgaaacatttctgtcagctgtaaacatgcctggaagtcagctggtctttgctatcctcatgctttcagacgatttatagaggctatgataggctggccaactatcatttaaaacatgtccacctgtcaccttttatgggaagcgtgccttaaattccagatggtattttggctgctaagaagttgaaacttcacctatgttaaaatgctctgctgtttgaaactttcaccttctgtgtgtttttcctcgaggcaaggtcactgatgaagactttattttcacactcttctaatctgtctataaattgattcctcatagttgtcatgtttctctctatagcatatataggtatgttgtttgtgtgcatgtagtattggttctaccattaattatccatgtgaccctgggctttttaagtgttttcatttctctgggtttatttcattttctgtatgtgaagagttggaccaggcagttgcacatggtcctttgtggatttagtggtcctgagtccgtggtggactgcaacccctgaggactctagtcctggccttgtcagtgaatgacccaagggcaacctacttagtcactgaatgcattaacagtctcacattttaaataagacaaagtatcctgttcccttccctgccacagaacaatggtatgttacttaataaagagaaatgtttgcaaagaacttgggagctccttaaaggaaggtgctctctataattattaaggtgctgtgatggtgaagtgtaggtatttcagaaactgtcttactaaatggggtatattttcagattagtgaggtgctcacaactttcatttctgtatgaatttgaaacgcagtcactcagcaggaatgaatgattgtgttttaagaaaattttttttcccactattttcttgcatattacttacagcaatcccaaaatggttttagacattatgcataaaatggatgaggtctgtcgattgttgctctccaagtaaagaaacaaaaagtgaagataaatggtcagagatggttttccaggtttaagcctatggtcaggaatggcaagtctgatttgtcagaaggggacacaaagtaaaaagtggataattgaattataacatcaaggggaaggtcatataagttccttcactttaaatgatccattttgggcctatacagatgtaggagtcagatatgaattccatttccttggctgagtgacttgggcatgtcatttaacctctataagcctcagtttccttatctataacttgagaataatatagtaagtacctgtctcgtgaaggcgttttgaaaattgaagagataaagcacttagtacagagcatgtggtcattttaagaaaaattaaactgttccattcatcacaaaggaaccaaggataaatgaaaccaactgcaaaatgacttgcatggcatatggaagtcaatcctgaatttttaaaaaattatttcagataatcagtaaaacaagtgattatattgcagctatgtaattcagagttaaaggtatcgtctactctctcaattacatatgcgaatggcaagaagtggtatatggataaaatgtcagcacagagcacagacagaggatttcctaggaaacccgtgactgagcactggaggcacagaaaccaaacagcaagggaagaaactgagggggaggcagtgccctttactgccttgccaagggtgttgggcgtggtaaaagtatacgtttttctcaatttttcaatgcctgctcatcaccttcttctcaaggaccagctctgacacttaactctaccatgactgaaaagtgaaaaaaaaaaaaaaaggaagaaagatcctgcttaggttagaagatgcagagggttctgcctgaagctcacaaagttcaagtaaaagccatcctaatgggtaaagacaccccaattttgaataggaacctcttgcactgggggctcagcaagaacccacttattctactgatttttttcccctcattttaaccaaggcttctcctgagctgtgaaaaagacaatgaatgctgttatcaggagatttttcagaagcactgttcctacctgactctcctgttctctctgcctccccatcatctgccctagtacaatgccctcctctttcgtgagtacagtgatgggtcaaaaaaccaagacagggtgcttgatgagacagcaggcagcaaggaaggaggagaaagaggagaaggtgggtagcagaaggtggccactggtgaggaaagcagaaggaacacttgaaagtccaggtcctctgaatggggaacatcaagacacgaccagaaaatggggaaggttccatattaacaatggaagtacattcagatggaatcatatggagcttttactggctgcagagtctagtctccgtcaagagacgtctgtttaaaagggggcccacacggctgggcaccgtggctcacgcctgtaatccctgtaacttgggaggctgaggcaggtggatcacctgaggtcaggaggccgagaccggcctgaccaacatggtgaaaccacatctctactaaaaatacaaaaaattagctgggcatggtggtgggcgcctgtaatcccagctactcaggaggctgaggcaggagaatcacttgaacccgggaggtggaggttgaagtgagcagagatggcaccactgcactccagcctgggcaacagagtgagactccatctcaaaaaaaaaatggggggcccacacacctgagatatcagcggtgtgattgcctgccagcctttctgttcattccctgggatgtgatcctgttgccagcttggactgtgaggctaagagggactgcctattgggaacatgctgcattcacaaaatatctgtggcttcagtgacaactaagatattttagttttaagcagaactttggagagtttcatccatgctacttgacttttcttaaaattttgtgaatagagtggatattaacatccccagaaaatagcatctccaagtagagagttgtactaacatcttgaaggtcatctaagaagtcagtagcacctgagagtataatactagcccaaccagattatcttcctctcccttgttaacaactccttgttctctggattatgctgcaaaatgtatgatgctactataacacatattaatggctttgatagttttacagcattcataattaagtgttttcacataaattatgttattcaattcaaagagcaatcatgtaaagtaagtactacagatctgaaaaactgaggcttaggtcagttacagaacttagccaaagtgactcagccagaaagtggtaatatcatggccttctcactccaagccttatacttgttactttacacccactggcttgatataattaatagtccaagctccatatgaggattaacacattatcttcatatgactattatggcccaatcaccaacattgttatgctactattgttactatgtctatttacactgaattcatggctgaaatagctgaacttctcaaagtaataagcaaaattaccgtatgtgcagaggataccaatgggctaaaaacagtcaccagtgaacgggctgttgataatatgattcagaaaacgccaaaatatttatctcttgtgggtaaaaaaaaaacacgaaagtgtgaacacagatatgtgtacaatatattctatagcaaataaaaaaagagaaaaaacaaagaaatttaaaactcttgctgtgaaaagaatgtatctgtgtataagtcccttgaattaaattctcctggaaagcgtgttcacattttaaaattttcttttatttattttatttcaatagtttttggagatcaggtggttttcggtgaatgtgcacattgaccaaatgaatgggcatgtgaaagtgtgatatacatgtatatatacgtgtgtgaaatgtatgtctctgtgtgtgtgtgtttccgctctcacagagtttacattctaaagggaaggtgtaaagataatacatgatgatatgaataatacaagtcagtcctgctaaataccagaagggatacatttgccatgtgacctatgtaatttggaagactcaacttacctcatatgtgagtgattagtttctgtgatataatttatccactacaaaatcaagctttgatccataattttgatttactttttctaaacagattcttattagtggaattttaaaaaatgttatgtaacaaaagcaacctgatgccattcttctaattacccaggctcacctctctagggaattgattctcaacttcagcatgaaccagggcttgttacacagatttctaggctccattgcctgagtttctgatttaggatgtctggggtgggggtgaagggtgggggaacataatttgcatgctgctagtgtagggatcacactgctccagggttatctttgaatttgccctattgcttgccttccacatccatgttgacaccaaggcttatccttcttgtattctctgtctttccctttcatttccattcctttatttgacttctgcttttttctcttgatgaagggggtagaggggagcactgctttcttccctgacaggatggtttgtattatctttgtttttttctctctaattctgttgctttcaaacatgcccttaactcttagtttcctttctcacaacttttatgaagctgcagtaagtgaatgaaagaaactcctagagataaggaagtcctccgtggtttgtttagcagtggataaagagtggttaggtgagcaattttcttttactgttataaaaattgttaagaaataaaaaaattcttgttatgaagaatattcaagagcaatctaaggagtataaaggagtttcagagtttaaattccaaagaggaaggacacatgtcaagcatgtattattcagagacaggaaatagagcaaagaaactaagtgtctcctgggtagtaggggcgaaaagtaataatgatgaggatttttaatttttctaattaagtaacactttgcctcttctgaaaagctctcacatgcatcatacgtttacatcaaaaggcagaaaaaatcatttttattttaaactcaaagaaatagacagttgtgaaattaactgatttgttgaaggacacacaggcatttagaggaaacaaaactggatccaaatcatctaattacagtacaatcgtctttcatttatgcctctactttaaatttttgggttataatcactatgaaatatgctttacaactaaagcttccttgattcttaaaggtagagcttagctccaaagccaatatgatggactacttctttgtctcaaacagattttttttttttttttttttgatacagagtcctgctatgttgcccggggtggagtgcagtggtgtgatctccgctcactgtaacctctgccttctgggctcaagtgatcttcccatttcagcgtcccaagtagctggaactataggcatgcagcaccatgcctggttaatttttatagtttttgtagagctggggtcttgccaagttgtccaggctggtctcaaactcctcggctcaagtgatccacccacctttacctcccaaagtcctgggattacaggcgtgagccaccatgcctggccccaaacactttctttcatgaatgtggatcattaacatagagcagtacaagattttaattggaatatgaatcttataatttattctcttcaggtttttttttttttttttttttttttttttttttaagagataggtacccaggttggcctcgaaactcctgggctcaagtgatcttcccgcctcagcctcctgagtatctgggactattggtgtgtaccatcacacacaatttatatctgcagttgttgaaagcaactaccatctatattaaactttggagttactgaattgctaagacagttactctgcaggtctattggtttgcatagcagctgtaatggagagaactcaaatttctttttaactttgtcaagctattctttttttttaggactctttttggttagagtatgggtgggaacacagagtccaactctactcttacaagtatccccgtgctttctagaatctttttatactaacatttggactttttgctttgaatttttatcacttccactgggctcttggaaagttttgaggctccatttttttatgttttccctagaaattgaaaagaactttgtttggaaatgcgagctacaatgaacccaggtcttgaattatttccacatgttccggctgtcttgctttttgaaatctagaccaattgttctaaaactttgttaggttaggggatccttcagttagacaatagtcttgaaagactgataggatttccaaactgccactgccaaataattctggaatgaaagggaagagcattacttcttttaaattaggtgcctgattgatatatgcacattattattttcagatggggctatattatacacaccattacaataacattcataatttactgaggatgttcataatttactagaaaactgaagtccacattttaagcataactcagatttataaaatgactctacctatagcttttgcatctgtgtctgagtgcacaaatcctttgctggttttcttatgtccaaatctagttatctcggttaaccacagaatccttcagtgaatccattggagaaatgtatttatacatcacgaagatactttttggtagtacattgaaaattttatgttgcaaatttaaagacttattttattatgtgatctaacagaatgtgtgaattttacatctgataggtctacttgaagagatgtacagaggggagagcagatatgtttatggatccaagaccagcaaagtcaactttggttaaggagatactttcacagatggtccttcctgcacccctcccccatgttccttaatttaatggcttataaatcagctatccaggggaggaaaggatataaactatgtgacagcactctataaatcataagatgctacaaaataaaaacattactatttgattaattcacctaataatggtgatatccataccatatggaaaatttcttgtgatttacctctggttattagtacattcacatttatcccaagtaaacaaagcaactcaccactacccaagtttcttcataaattcagtagtgagtcactctgtttatttggaagtgtgaatactgtgatctttaaaaactgattctcataaaagtacatacattaatttacataatgtcctgacttacattaccctgcaaagaaggcaaagttcatcttaagcaacgttctgtttcagttgtacaattccatgtttgatgccttgcctctatctctgttgctttccttcccttcagtccccaatctaaacttcactgttttatgtcttctctcttggattcctactagctgatctgagaaacaaggttgttttgagaaactaatttgttttcatgtatcagaattcgagtatgtaacttttccctggtaaattatttgtcatttaataagggtattctgaggccaggcacagtggctcatgcctgtaatctcataactttgggaggctgaggcaggcagatggcttgagctcaggagtttgagaccatcttaggcaacatggtaagaccctgtctctacaaaaaataaaaaagttaaatgagcgtggtggcatgtgcctgtagacccagctacttgggaggctgaagtgggaggattgcttcagtccgggaggttgaggctgcagtgagccgagatcatgctactgcactccagcctgggcgacagagtgagaccctgtctcaaaaaaaaaaaaaaaaaaaagaatttcaaatataatgatcatcactgttataggtattcttaggtccaagagaatctaggtgacatcacaatcgcttatgtgctcacttatatggaggcacatccatggaatgcccaattctatgggaattccatatctctgtaccactatggagctatgaaaaaggattggctgagagatcagaagatcttagctctggaatcatagaatccagggatgaaacatgatcttgcccatcttgatgactgaatcctgtgtacaaaatccctaaaaatgttcatccattctctccttgaatgcgtctaattacagaaactcactccatttaaaggcagtctatctgatattagagcagatctgattgttaacaaaatttttcttttattttgtggaaaggatctcctgatagcatccaatcattggtctagttccaccttttggagccaaactatacaaactgaatgtctcctcctcttaaccatcttaataatagctaccacttatagagcacttattatatgcttggaagtactctaaagacttcacatgtattaatttattctcaaaacagcactataaggaaggcgtatcacgattattctcattttatacacaaggaaactgaagtatagacaagttaagtaatttttccaaggcgacaaggtttagtagtagctaagcctgaatttacacccaggccatctggctgggtgtaagagctcaagctcttcctgactacagtatgctgcctctgaaacacaaatacttgaatatggcttatataatgacctgagtcttctcttctgcagtctggacatccctaggacatcccttctccataaagggttcctgtgacggtgtctcttggtggcagggtgctttgttcttatgatgggaggaacacagttggggtttctagaagaggcttgtggtggggtctgtttaaaatctgaaagatgatcccaaaccttcccttctacctgctctcttaccttgccttcccacagccccctcagcccctgctgccaggcctccaggtggggtgacactcacctgtgtgtacgaacatgtgcttgacgtagttctgtttggcggtgaaagtcttgttgcagagagtgcactcataaggctttttttcgccttgcccactggctgtgctgtggcctgcggatgaggccaggggctgtggcgctggcagctgtgcagtaaaggtcgacagaccgggctgggacactgtcacaaactgggtctgctggcctgccaggggctgtggcaggctgaagaggaaaggcttggggccactgcccgcgggctgggtagtgaagagggctggcaggtaggtgttgccagctgtgccaatgacctgcgtgttgctggtcaaggtcagaggcatcctcaggttgctggtgagggtttctgtctggcgtaagtagagctgggtacttggcaatggctgcccgatggacgtgttgaccgaaggctgttgtaggacgctcttgtcggagctgttgctgacagtgataacagtgctgtccatctccacttcattgcttctctccggagaggaagcacctgtttctagctggtttgtctgcggaccaccctcagcgggggcttctgcagcctgctcgggttgggtgggttcagcctggctgtcccgcgccgccccaggcccaaactgctgctccaccgagtcaggctcggtgcctatggaggagctgacgcccgagtcgaagctttcacctttgggctcactctcggtgccctcggcctggtctgtgtcttccgtgcactcctcggattcgttgcgttccaggatctgcaccctttgctgcccgtagtagtcgtaatcgtcctccatctcctgcttgatgtggatgttgcccactagggtctggatgcgcacaggccggggctgcttgcggcagtgcgtggtctcgggggtggtggacaggtagcgctccatctgctgcgagcgctcatggatgcgtgtgatccagctggggtcttccatgtggtggtcgcggggcaggccgagcgcagtctcgtggtggctgaccactgcgccgctgtaaaaagagcgctcgccgctgccattctgcatggagcacgcgtagagtgccgagtagatcctgtccacgctgtgctgtgggtggctctgcaggtagcccgactccgtgtcgctgctctggcctgacgtgcctgactcgggagtgccccgcggcgtgtcctggcccgagtcctggatccccgggaacacatcgcccacgttctgtgacacgatgcgcgtgcactcgtcgatgactgttttgatctgcaggatgctggcggccgtgaggatctgcagagcttccgactgcgagacccgtagcacgccgctgtacatgaagtcaatgagcttttgcactgactgcactgacaccaccgacgggatctcgatgtcgctgtagccaagcagcagtttgtcctggaagaaggggctgccggctgccagcacgcagcggtgtgcgcgcagcatgctcccgtggatgcgcaccgttacgtcacagaagtggccacggttgcgctgctcgttgagggtctcgagcacggaattgctgaagttgtgaaggttgatgctgtgaatgcgctcggtcatccccttgcaactgatgtcacctgcagcatgtcaacgcagacacaaaacagggcatgggtcagatctagctggttgcattcctaacacctaggtttcaggtgagtaatgctcatggctcctagaagcactgcccttacatacgcaagtggggagatggacaggctgcggcatacaagctgtaggtacgatgacctgagggaaaaggaccttgaattttgctccaattccggcctttagtgccgcagccattttgggtatccatattaactccccagagcttcggctgaggtagagtggcctaataaccagatgatttgtttgcctgctattcctacagcttcagcaaagaactgaaaggcaaatggaagacttgttcttatggaacactaaacctccactttatttttatttatgtatttatttactttgccttcactttagacaggcctaagcccagattctttgggaaagtttacatttcccccaacttatcaaagtcccttattttattcatacacagtgaccatattcatagttaacaaataaacccccttcctattaagtcatatggcatattatcaaaacccacaccatgtatgcaaaaattattggaaaattcaacccagactaagatatctaccaaacagtcatgatcatgctttccggatgatggatgggctacagaaagcaatctgctagctaaaggggcactccatggctgctttctgtatctactcattcttcttgtcatctctgacaacctgtttgagcactttctagggtggttgcatgtgatatggaaggttttctgaattttctgaggcttaatgaaggaggaatgttaaaaaggtcagagatggcagttctgacccaggagactacagtacattggtgatcatatttattatgcaaacagggcactttcaagagtgaaagagagcattgttaataattaggccaggatagcaggagtaagccagaagtgggatatatgatctccttgggtaatagggtgctttatgtacttgccacagggaagtattaaacagctcccaggaggaaggcaacagctatgtggaggctgcggatagcctgacccagcgccaccctataacgtaggctgttatggcaagggatactattgataagatttggattcagaatgagaaagaaaacaggtggctacagcagtagatcttagggcttttctatttttctagctcatctctcagatggctctagagaatccccctccaaataattcttcaatcagattccccattcttgcctttacaactgaacaatcagcttgggaaagtgaaataagtgggctttcaaaaccaaatggcccaagcactgattgttggcctggacccaaatctctctgtcttgtgagaagccacctgagaggtaacagcctgcagataggaagaaggcctacctcctcaaactctttccgctctaccttgcgatagaagacttgttcaggaaactctgagttcaatgagcgtttctaccttgcttcactcaatcaccctcacatggtatgagcttaacttaataaatgttcaataatacaatttgcactaatttgtataagagcattctttctcgttctgactctatcaggtctgttatgtgcctaaaatattgtattaggctacagattccatcgtttttacttatataagacaagttctctttgccagattaaagaattaaggtaaatcccctgtaaccatgtgaacacaaaatatggccccaaaagaaggcacaaataacccaggaagggctgttcaggagctcaatcagcagcagaccaaatttcaagttcttgctgagttcgccatacatacataccatgatagtaatcacaagataacattttttaggggttacagttctaactgctttctgtatatgatttcatttaatcttacagcaaccatgggaagtagatgatattattcccattttacagatgaggaaactgaggccagagaaactaagaaacttgctcaagtacacacaggcaattgctggtagactggcatttaaacccaggcagtctggctctagagttcaccctcttaactgcttcattatattgcatagtttgccctttactgaggtctggcccttagggatccacggctctgttgtaaagctgtgtgaaaggctttgtccactactacctccagctacttctatacctatccgtgatttagtgtggcttttatgtttttaggctgtgatgctttgacatagcctcagttgtgtaacttaaaggacttatttttttagatgtcacagtgcaagaagtaagacaactaactggcactatggtttaggattttctatatacaattttactataaccaaggtctctttcatttaagtaaaacaataagcagtaaaactggttgtgtctgtgatcatctctgtgtaggatggatttattacaacatttttttctacacaagtgaaaacactctttaaacatacatttgctcataacattagttacaacaataacactagagatgtcatatatgacagttttctttcagataattctgggaagtagccctatcacaattatcacaataattagtatccatgtagtgtttgactgtgtatacaacttttttacatgtaacatctcatttattccttacaacaatcctatgtgtgttctgaacaggtttttttttgttttgttttgtttgttttttttttttttgacagagtcttgctctgttgcccaggctggagtgcagtggcacaatctcagctcactgcaaccttcaactcctgggtttaagcgattcttgtgcctcagcctctcgagtagctgggattacaggcatgcaccaccacacctggctaatttttgtatttttagtagatgagttttcaccatgttggccaggctggtctcaaactcctgacctcaggtgatctgcccgcctcggcctcccaaagtgctgggattacaggcatgagccactgtgcccagcccttcaggacaagtcttattattgctatttcatataagagaaagtcgaggctctcaaaatgtctaaatgacttgcccaaagttttgcacagtagcacatggcagtgttgggattagaaactatgcctcttaaagctttttccactgcataacagtggatcactgaggaatggaacttgaagtgcccaaagatcgagagttatcttaattctcagcagagaaaaaagaaagacactgaaagtaatgatgaaggttgctttagagataagaaatgaacacagataatcacacacacacacacaattccatgagaaaaatccaaactgtttgaccagattggattgcaaattttgttcatctaaacaatcaagttatctactgaatagtctgagttaagactcttgcgataatattgccaccaacttcattaaaaaccacagagacaaacctaaacctgcacacgtacacaacctgatctgacatgcctggttgaattttatacacacaattcttaaatatctccctgagtacactggccccacactgcagtgaacagccatgaaaagctgaatcgtttttgctgatatgagtacagatgcgaagggggaccctgcctccccattcaagcatgcctcattcctccagcacacaatgctgaggcaattcctttcccaggctttcttttatttttaacactaatacagtgggaaaaagtttctgccacagcaaggcaaagtccaggcttttgtgagcatgtccttttcatccaatgggcattaatgtatagattccaatggaataaatctgaaatactctactgtagaagatttgtcccccattgaaaacaaatcttgattagatggttattcagggagtgtataggaaggaatggtgtgaaaatgctaactctattctttcttagattggcactgaataggcatttgggctattcaagaaaaaaaaaacacacacacacacacccaaaccccaaccctatcaactgtacaaaaccacaaaactttacatagattatgtgatcatgtgtatttggggattcttccccacccaaaataaaaaatgcacagtgttatgaacacaaaactgatggcaaaatgaaatagtgataaaaatagttctctgtgttttaaaataataacttacctcctttttactagagtaaaaatacagagtcagcttgtgatggcattccctcaaaacatggaaggaattgcagtaatgaaagtcatcatgtattctaagagactgttctgcgagagcacaacacagacggggctaaagcaggggtgagtaccgaagggaaaatctgcctgtggggaattggggatagagggcctgactctctgttttgcaggaacgttgctcctgcctgtcccttaagctgcaggggtccagggataggacttagcatgagaataaaaagctgcctgctcacaagagaaaatgagcaagaaaggaaacagcaggcaatacaatctcttttaattaggtgtgaaatccagttctttctcaatcaggagagcaaaaggatatataaaatgagactagtgcaagggtaagatgctacagagggggatggggatttgaagtctctggacttggaaggaaacatcagctctcaaatgaaaaccaatataaatttcggtccagttaataagcctaagtcaagtggcagggccagaaagcccttgagctttcaatttggggcaccagatgaggttagtgggtcttgcacatgaaacagggtgcagcttgccaagttagtcacactaggaaagagccagtcatctctggagaaaggggggatgtattttggtgactgagcccccttattctccaaaccccctgcctggggtaagacttcagttacatgtactttacctcctcatatatgccaagggagtcctgctgaatccctgcactataggaggtatagtagtttcttgctaacaggttccatccacagcaaatgactctgcaccaccccactctctctttctatctcattagtatcatcacagtcttgggaggtggctgggagcactggagaaatcacacatgcaagtggaaggcagcaagcagacaagatctctttctcctatcttggctctatatacctagcatatcccagctgctattacctctgtagtgagactagggagggtcatcagcctatgggagggcgagctgtacagttttacttacccattcttgggtgaaaaggggggtgttttgggccatctcccaataaaggttctcctctatcttccagattgtctaagcccagtgtggaggaaccatcaaggatttcagcacgtttttttagccattggtaacagaattcttcacataaaacatatatcaattgttgaaatttgcagaaatttgacttcgaacttgcagaaatttgactttcaaacatgtttgcaggaatggctacctatgaaagttggggactagctggatgtgcttttttagtcactacttattattttatctagacaaagattaaaaattactaacttgtttacagtatttacaacaccattctatttatgatcccaatactgtaattgggtatgcctttaatattacctgaatttttattcattcatagaacatttctagagaatacttaaaagtatttaaaggtccttggttttatgtttgggttttggggggtatgtatagtttttataaatggacatgtttatacttttataggaataaggtcagtggctttcatcaaaatctcaaaggggtctgtgttttccccaaattaagagctgtggattgagattcaggcatccctctttaaaatacttgtaactactttccataatcaaagcttctaaaactgatgcaaactttgtgattgcattactctgatgcataaggtctgttgaactgatattttccatttacttaagttgagctgatactattttgtatgagaaagcaaacaatcttggccaaaatgagaaaagttacttttcagaagagaaatattttttaaaaagattgaaagggaagagagaaatgtaggtaactactaatattagcagaaatctggattatgacagacatatagtttacaactgttgaagctaactattatttagcaaactttgttttactcagagtaagtcccttttgacagttaagacaaatccacagaagaattagaaaacaccctttaacatcttttgactgttaaaaattagatattgtggtataatttgaataaaaaataaatataaactcaatatacacatctaatcagccaaaaaaatagtttacttgcaagatctatagcacttgtaatggggagactgcctttctttctattttcctccttccctttcttcctttttgctgtcataccacgaagttttactaagtttgaagtatggggaacaaagaggcaaaattgagaactagaaaaacatttgctctgtgattttcaggcccatccccaaatcttgacttatcttccattcctgacttctttttcctctcttcactccaccaaaaaataagagctttatactttatctaaggctgagaatagatttacagtactagtgggattttacaggtccaaaggagaaagtaattccagaaaagtctttttacttggccttagaggtctcacagtctcccttggttagcccaggcctttggcttgcctgattttatgttaagtctgctgttctctctaagaaaggatgagggcatgcctatccatattgtaaaactgtaaatacaactgacttatgaatgaagctgctttgggggtcacttgaattttcaccaattcattagtgaaacatttactgagaataccccagtataaatggaaccataaggatacaaaggatcttaaatctaaatcaatagaagaaatttatccataaggatctttgatattggaaacatatattaatcaatcaacttctcccagacctcagtgctcaggaaaagctgtgttttgcttttctttgtggagcctgtgaatatcataactgatcatgtttccctcttggctctgttcactagggagctcagaataaaaatttaggcccccttttagcaactatgtaggacctcatggtatgcttttctatgtaaaattttcaccagcctcattatattatccattctttattttacctctactctgatttctttttttttgtagttatatagaaatacatttcctacatatttattaacaattgaatattaatttaagctacctcaaatcccttacttatgaggtgagggcataatcaatcaatcaacaagtaattgagcatccactttatgaaaccaattccaaccataagttaaaacttcagtcttgagtattatcacactatatgctttatgaattttttatactttgagcatctgattccaatgaggtaaactgttgaaatttactttacagtacagtttgtgaaaattaagttttactctgtgaataaagaattggatagataattccagacaacattctgaaagacacttacgccgtcattccaaagttgaaatgaaatgagggggagaagacttgctgggactaaggaaaaaagtcaatgaaatctgaggttgatgcctttaaatcctcttatattgtaaaccttttgagacaccttttaggagtttcattttttctctctctaaagcgctttccttacaaatttagctactgccctattgtaaccttttcctttgttcactaaatctggggaacaaaaatacagagatgctacatccgtgggtggtatacaaaaatgaaccaaaggatctacttaaattcacaaatttgtgctgtttgaacttggctttgaatagaccttaaagaaggatctgtatattcaattgtacagttaataagttaggtcttttgttttgcttaagaagcaatcacaaatttaaaaattgagtatatgaaaaccagcatcttcttacttgataatctgttcttgtggtctctacataatcatatacttattttatagaaaaaacagatttataaattcagtgagttcaaagattcagtataactctcaggtatggcatttctttaaagaatatcatcacacactgatgaattatagttaggtaagaaactgattttttgactttgggaaaacttttctctggacttaaacgagtgagaaaacagaactcaatagtgtcattaaaaaaaaaaaaagctttctggcaaaaaatatcattgagttcccaattcatagaacttcctttagtcctctgttgctgtgctgttctgaaactgcttttgaagcaggtcttcaaattcatgctcaaatgttctcttcccttgggtctttctaacaaataaaaaaaagttgcttccaatgagaccgctgtttttcaagagtatctctgtttgttggtaggaggggaatgcaagattttctttttttttttttttttgagacggagtcttgttctgtcccctaggctggagtgcagtggcgcgatctccagctcactgcaacctctgcctcctgggttcaagtgattctcctgcctcagcctcctgagtagctgggattacaagcgtgctaccaaactcggctaatttttttttttttttggtatttttagtagagacggttttcactaagttggtcaggctggtctcgaactccttaccttgtgatctgcccaccttggcctcccaaagtgctgggattacaggcgtgagccactgtgcccggccaatttctctatggacttgagccatgatagataagttcactgaggagtaaagaccttctatcccaaagcaacagggaaaagccaaggaaaaaagtaaatctgttttgttggatgactggttaaaatggaagcactgagatgatttgtgtgggctaggttaagagagtagctgaaattcatctgcgcacctagggtatagaaccaggcacgggaaatcattaaaaaaaagaataggacctaagttcctttttggctcatactgagatgaagaataagtgctgtcagatagaactcaaaaccttgggaggttctggtaaataagtaaagtagaaggcatactttataattattttaatcacaagtaggcattttatctttatgatattctttatatagtcttttgtataatatttattatattatttacatattgtcaaaaaagacattgagctatagaagtctcctatagctatagctaacattcaaattatctgatttcacttcactgatttggttggatttgattttctctaaaataaaatctctgtgctaatccaaaaggttggccattttgctttcctgtgtgtggattacattcatttttacttctcttctgctgaattttccgcagttctgaagttattgtggtttctctcctcaccaattcttatcatccccatgaaccttattcaaactttttccttttctgtgaagccttctgtgattactagagttcacttttcttggtttccactggttggtgaggtaataaactaagacattcatttttggcttgttctcactgaattagaaaactttcttaatgagaaggtatctcccctttcctccacctgtaggaatgaatggccaggtttttgtatactttataggctcctttgcctcagggagttgtggtttcagagcccattaagccctaaagaataaaccataaaacaaagagttttctttcctaatgtctgttctctaaaatgaattattaacccagaatgggtaaggagagtgaggctgattgatgctttggagttagagaattggatagcattactggagagaaaaacaatccactttccctcaaatgcagaaggtagcaaggtctctacttgcatacagctccagttggggtaattgcttggcacacttctggaggctggacataaaaaggcaccactttgagaggaacagtgatcatctgggggctgggccaatggtcaacagcaaggaccactgtggagggcatctgtaaacccagctagtgcagtagtgctggcagtcagaaggacgaggctcaatggcatctttgtggggtggtcaagcaatgtcaatgttggagaccatcatggactaaggacttagatttaatgagtcttgtaccaatctagggatgagaagggagccccaaaacttgtctgtatttcttgcgaatttggtgacaggggcctcaggtttaattttctttagaaaaatacgggaatttttttgtacctgaatgttgaggagtgttggggaagttcacctgaacttcctatacatgtagcacctaagttagttcttaccaatatattattgtttcttttttcatttgtgtctgtcttatctctctaagactcaaagcctcccaaaggctagtatcttgtcttgttataaccacaactacaatgacaactacaaatatgtaactggatccctcattgtgcccagcatgtttctttataatgtgtgggttctatgtgagtgcttgtttggtcagctcttcgctacacttcacaaacaagtgggaacctcagggcgcacatttactctgagatatgtctatgtgatatggtcctgacagggcttttttgcccctgaagttctgtgtaatgctcttcttcttgtcctttatttccctacctacccacagttctattttcaatagaatttaaagtccaagcaattgttttatgtgttcactgagttgcccacaaactctgctcattcatttatgatttctgatacatgccatgctgtctctgtctccctgattccatttccccagagagacagctcactgggtccccctgtcaacagaggattcagtggaacccaaagctaagccatactttgtaataaaaaataagaagagatgaccaatctatgatgtgatagaaaaatgatcaggccaaactccgatcacttttgcctatgttagggaagctaacctgcttggtaacagatgttacagaaatatctatcaatcagcattgataacagggtatttatatgtacattaacagtagtgtcaaggattgtttagaatattttctcttggtggccactgggtgtcctcatttacaaagtaaatatgcaatatttagtgaaggtcactggagagaataaaagacactagttttctctttggcccttcacatactggggataaatttattgctgaactcacaagcaggttatatattagtacagtttaaaaaccttcaggtcaaactgttaaaagtttataaccaagagtaacttattcagggtccagacatgaattttaaaggctgtttcctcaacagaggggactgtgatcagctattagaatgatcccttattcatttgaaaattggcatgggattttgactatctgccgagagagccagcagagaggagcagagaaggtcttaatttattcttgaaagaaaagagaacaccaaatatctctatgggatatttgttagattctgtttttatctcaccttttctgaaaactaattaaaaataataatgagaagataaaatatgtcctttgcctaggaaacctgaaataatgtgaaaaacattacaatgagctgggtcagtatactgattatcaatcatttcacatttgaagacaaagaattaaactattcctttatggacctgttatcccacctgtaaaacaaaggtgtgtatgcttcacagggatgttgtagggacaaatagaatatgaggcacacaaggttcctaggaagagaaactgtacatgagatagatttagggcattactagtattctaattgaggctgagtcacagttgtatatgacttgttcctgctggaagacagtagtcaaggccagagctcacacagccaacaaatatgttctgatttgctgctctcagacactgagtctgacacactgctcagcaatcacttactgctccctaaagtggtattttgcatttctaggattgtcattgtctctaaatttatacttatatacatcgctgatgaggttcttcccttgcaaaaagaaatttcagccttcctccaattcaagatacaggcctactattgaatacataacagtacatggccttcaaatgtcatgcctagccaattagctaatcctttcccaaaataaacttcactgtaatattttttttttcactagcatacatccccagcttaattactattctctggcatgttatttcagtacataaattatcaatatgattttgtgtcaaaaccaacaatttgaccaggcatgttggctcacacctgcaatcccagcactttgggaggctgaggtaggtggatcacttgagtttaggagtttgagaccagcctagccaacatggtgaaacctcgtctcttctaaaaatacaaaattagctgggcatggtggcgcatgcctataattcgagctactcaggaggctaaggcaggagaataatttgaaccctggaggcggaggttgcagtgagctgagatcatgccactgcactccagcctaggcaacagagtgagactctgtctcaaacaaacaaacaaacatcccccaacaatttatgcaaacaacatcagggaagctaggaagctctatgagctattctctgccgttcagatatgttcgattgtcttactagctgagcttaacagccttttctgtttttaaaggaccaccatgcatgcctctagtacagcaatctctaacacttaatcaacagttacgtctacagcaatacacaatagccaggtcactttcaccctgagattatactaaaggctcacaatatgctcagagtgtatggaaaagtgtctcatttcttctaaagatccttaaattccttgcttttatagtattatccaactgattaattagtagattcatttttcaactactgtagccccaaagatacatatcggcagagccctcctgattgtattttacccttggccttttctccttttagtttcctcagtttgcacctgtaatttcacttttagaacttctctaggctcggtggctaaacaccacacagcacaggctttatctgatgtgccggcgcctggtgtggtctaagacacactggtgttttgttcttgaagtacaggattgatgttctgaaacctaggctctaacacaaaggagatcattagctcattttaagtgtctcttttcttccctcccagcctcctcctacccaccccaatacttccttagtcctaagcactggcagcagatggcaaccatattccaaagctgagtatacataaaatagtgccatggagaacagagtggcttcaaagttagcctttctattcaagtgggatggcggggacttctggaggagtgaactcatctctcattcatttaatcctctattcattcagccaggaatttgttttcctacacatccatctactgtccagccagttgagggagggtgggcatgaagcatctctcttgagggcccttccagcaggagggcactaagatttctatgccaagctcttgtttccctgggccagctctgcctgctgctgatcaaatcatgccattcctgtaagaggagcttgggaacacagtgtgtagggggtggatttctcaagaactatctccttgctagactgacagtcacatgctgtattccctagacaaagattagacccaggaaaaagatgaaacaaggaggaggatgtggggttgcagaaaactgtgcaggatgttacagtaacgggaggtgggagtgggaaaacctttcctttttgttgtttcaaggtttgctagagcttttgcctaatcatctgtttgagcatcttgaaaataagtatctatttccatggtatctatcaaaaacaggcaccagattatactacaaagttgacctgccatattgctattagaattaaaacatgtagcagcttacattcaaaagaaagcttttctgtttccccagcatgaaaagcagagggtatttgtgatacactttgttttgtaggtctgctgaatgaaaaaaataatcgggtaaaaaattagtacctatattttcacaaatgggcataatgcttacaaatgcactacatcattattttagcttcattctccccacaacattcatttattcattcaacaaacatttgctgagcacctactcctaatttgtgtaagcactttgctgggtgctagggattcagcagtggacaaggtaaacaagattccgccctcctgaattctgtcacctggccaaaataaacatttaacaagtacgctgctagaattttacttgagaaaaaggaataattcatcttacctagtatttcttctgaatctttcttaaacatatttcttgaaggtccagactcctttaactaagaagttctatcttaaatctctctctttccattgttatattcattcctttcttggttacaatgtggagagttcagattgcaactgctatcatttctggggggaatgggggtgggactgtaaccctgagaatccttgcttttcaaactacacatatattttctctgtaaatattgtaccatctaatttgcgtctttggattttgttgattagccatcaacatgtgatttaaggaatactgcatatgagatgcagaaatcatgactcagtaagttattattttaaagctctattttgggatttatacagacttgtgtacagtctagtttggctttcaatctaatctgcaactattactaggaggcttttagatcaagttccatacccatgtgtctctggaattctacagtgagaagcaaaagtgctcaggagttaagagaagcagacgtccgaaattatctccatgcattaccaaaaaccgtgggcaccacggcacggggaaaacttaccaggtacaatgagccagtgactgttactgaatttcttaagattacacttttcccaactactgcagactgcttcagaatagaagaaggtaagtaagcagggtgattacaagcaatcctcctcggaagtgaaactcactcttctaagtttacctctgttttgaattatttcagacaactctcatgccatcaagccgacggactttcaaaaaaataaaagatgcatttctttacttgtaagtatttgtctttgcaaagggctctctgatatggtagcacagaagtttgcacattctaaggatctgatgttttgccctcttcgggtatcccggctggaaggagctacggtgaaagggcacctaaggtgaatggacagattgtagatgggtgcacacaggaaaatgtacagctcctacaatgtattctgaggtaagagagcacacaagtccattccctataatttgaaaatctctcttctttttttattttttagagacaggatctcactctgtcacccagggtggaatgcagtgggatgatcatggctcactgaagccttaacttcctgggctcaggtgatcctcccacctcaaattcccaagtagctggactacaagtgcacaccactatgccccgctaactgttttgtagagatggggtttcactatgttgctgaggctggtctcaaactcctgggctcaagtgataaatccacactggcctcccaaagtgttgggattacaggcgtgagccaccatgcccagcgtgaaaatctcttattgactagaatgcacttgaagacaaaaaggaacttaacaggttaacactagaatgtaatgctataatattaataacactctaacccttccctataccaagaagacaacattcagagagatttgaaacttctttcagccccagtttccttatctgtaaatggggtgttttgtaataagattatgcatattagtcctctttcatttttaggaaaaaaaaacatacaaatgggggaataaaagaaggcaaagagataatggagaaacttcccagtctattcaggcctgaatccaagaagggacaagaagaagggcactggcttttcctcgaagtgaaggatgtaactgtcttacacacaatctcctcccatagatctagggcttttcagcctcagtcgttctcagggggaaaggatggggacctgcaacaactttcacttaggctgcatcaattttagttcatattaataattttcaagcacttaaaactgtagccgacactcaaattcacggagcgctggctgtttttctggtgctgctttaagggctttacatgtagtgttccatcgaatccttctaataaccctatgagatgcatactatttttattctcattatgcaattatgcacatgaggaaatggaaacatagggaggttaattaaaggcacataaaatgcattcataggctgaagttcatgttaaaaagagcaaataagtagaccatgggggtgagaaaatattttctgaatattggaaaacaacacatagccccagtcttagtccattagcaacatgttcaagaaatagctttagcagtctgttatcatacctgcccccaccctgaaggcatatcggagggacccgagaggacatcaggagccattctgcattgggatgttcacagggacctctcctcattgcttctaagttcactcttgggtgccaggtttgagggtgcagattctgattaggatatgtcctggggaagtggctttttccttctgttagttctctgaccctaatgtaacaaaatctttaaacctgtgtcccagaacaacacgcaggaaagaatatgaacctctaaaagaaaggcccagtaatggtaccagtagagtccaaggcctccaggtcaagaactcctgctctggagcagggctggaagtgggggcacgctttgcctgtatcactgcccagtgaaaccaggcctgctttgcagtgcctgttagcatgtcaacccaggattacttaggccacttcaggaatcccaggatctagtcacccatctgggacctttaggtcaggaagaaaatggaatgggctagatttatgaaaattggaaaaaatccagtcaggtgtacctataaagacctacagtatttccctgagaaaatgacatgtatcctttaccctggggttaacttctaaaagttttagtttagaatttgcatgtgtcttttccattagacacagagttatcttttgtagttcaaacttatatgcacctttctttcattgtctcctttacatctaaatacctggttaagatatgaggcaaagagataatcagtgattatatagggaagaacgtgattacagtaaaaaattgaaggacaaagttaattcagttactgctttttgaaattctttgtagtattctacatgccacaccaagcttttttaaaaattctgtactctttggtctaatatcttggtataaaactgataacataaccaagctaaaactagtgaggataaataagtaggaggaaactcatttttagaattggagaggaaaggaaaaaactcctcaaggtcaattttgacatcaactataaattcatttggccttgtgaaattataaagactcatgttcaacattgttccatgtggttgtttatataattttcagtagtgacaaaataatctccttatttagttttacaggtaatttaatagtagaacaaagtatcgtttgattcagttggttccagatcaccatcctacagtagaagtatatcagatacttttgtgtacaggtgggattggcctttggaatgtcttggaccatcacagaaagcagcatactttaagtaaacaaattgaaaccctccctacaaataatgaatttgaggatgtcccatgacaatgaaggtggccttgagaacaacacataggtttgttattagtaattacagagctacctgaattgggcatatcatgaaagaagtacacagaacatggcttttaaagaattatgctttgtcatttcaaaaacaattgtttttaaaaattgttttaaaaattgttaagatgatttaaatgttcaaagtgtatgacacctatcctctgcttagtgttcagaggttactgagggtaaggaactgagttaatatttgtgaagtaataatacttgtaaaacattatttctcataaaaaataatagaaagcaatgttgagaagaagtagagaaagaaccagtataatataattactgcctcactgggcttgggtagtgccttcaaattcctttcacatatatttaccattccaattgccctgtgaaatggaagatctaattccttctcactttgcctatttaattgcagagtctcccttaacactggtttttctcagtctataatgggctaggaactcttgtatcataaaaatattcattactccacttttgagttacccattcattatttctttttaaaacattaaacttgtactttgtaatagttgctttcccatttatcctatgtttgctcctgaacccctctttatggtcttttttgtgacacatctgattctgttttcttgacaacaatcaggaggctagtaatcccaaaacctaaggtaatcttttcctaggtctctccctcgttggtgtctgtggcacctgatactgactgctgatccttcctctccctgatggtctctctgcactatcctggtttttctcctatcccttagaactctcttttcttttcctctatttattcattcttcattctctttcttatcactcatgtaaatatttcccaaggttttgctttccttttttctctcaacaaagacttctttgaagtttactcccatatttatggcttatagtgctcttggccaaagtgtttgctagtcctaatctcacgcattcctgctgtgccccaggaccctgtttgtaactcagtgttagttgtctccactgggaacacctgtggtagctcatactcggcactatataaaatggaattcaatttgattcctttaaatgcttttcatctttacttgataccttggagttatctttgataactgcctttgttgtaactaacactcagctcccagagctgtctaccctcatccacaaaatctgttgcacctggatcctccccattcctcctattaccgcccccttcaggtcaccaatagtgtgaaatactgacagtgctgtctggaccctctccttcctccagttgctccttctcacatccaggctgccaaattagatcttctcaaaatcttgctcatggtaggccctacttaacacccttccacagctctgcaacagaggtgcaaacccctcatacctagtcctgatgcctcatttccagtctttcaaaagagctcaaatggagccatgtctaataaacctacctagatattactgttaactggattaaaatatactttacaaactttctaaattctcagatactggtgatgtgaggatacatattgttttaagattcttggtggtggggtctgtttttctccacctttgtgtcctcatggaactcactgtagtgacaggcacaaaagatatattctatacatacttgctgagtgagtgaatcaatgctccggtgggtctctgtgtatggggacatatctttaaccacgctgcatggaagttgtttgtgaatgttatttgatcttctctacaagactctaagtctctgagcctagggctccagtttataaaactgcgtcctgcacaatacttagcctgtggtcctccacattgaaagcatccactatattgatggatgaatagtcctgactcctttctgttcagagaacattaagtttgtccagaagcagacttagtaacaagcagcataaatggtgggagaaagggcagggttctgtttctgactctgtcattcattatgctgggaaactttcgttataacacttgtgttatttgggcctcagttttctcatgtgtacaataatgggtatagaccaggtaacctttaatcttgcactgctgataaaaagttagaactggcacacattcctcagagagaacaaatgattcagaggcagaagaaaagcaaaaaagaaagcaaaaaaaaaaaaagggattctgctgatgaagtaataaggtatgtgattatggtacctagtgtgaggtgactggtggaaagatccgacttgaaatttccttaaagcaagaagtccttaaagaatcctcatgcttgctctcaatcaatcctaaatgatccaactctaagggcagtagtgcatgtggcctcttttattttaagtaaggatgtgagaagtcttgacagatatggagaagcactaattttatataatgaaatctgccatgaacagaggaagcacacatgaaactgtcactagcagctgtagataagaattaaagatgtattcctgcatgggatgagatggcaagatgaagaacagaaccgtgaaaatcagcattgggccctaacaattacatgtggataatcatatctatgcactgtttgggagagcaatatgacacagtgtaacttgagccaatgggcattgagaccagacttgccaagggacctgggaggattttataagaggacagactgttagagtcgggaagggccacaaatccatgacaaagttccagcatgacacctgtaggtgactctggctccatgaatgaacttttctcaacaattagttattctgagccaggtgtggtggctcatgcctgtaatcccagcactttgggaggccgaggcagacggattgcttgagctcaggattcgagaccagcctgggcaacatgatcaaatctcacctctaaaatacaaacaaacaaaaaaccccccaaaaaactagctggctgtggtggcacaagtctatgttcccagctactcaggaggctgggtgggaggattgcttgagcccaggaggcagaggtggcagtgagctgagattgcactgctgtactccagcctgggcaacagagccagaccctgtttaaacaaaaaagaaaaataaaaagaaaatttattttgtgatttactgatcaaaatcatcactaggtccttcagaatactttctttttttttcctgagatgcagtcttgctctgtcactaggctagagtgcagtggtgcaatctcggctcactgcaacctccgcctcctgggttcaagcgattctcctacctcagcctcccaagtagctgggactagaggcacgtgccaccatgcccagctaatttttctatttttagtagagacagggtttcaccatttggccaggatggtctcgatctcttgacctcatgatctggccgccttggtctcccaaagtgcggggattacaggcgtgagccactgcgccttgccccctcagaatactttcttactttgactggctgtgtggaaggaagggttcttttgcctattagaaaataagtagatgtcttgctttattatatatttggaaagcaaatgtctctgaaatggatataggattcagctcagctgaattataacaatagacaatgttacccaaatacaaatcttcccatgattaaaatgaggcaaagtataagaaggcctcagtgtcataactgaactgttctgttttctgaaaactctgcgctctgtttgtgcctctatggttttgcttctttctattccttctgcctggaatgccattacttctgccttctactttacaaatgcccactcctttatgatccagtttaatttcatttttggtgtggagctctttccacttcaagaggctctttcctcgggggctctgtagcattttgtgcatactggaacactttaattctgcatttatatttaccccgttatgttccaaagtgtggggatggggtcttattcctatcttcgtccctaatcttagctgaggacttggtgcagaatgagggatctgataacatttgatcaatgactgaattaatgactaaatgaatgaatgaataagaacgactaccagaaattactgcattaagtgactatggaagaaacccagttaaattggtgttgtagggaaataataagttttataaaaagagggccaatttaaaaaatagaggtagattaagatacaaagtttcaagacctgtgcttttttaaaataagtgtgtccccaaatgcacaaagtggaaactctaggaaattagagcaaataaaaaaaacgaactggccttccaatgtataagtgctggactaagcactaaaatctctaaataaagggtataaaaggtaacgaaaaaattccaaagagattatatatcaattaactaagaggcagaaaggtgactttttaaaacgggaaagactatctttaatgacaggaaatccacatttaacagatgaggggcttacttggcaatgaaatgacagaaaaacagtttaaatgaaaagataaatatataattccttacagaacatagaataaagcagaatgcagaacactgggggcaacgagagcacttagttgtaccaaagacactctattactgcttaactgatacggaatttattagaaaattaataacaagccattggatagtaactgtctgtggttgttattccattccattttggctatattttctctgcaaattagtgtgaccctaaaatgttttcaggattgtccaacttgtcctaaattccataaataaactctttcagaggatgctgttttttgccatgtctctattacggttcttcacagatggaccatttttgtccttccaaagtctaagaataactctttcagttatcaagacataccaaaatccagttcagctgctcctgtgggattccagttagtttagacacatctgctgagatacatgcatttgaatccaaatgaagcttttgtttgattatacattttgaacatttatggaggttttctggggccaaaatgtttttcattttttggcacaccaaacagagatcttcagttataaacactgccttctgagcacctccaacagaaatccaatcttttcatgtgaacaggtgcctcaggaagtttttggaaggttttacactgaatcagctttccgattggaaactttctgaacatgcagtcaaatttgccaaagagaccttcaaacttgcttgagcagttttcactcatacagacatacattcacacatacagacagcccaagtaaaagcaaatcagagccctgtaaaactgaagtatttttcttaaaggttaaatatcatatgcaaccaaactgaacaaaaagaaatacacaacaggagacagaatgaacggatagcacgaggttcttcattgagcgtgtctgccttaaagccttacctagagtttaagctatacatcctttcagtaaagttttttatttcatctggtttcaaatatatactcaagcattcgcatttttaaacacggcaccatagagtattgctactaacgcctttcaatcacaaacccgttcaaacagttattttgaaacactgccttctctaacacaaatgggtaaaccagatttaaatgtaaaggaagaaaaaaaattactctttaagtcaggggttctttagcaaagccctcatcttacctgattccctataacttttactttccagtttgaatacagcatagactaaaaagttgttatagagtaaaataactttttaagccttaagcctataagtttttacagagtaaaatcactcccccagtgggcatgcctgcaattcaaggggaaatctgctttcaagttgttctaatggccccgaaccagatgctctaagatggccagaaacctttgtctacacccacttagcagatttctggctcgttatcagggactaaaaggtttattcacagaaatgaataatttccttcgaaatatcccttaccctatttacatgcttgcatattccttccattttgttttccccctacagctttactaagggaattaattatctggaagaacaggaacatacagtaagtacatctgagttacaggatgagacacagtatgtcatctattaggcctggctaagaccagcagctgatgctaaatgggaaggaacatgcaccaaatgttttttaatcacaaagttagtaattaattgctctttaaaatacattttatgcttctttctgtctgtgtacatgaaatgcacatttattacatgccaaaaattacaacattatggtttaaatgtgactggcacggaagtccggaaatcagagttaatgttcccacagcaactttaattctgtccgtgtgcacatgtagagctataatagtcttccgttccaggataatacgtatagatggttttgggagggaagctaaagacccatatcctcaactgtagttacaggaaaaaaatcaaaggataaaagctgtgctcctttccacatacgtggataaaaacaatgtccccacacccagtgttgtgtaatcagggaatgaaagaatctgctgtgatgccagcactcaaggggacagtttctgttgctgtgggaacctgaactttgcatttcctgactttggggtaattaaaatgtcagccttaatgtggcattaatggagtttgccataaaaatcttctgttttgttctctaaaaaattgcttaaaagttcaaaatgagccaagtgtactaaaaattttaatcacacagacttgggcgggtgaagcaaatggttgggagggggaggccaaggaaggtggatggcaagagttggaaaaggaagagcccattggcctctgtgagtgtccagccccagcagaatgatgctacctacggagctaaagttaaacccacccacacaacagtttggaaatgtgtaaaggttcaatgaaaaataaataaaaactgttcatgcgtaagtgcatcttggcaaagacacaaaaaatgagacagtctgatgaggccggtataaaacatgggaaggtaagtcaccatggatatcagcttccaacaaaagaaagacatcagaataggtggatctacagcagaagtagggaggacggccacagggaggaaaatcacttctttcaatgggagccttatttgggggaaaacaaaatggaagaaatatgcaagtaaaagttctggtcgcgtctatcacatgtatatgactgtgatgtgctacagcttgatagctgtcaagaaaggtttttcatatggagagcttcgtctgctttactgacttggtttagtcctgcttaagcatttaaagggagcacttggctcagctcatactcagcttgcttagtgagtaactgctctatcaaacacctagggtgttttttacccttcagattccataactcatcttaatgccttccattatcaccatgtgaatttgcttaccattagatttttagcaatggtgaagaggtggtaagctagggggtaatgggggaatattgctaaaaggaaattgtgttagtaggcgcactgcaaagcaacatacattttagcagcaatattaacctcatcatctcacaaaagaaagcatatctcaactatatttcttcttgttttgaataccactgggatcttttgccgaatttgaagaggctcaggaggttaaacagccaactgagaatttagggggtcagacttgtcatctttgctgtaaaacacagcctgtgtccttcatatgcaaaaaagatggtggcttacccacccatgtcagttcatatgcagagctgacttttcttttgtggcgatgctttatccatcatgttttacaacccagtcaccaatatgagtagttgcacattttcaagatgcctgttcagagccaggaatgccgtctttgggctcagaacagagaattccaataagaaatgctctcacaatgagagcaaatccataaacacccctcggtacccaaatgagttaaccacaagcgagtcttccatctacctgggtgtcaattttctcagttttctcatctgtaaattgggaaggatcatactgacaggatatgggcattaaatcatgactaagaataattttgctaaacacatgacaaataaaaaggtgctataaaaattcaagcacttgtgaaagcttggaacaacacacactggtggaatgtttctgaagttaaagagactaacaagtcaagggcactatttttaaatgccccaaatctgttagttctaaataggaactgaatattttaccttaaagaaattaggcttttaaattaatctatggtaagaatgacatttgaaagtaaaaaaaaaaaaatcctcttgaatgcaagaagagcatccaaaaattttaacagcttaaaataaacctttttcctgtcttctctcaagcaatctccaaatggacagatttctgtgaatctttcctaaaaacaattttcttctaagtgtaggctcaaatcaggacaaactacaatccaaatatatttggagaaaagtataatcaatttaaacaacaggttggaacagagaagacttacacatcttaatggcaaaatcaaagtgactgtctaaaaacagctggagatcaggtttctcctcctggtttgtttttccaactgagctcacatccactggcttccccagggccaccaaggagatgtatggtgacaccatactcacgctgttcctgaaacttacttcatgccaatgctaaggcctggccagaggatgcttatgataaagcacaataagtgaagcccaatgctttttctattcacaaaacattcatttttgctgtaacagaagatttctagcctaaggcaattctatgtaatccatacccataaggtgtggcagaaagctgggtaatgaagacctgcatgtagaaactccaggcccttcaccacaggaacgggctattttcctggtgggaagggacagtgtgcacatgcctatgggcactgtgccactctactttccaattctttctgtcattactattacactgaagattgccaggcaagaaggtccaaggatgtgactattaggacggtcctcagaacacagtccctgcttctgccccctggtttctctatagaagcctcaacttcgactgttcaaatcacataggccacagagatttgtctcacgttacttcccttttcattttctagtgacggctagaatatggtcttagcccaaccttaaatagaacaagctctcttcaccccaatcctgccgccagctcatttccctctctttagagactatcatgatgaagcaagtagagaatggaatctcctggaccattgtctcttgccttctttgcagaattttacatttgttctgtcagaaaaataacaataaaagatttagaatctcatttcctaataatttttgtctttgtggacaaaattttatttttgaaataaaactttgcaggtcttatgttactcattttaaagaagaatatgccagttatttgcatgttaccagacatcctttatggagatcagttcagaagagttgttgggtatgttaagactaaaaggaatattcttttggattcgactccaaagttatttcattcctttccattgtcaacacacatgtttctttttctctgaagtattgggttacatttcagaaaaagaaaaaaatctcctaaacgtgatttatcaacttgcttaaaatagaattagaagaagtgactcccagattagtgggaagatggcaaaaataaacagcaaagaagtgatttcaatagcgacgatctcattaagctgcccatttccaaatttagcccttaggcagtttttttaattaaaaaatatttttaacctggattctcattggctgtgtgaagtctgggtggcttctgaattcttggaagccattctcttttcttctgtaaatttatgctatcctttaaccacttcaaaataaattaaaaactggaaagacagaaattcagccaagctacatgagactccaataactaatgcaaatctgacttgtgttatgtaatttcaaaatggatgtttccttgtgtctaactggccttctgaggtccacatttggttgttcaatttagtaattgtggaagtgccattatccagatcaagaataaatggataccagcaacaaaacttcattttctgggttagtgttatgaaaagaacgtgttttatgtaattaatcagccctttaaggccaaatggcatgtcacctggcttttaaatacactctagctttgcaaacttatagatattggctgaatgaaaatggtggcacattacttttggctgctttagaagaccaaatgcaaagagctcgctctgaaagtagaaaagccagaacccagggtagaagcactactccaagcactgcaaagacaccatcaccttagtggtgtactcacaatcagatgacccggtgtgagcgtgagagtttgtcagtgaatgtgttgagtggatgagggctgggtctggagacaaaacagcttcaaagttcaggcagggaaggcccggcttggcgctggatccacccggctgagtaatctcattctcctcagatgccttctggttttcagctgtcttgggtttcttcctgaaaataaacaaagggccctttgaaggaactgactgcatatttgggaaaaggcatttttagaatctgttaaagataacttgattttttttttctgaagggggatgggagggagtccagtatgtcccttgttttaaaacaagctgattcttgttttttttccctccagtaatggcctaactgggaacacatgaaagcatatgggccaagcaaacagcaccacatttggactctgttggctgcataaaaagaccctgtcccagaactttagacagcttgagctacgtatggctgacattatccaagaaagcatccctcttccccccttaggagttttaacatggtctggaaaaatactagtggaagttttaccgttctagcatttgtcaggaagcttagagacaggactcgtggagtaatgggaggagcactggactgggagtcaggagacttgagctaccgtactagctgtgcctctaacttgctgtgtggccttgggcacctcacttcacctctctgggcttcagtttcctcatctgtaaaataaagggcttggattagaaggccttaaaggttccttccaactttaaatttctactcatggactacattaaggaacattcaactttcctgctcttattaagattttattttaaataaaatttcaaatcacaatttaaatttgcagcctgtacggatgagggggtagtgatgggaggtttctgttagagtagcaagtgaaaagtgaaaagaagagcttagattctagtagctaaagagggaaggtgtcatgcagagatttttctactccaactctttactcatcctacgcctaagatttttgatttggtgcatcgtcctggagtttagggtgtgattgtgtgtttgggacatgaggaagagaagggtgaagggaattagaaagtaattgttactaattgttatatggggtcaggaataggaagtaaaacagcacagctatcagtcagctcaggtctcctctccccaggacaatgcaactgatatgaaattaacaaatacttagcttatactacacagaccctagaccacagccaaactggtttattagtaatagttcctgaacatttctccaattcccttggatttgtgtctttttctatcattatgtggacatgaccagaaaaagcatttattttatttgtagaagactatgtgtggtacagaatttgttgtaagtagatttgtttccatgtttcccttgtttctgtgagcatggtaatgtacttgttatgcagaatattttgtatttaaatttgttgtgctgggtagttaaatctgccctcgcagaatatggtgttatgattagtatgctgtgttttcagtccaacaggttgtgaaataaaatctgtttcttcagagggcaggaggcagagatggcatggcaaagattagaatagaggtgaggctttcagacatctttttcagtatggaggaagccaatacaagagaagcaacaaattataagaccttatcaattgatttttgaatggtgactatgggagtaacccccaaatcttgagtgtctacatggaccctgaaggagctggtattctgattttcagtttaaagatgtagccaagatcaaagttgctaaagcccaactcctttattaaaaccaatgctttctctaaggtccatatctctatcactgttgtctaccaccaggttggaaacctcagggtcactatacaccttcctctgccttaaagccaattcatcagtaagttcttacagttctgcttccttcatattttttctcacatctgtgtttccattccaatttcactgcaatcacctactgctttttatctagctgattgtttactaactggctctccaacctctttcactcctctagtcctgtttctttgcattcactaaatctaagatgactacattagcctgacactcaaggtcagttccgtatctcttctaacttttctcatgtgtcctgtatattggccatactgtaccctcagatttcttgaatatcctccagaacatcctgggaatctacattctgggctctacatctttgctcaagttttctcttactttgaatatcccatatttcatctctgccctgttgaaatcatacttattatccttcatacttattaaatggtgtcttcatcttataactgtcttgattcctctctgccaggtaggacttcactccccacagtgaattcctccctaggtctttctccgaaatgcctaagctcttttttttcttaatcttatttcactcactcaattttatttcaataatggctatttatgtgcatatccctcttgtgagactgtaagctctctgaaggtaaggaaatgtcttagttattttagtattcctagtgttcacctattcttttcttcttccttctctcctgtcattcattcatttacatattcattttacaaatatttatgatgtacccatgatgtgccaacatgggctaaagaataaaacaggactggttccttccctcccagagtttactgccttgtctatactattaagcaatgtagcttagacaaagctgtcattcaataattgattgtggacagaatgaaatgaagctgaaattaaagtgtattttaagaacggtcatagtctgaatcccaattaagtttcctactttttatgcagcaaggtagcaaaactacctgactggctgcttttgctttaagtctgtgaggggtatttaataagagcaggactattttgctcagtaaggctaggctggccctcatgattcatttaaatatagggtcaaaacagtaatgacatatgtcacctagcagaaaaaagtgtttatttttgatattcatagacagggcctaggatactttcagatgtgtgcttcagaaaattaagaaagctttctttcaaacataaggacatagcaaaaccaccaatatattactcttttatttttaacactgcaaaaattatattgttcttcatatcaatgcccttgtttccttccctagattcgctcttgtttcctacctgacatcttgtatcacaccctcctgttgcctcagtgatcactttgggagaatattgatagcacagaggcattggagctacctctataaacaggaaatgttagcaactcaacctttttggctcacccccttatttgtcttatatcactttacttacccttataccactgggctgtttcccaactgtccagataatagagaactgctcaccatcctcagaagcaattcatgtcctgtctcaccctctctaatggttcttcggactcctttttccggagctgagaaaccctaaaacatagcacccgtttacgtctagacatgcacaggtgctgtgaattgaccccatttttgcagttcatagtttattaaggaggaaagaataagccctgtcataattagttgaaaatacattttgaggctgtataaaaagaattataaacatggcacatctgagggcaagtcttttcaagcctctgtggcgatgcactattccctggagcctttagagggcagcagcacactggctgactccagcggatttcagagaggcgaactcccgaccagaaccttcctcctggtcaccatgccaaaggttgatttgccaggctctggcctctcagtctctttcttttcagttctcattctctctctctctctctctctctctctcattctctctctctctctctcattttctctctctctctctctccaaccccttcctcctctctctctgttaaaattatacactctgatgaagtcgcccctcaaccggaaaatgaaagctccaatgaaaaagttagacaagccaacaacaacaaagaaagaaaccagggaaaaaggaaaagggggctggtgacagggaaggacttaagaataagaaaagggcagatgtttcgcaaatatatgcaaagcaaaactgggtgtaccctgaacacttccacagagaaacagaccaatcattgtgcacttcctcccgccacactggtggagctctgcattcaaaaaaagaaaaaaaaaaaaggcaaaaaagcgtggccgcaggcacccgcctttcaacggtcagttctgacattctgactgaacatctctcaattgtccaaggagaacaaaaacattttcatctcctcactgcaaacatttctgttatgagaaaaggctgcttcaagaattgggagtgtgttttaaggagactggcggccgagttagccagcagagccttctggtttttaactctcattgtgctggccccagcaagaagttttaggctgaaacatagcagtgagtaaggctgtggaggatgttggctctttcctaactagaccatattgtatgtggaaagaaatatgcattaaaacatattgatgatatggtaggtattaagcatgttaaatgcatggaaattaaccagatcggcggcatttgatgtatatatttcacactcttttgcacatattgcacacatacagtgatggcaatgctttctgcaacatatggaaaaataaatattttatctgtgtgagctcttagcagtctccagggtgttgagagtgctctcttctttcaccctatcccaattttctctcttcactgggctcccaccctctcttgcacgttaatgtgccttttacttatcagcttggtcttttcctatctggtaagtaatgtgcctgttacttatcagataggaaaaaattagttggaacctcctattggctcatgataatttagaccagtgatgcctcccccaatcttactggagtcgtaacaatttccctactcttttccccaacaatacattaaataggcttagtatctgggcaggagagaaagggtaggtggtaacaaaccaccccaataagggtggtagcggaactgcgctccactacctattagctgtatgtcctgggtagattactccgcatctctgagcctcattttcctcatctgtaaaatgggaataataatacctaccgcttagggttattgtgaggaacaaatgagataagccatgtaaagtgatttgccttgtgctggcacatggtaagagctcaataatggtagttcctctcatagggattgttagttctgtgatattcatcatgttagctttaagaagacatttccgggcaaggggtggtagctcatgcctgtaatcccagtactttgggaagtcgaggcgggcggatcacgaggtcaagtgatcgagacaatcctggccaacatggtgaaatcctgtctctaccaaaaattcaaaaattagctgggcatggtggtgcatgcctgtagtcccagctactcaggaggctgaggcaggagaattgcttgaacccgggagtgcagaggttgcagtgagccgagatggcgccactgcactgcagcctggagcaagaaaaaaacaaaagaaaaagaagacatttcccttcatttcagtaatctgtttagatatctagattttgggtaggggcaaatggattgttattgtagcaaaggcagaaacaatgttaggaccagcaatctcttcctcaacatttgatcttgctgtatacttcctgacatctcctttctgctcacatgtttgtcattgctgtggctacactacaccatgagctccttgaagctgagggttgagcaagctgcacttagcctatagaagcccatcaagcctggacactatggtctattcattgagaccaacctatgggactctggcttatcgtgttttcttgcaatttatcatttctctacctggtctgatgtcctcacatcaatttaagatattttagtgattaaacacattttattttctcaatcttattttttttaaccttggcagggctgatttataatttttttttcagtataatttcctcttaactgtatcagtcaggatcctggcaaaaatagatggcacatgcaaagtttttagctaaagaggatttaatgaaaaaactgtatttggagctgcagatgaggttaagggacctcaagagagatagcaccaggtactagcaatagtagagactgccaggtactagcagtagtggaaagctttaaaccatttaaactgaaggggcaagtaaaatggtgatgaattctgagtccagtcagaattggagttgggaaggagggctgaactaacacatttcctgacctctctcttcccccactttcacatctcctgctgatgtctccttttggccaaattcaaagggaagcccaaggacaagagagcctgggtaatgtagtccagaaggccagtcttctgggtcacacatcagggcaaaagaatggttctggggtttttttgggggtagaatggggtggcaagactaatcaacatatgtgttcttctctcttatactttcaattatactttctggaaggaaagacagaacaaaataaaataggttctgtcttagcttccatgtacctattatgtcgaattgccattcacagagcaagaaaagagaatgctgctcagccgagcagggatttttgtttgttttgcttgctgccatattcctagttcctagaacagtgtctggcacatagtaaatggtcagcaaattttaaatgactgagtaaatatactcacctctgccgtgacagactttatatatatatcatctcattgacttatcacaataatctggttaagtaggcagggccactgagcattattgtgcaggtggtatggggggggtgggtaggtattaaaatttaatatgtgcctccccaacccacttccaagccttgtgactaggcccgaagcattgtcaacccaccagaagagatatacttctgtaaatgattcacattttaattttttatcctctttattgatttttgcacctagcaagtttctgttttattattattatttctcttttatgcattggaaagccaagtttctgaatagcaaagactgcaaagattataacccagtctgtccattctctagggcccatgagaagtaaaagcaggcactggcattctgcacagatgaaatacttcctacgacaggaatacatgctcacttgtggacttctctgtaatctgtaggcaacatcagctcctgatttctaggtctggatctgggttctctgtagcacaggaaggtaagagtgataagaactcttttccctcttaaaggatatagaaacttttaaacccatctgcatcatagtaaggctgtgttatctgtatcagcatagttactctgtgatgaagaaaaactcagaaaactatccagatgtgggaatttctcgggtattccttgcacttgaacttaaggatgaatgaaggtatatacaagtaagttccttgtgtgggtgtggactgaagaaactatgtttgatcttctgtcatgtctttagtccccagtaactcagtcctattagtactatagaacacattcccctccgggaaaggcaggcctgtctatcacctacacagcagcccccatcaactatgattcagttgactggaagcattaaaggtaaaaaagcaacacaaaataaagcaaaactctggcttcatccctttaggtttgatttataccagaatagctaaagacatagaaatatgaatgtaaatatcctacctgaagcctaagagggatgttagtctcccaggtttagcgttttccagtaacatagaagtctgtaaaacaccatcccattacctgcctcataacatataggaaaacttgtgaatataacaactagttattgttttaaaatgtgtaattaagttactttgcatgcagaacttctaaataattcaaatgactggcttttctattggaaaatagcatatattcatctgttatttcagcaatgattaatgaatacttgatatcaaactttcatcagtattttcccataggtatcatatcccctaccccaaattatttctgtacttttccttgcaaggtctctacttctcctacataaatgccttgcatggcgggaactaaatcaactacacagacccatacatccagagagcagaggtgagctggatacaagtggcttagagatgtggtggaaggaggccagagctccaagggaagggcagcaaggagacaacagcatgggttgcagctcagacaacaggtaaataaaaccaagcaaagctgctggtcacagatttgaccagggtggcaagaaatgacaagctaccatgagattcaacagtggcacggaaggatgatgagaagcaaacagattaggagaagctgccaccaccgtacatagaggcacagatgaccaagcagaacagcaccagtccctgcaaggtgtgctcagatacagctcagcacagccatctggccaggagggaatgataatgcacatggtgtgcactgcagccgggaagttgagaaccgctgtgggcacctcaggactgagtctggttaccctgctgatccaagaaatgaagccatctaaaattttgcctgctttcacaattttctgtgtgtgtgtgtgtgtattaaacaaagtgaactaagaagccttttattggagacataatgtactcacagtagtttcaaaatcaatggtgtcactcttcaggtaaattactccaaggcttgggcctagtgcagatgttcattggggcagggagcagagagcggctgcatctagatcagacaaaaaacaaaaataaggttgttaaatgaacaggtgatggtgatggcaattatttattttgataggaaagaactttgggacttgagtgagaggttggttgtttggttctacatctttgcaccagagaatggcgaggtacggaagggagaatggagaggatgttgtccaggctccattttcagtgctttcacctaactgcctgtgcagcctgggacatcaacagtaccctgtcagtgcgggcggagctgattttgtggttctgacttagaagctgagttgtgggtgacagtgggggaaggaagtagaaacagtgtccttcaaccttcccacagttgattcttctagtatccttttcttttttttttcatttattatatttatttattttttattcacacataaaaattgtatatatttatggtataaaacatgttttgatacatgtatacattgtggaatggctaaatcaaactaattaaaatatgcattaccggctgggtgtgctggctcacacctgtaatcccagcactttgggaggccgaggtgtgaggatcacgaggtcaggagatcgagaccatcccagccaacacagtgaaaccccgtctctactaaaatgcaaaaaaattagccaggcgtgatggcgcacgcctgtagtcccagctactcaggaggctgaggcaggggaatcgcttgaacccgggaggcggaggttgcagtgagccgagattgcaccactgcactccagcctggcaacagagcaagagtccatctcaaaaaaaaaaaaaaaaaaaaaagaattacctcatgtatttatcactttttcatggtgagaacacgtaaaacctactctcagtaattttcaatatatactacattcttattaacgatagtcatgaggatgtacagtacatctctggagttattcctcctgtctaaccgaaattttgtgtcctttgactgatgtctcctcagcgtctggcagccaccattctaatttttgcttctataaattaagcttttatagattccccatataagtgaggtcacgtggtatttgtttttctgtgcctggcttttctagtacaaaaaaaagcctattttttccccatatatcatggatgacctctagattcatccatgttcttgcaaatgacaagatttccttctttttgaaggctgaatagtgttccattgtgtacttttaccacatttctgatattcttgatttcatttcagtctctctctttattgcttagttcttaatgtattctagtgacacccattgatctgggcatgttctgagcattccctctgtccttcactgcaaaggctccattttcttccataggctctaaccctgaggacaccgaattaccctattttttcccctatacctcagtctgctattctgccttcttcactggcttattttctttcttctgttctctaaatgtagacattcctctagatcctctcctcaggctttgtctaccccagtcctccctgacctcaacaatcacttctccatggagagcatccacattgctatctttagttctagcttttctacagagctgcacacccacattctaaataacagctggttattggttcattcgttcctttgtccattcattcagtgtttatatagcatctatgaggcacctggatgaatacaacagggtctctaactttgagaagttcacatcgccatcaaatactacacaggcttttctaattcagaaagtttagaacttaattcattgtctttcctttaaaatctgttccttctctagacgtcccatttcctgccattggtattctcttcatccagttacgtgggcctacagctggggagtcatcttcaattcttccgttttttttttcttcctatatccaattagctacccaatcctgtagattctactctgattgtgattcctgaatcaatacctgttttctataccagcccctatttctccctttgctacctactgtgaggacatctatgaaaagctcctgactggtttcacttttccagtttttctttacctcttgtccatccttcacacaaacattacattaatttttctaaagtgcccttctaaacatatcacttctttgcttacagtcctccttgcttattggattaaattcaaacttctcagtttggtattcaaagctgctacaatgtagcccaatctagtttctcactcttatctctacactccattctacgctccagcaaagtcctactctttcctaccatgttcatggtatttcttcctttctttcaatgtctacatgtagcttcttcaagggccatccaaatgccacctcatttatgaagcatttcacaaaggagagtgcccttcttaaatattattagcacattctgtactactccctttgcatattctaccaattagaatggttatttgtgtaatttgtcttccttcttcataagccctttgaaagctgagacaatttttactctgagtaccctatagtgggccatgacttcttgcacgttaagtttgcactaggctgataatctgctgaactgaatttaaaaagaataaaccctcttgccttgagtcatagaaacggggactaaattgaaaagacctaaaagctcatctgcttcaaccccctcatttttcagacgaagagatgaagggaactgacttgctcaaggtcgcatccttgttagtggctgggcaaggataacagacataaaaggccacagactaatatttatcagtgcttacttggcaccaataggcccaacagatcatcagtaatgacaagaccagagagagggaggttggggtgtgtaacctgcaaaaatatattgtgttccaaaatataacaaatttgcttcatttatttgcttcaacaaaccgaactaataaatatgttttatagttaaatgttgtctaaaaaatgagggtggatttaaaaaacaaggaagcaaagttttctaacattaccagcagaaataattatgacaatactgtcaacaccactggggaggaggtgcggatggttaatgggtacaaaaaatagaaagaatgaatacgacctactatttgatagcacaacagagtgactatagtcaataataacttaatcgtacattttaaaataactaaaagagggtaattggattgtttgtaacacaaaagataaatgcttaagaggatatatgccccgttctccatgatgggattatttcacacggcatgcctatatcaaaacatctcatgtaccccagaaatatatacacctactatgtacccacaaaaattaaaaacaaataaaatgttaaaaataccactggggtgataaactcaggctgaaaataagaataaagaaatttctcatgctttggaaaagctgtgtgttcagctggagttcttggtgaaaacatgcagtaattccgtggttaaattcattactttgtagaaacaaactattggcaatctgctattatgccacattaacacttctttttccacctagcttagcctagtactcattctctaggtttgtttaaatgtttacttgtttttctttccttatattactaatttacttgtagaaatgcatagacaattgcctctgagtctgttcaaattttcttgccttgttcttctcttgtagtagaggaaacattagttgtttctcttctctatccttatcctcaaacagaatcattttctctcacccaaagatgaaaagcccaacaaaacatgctgtggggataatagtgtttacctaggtgaggaaaacagacttttccagggaatctcagtaattattacttggccagaaaagctcagctcttaaatgttagctccaatactacaagacctcatctgcatctcccaggtgagcgcttgactcactgttactcaccagaggaaaaccttggtaggtagcattaatcaaactctttttggccagtatggtggagccatgctacgcattgagacatccattaaatagcatcaccccagcagccacacaaacagcaaaatgggctcaagagctcttcattgttctttctaacccatcataaggctggacagattattgacacttcaccagatagaacttacttctccttttgccccctggcaactacattaaaatcataaaggaaatcactcatcaatagtacattgcagtgaaaaattatctggcaaatttacaaatcctttgtgtaattatataaatgtacattttaaatatatctaaaatctgatttacattgtgcattttataattaatacaaccatagtatgtctgtcctttaattaaatccttctttctcagtcccacatcctgctgctataatcttactttcatttttggcaaagtgtcacctagctccatcttctttccccttttgccttagtacacacctgagcgtctattaatcagaaccactgcatggtgtgtcatgttttattgcttaaagggtggttacactctaaaaaagattcggtgagaatgacttcatggggtttcacatttattctcttttaatgactttcatatccagtgtactcggtttttaagtcaaaagataattttgaggggctgctgatgccacaaattctccctagaacctgaaaatccagctgttgtctctgcttcttacatcatcactgtaataaagaatctgctcttggaacccagctggcaagtttcttgatggtgtcagaggcgaacagacagtaggtcacttctctacagcccgtttcattgttggcgtttctgcagatctgtcttggaagcccttagagagcagagctgttatgaaatacactgccacatatcaatgtaaggaactttctgcagatgtctactttgagtatggcctgtcccagtcctaggaaatcacaccacatcgttctaaaattatagatggggggttcatgattaaagtttacaagaaaggtaatagtaacaataacagctagcatttattggatgtctaaattttatcagggactgcaccaggcatttttataaatgagtatgttcttgtttaaccctcatagcaatgctatggtgtatgttttagtatacccattttacagataaggaaaagtgagacttaatgggcttacgtaacaggtcgaagtttagaaagctactggatagtgaggccagaatccaaacccagatctctctgagtctaaatctgtactcttttcactatataacaactgttccaatgcagcatggacacgggacacatttctagttcccgctgtgatcacagtacaaggaagatgcttatttccacgatggttcagagccactggaaagatctgggagcacagactccaggagaaggaactatttcagaaactgccaataagtatagtcccttccctcctcctttctaattgcagatgagaatgtcctctaacagtcttctcaaactctaatgaacaaacgaatcacccagggcttctgattcagcatgtctggggtggagcttgtgatcctgcatttctgagaagctcccaggtgatgctgatgctactggtctgggaccacaggtcttatttctgacactctcctttctactagggttgtttttgaaggagcagttcaagccaaataacttggctaacagttcacacagccagccgactggcttctgattctaggccagtttgtcaggtcatcaggcattacacagaattcaaggagttcttagcatagagcacactgtcaaaaaattgtttttagatccccaagggttttcccctctctctggaaattcaaaatgataatgtctctaacatgtaaagttcctatttttttacattattgttatttttaacaataattatctggtaataattcaaataacaccttccctctgagaaattcaatgagctttactaaccttaattgtctaacagcaattcccaggtgaagataaagctgtctcaaagatcatagtaaatttaaaattgttccacttccctcgtttctttgccccaaatgtagtggtgagttagtggggacgggttactaattggcaaaggcccactatcataatttgaggcacagcaaatttcataaaaaggatacatctaagaaatatttagcagagaggtcattgtggggaatacaatgttagaaaaaaaagagttagaaagtgtaagataagaaaagagaaagcaaaatcaggactagctgatgacctccgatgagacatttaacctctaggtggctcagcttttctatctgcaaaaagaggaggttggttttatgatttttaaggtcccttaaaactctaatagtcccctgagaaggaagatgtgggaattaagtagctcatcaacctgttaaaccattaaacatgttaaggaagtctatttgacttttaactttttagctaattacccgaaacaaattcccaagtctacgtcaccagccccacctctctggaaagtggtgagaaaaccatttaatgaataaggcaccaaagacatcacggccagataaactaatcaggaacaccatcgtcagcttactgatgctgtgataactattttactttttaggttttagttccttaattaaccactagttaatacccatgtccataagaaacacctctgatggcttgaagacccctgggatggccctgccaacacaaggtggaatcacaatcccactgtttgtcacattaaatctatgttaattttctccatagagacctcttgattcctctttgacagttcataaactctgttaatataagttgcacatcccatgccatgagcgttagcattatcagatacagttgattcttgtttaaaataagagatcttttggatcagagtacatgtaaacacacacacccacacacccacacacacaatcatgaatttctggtattaatgaatctggcctggtgatgggaacccctctattatgtcaccggatactggaaccttcttatccagaaagcctgccacaggtcatgttaataagatcgttttaaactttgtaatgagaattctaacatgagcatgatttatgacacagcattttatttggtattatcagagtttcctataccttacctcttacagtgagtatgtgttctgaattaaccattatagtttgtggtaaatggaaaaaaaggtacagagaaacatcacagtggcattactccagataacacactctgtcactgttcccaaagtgaacatcatttccctcttcctgctcccatcacttcaatagtaactttggctattactgactaaatgcttaccgtgtggcaggcattgagccttttcacagataactttattttcttacaattactctttgaagttgggaattatattcccattttatagacgaaggaggtgaaactgatactcaggaaaggtacagttattggtcatcagtcatgaaggcagagggtagcaaagcagagttaagggccaggttctaaccacatgttctagagcttaacctataccaggctcacaatcaccaaaccactgatctgccttcattccactcctcttcatttgtgatccccaccattggcttaggctagattcttcttcatggctctctcatgtcttcttgaatatttcttgaaatttctcaaaaccttctacacttgatttatgttttccctccctgtattaataatttaatccaaaaactcattaacacttcttttcaacagactttatcaccccttttcttagctctcatactccttctaaattactcttttgaggcctcacatttgacatcagatgttccacacccagctattgaactcactttcccagaagcccaaggaacctattgttttcagctggttcattagtaggccccagttggccttaccagatgtatttgtccagtttgatcttgccccatgatcaaccatttcaacactgtcctcagtaaccatgcagatttccttccttttctaactttctatgtgcagtgcctccttttacattcatcaactgtgaatctgtatcaccattctccatttgctcccactctcagaacaaaaggctacacatgcatgctacctggacctatgctcctgcccactgtttccaggtacaacctatggcagtttttcttagtttgttctcctttatgaagtcccattctctttttcagttgatgagctagcatcctagtttaataaaaggatctacaccatgcagtgtggtaagcttattagctctcatctcctctaatatctctgaattttcattattttatttcctcaggatatatcttttcccatgttcccttcgtatcttgaaggttattctctctacttctctttatcttcctttggtttcatcagggatactttctctgtagctgatagcatatcaatttctaatagtactagattaatcatcaccacataccttttttttttttgtcccgcattcaactcctgcccttcaaaaatcttttcagatggtgtatcttaaagtgtgtttcatactggaacttcaagatgcatctcaaaaaaagttcctcagtcaagtaagtttaggaaacactgaaaactatatattctattttcaaactcgcaagtgtacacaggatattaaggtgctggaagcctaatctttgtccaggcttaccggattacagactcccccatccccctttttaatggaacacttatttaacctcagaatatgcttcgggaaaagatgctttaagggattcccctggttccaaactcttaagcctgggctcggaaattcactgactccctatcaaatgagtcctctcagatttcctttccattaatactccacatggtctaaactggttaacttatagggtgtcagaaagactaagcacatttctatctctgagctactgtatataccagtttggctgcttggaatacctttatcacctttcaaaaaattatataggacttttttctccttcagggtccatatataaaaatgtatcctttatgaaattttcccttgtgaagactgctttagcccataatgttttctgccactttttaagtacttcaataaatggttatggtttactgcctgtttgctatattattagcgagggtgtacatcctcttgggtaggaaccttgttttatacactacagagaccccagctttttgagcacagtaggatgttataaccatgtcatcggttaatataaacagaaatggatggcattaagacatgatggtttaaaacccaatttctgtagctattggaatagtttaagatgctaacagcccaggtgaaatgttccatcacaatattgggaagaaacactacccgccatcactgccattgccctgaaaatgataccatgtgtgtctaaggatgtggataaaggctagatacagaagagcaaaggcagctccgttcttaggtgaaagtaagaatttgcattagttaacaccaaatggcgataagattaaaataatctaggaacatcaagtgatccatgaaaggaatcactggaatataccaatggtaaaattaccattcataatcattaaatcatggtaacttgatgaaaagaaaaaggatattttcctacttaaggaagtcagggtaagtattgtctgaggttccactgtgtgctattgtgcctggtatacagaatgtgtagcaactatttacagaatctgctactgccttctagtcacattccaaattctatctctttgaatcagtctggagacacaatacattggtgaattcaaggcagcttggcaacgactggcacaacataaaaccccaaataatgaattccatctttcccataaagctcttttattgacacaacatacaacagcgcagggcaggttgtctcgggctagtgtgtaataactagatgttaaggggccctgagtttttcagattagatgttatctgaagttgggactcagcaggttccctaacagtgaatttttagtgggcctacgactagaagtttggtctcttgatgcttagtcagggagttttattatgtgagagagaaaagtatagctttctttcttaaaactgcagcaatttcatattttagcagaagagaaagtgcattttattagagtataacctgtggagtattttgctaccttcctggatataaagcggtatacaaacaaaaaatttaataaaaagctattttataaataagaatgtttacttgtgtttaccttaaaataggtatagcttgtattatttaacatgtgaaatagaaggataatggtaaaatttcataaatataaaattctgtgtccgtcttcagttaaaattcgtaacagtgtatcagagtgttggttattagtagtaatcaataataagtattttttaaattggaatttttattgcaggagattattgggtgggtgaagctaaatggcctagatgttttcctgtcatgtcaatacttaagaattgtctttctgggcaatttacacatgtgagagtgaaaatgaagggtggcctgcctattgggtgtgtaacaggccaccggggcaagactgctattttctgagagccatgggcagtttctgcaataaagtatctgagtttcttctttttgtagtaaaaataaatagtttacttttatgttctgggtgaagcctgagatctctggatctctttgctggatttcactcttggtgggggcagggagatactattggcaatgctttatatatattgacctagacatgttaaagattatgtggtactttcatgaacactctaaaaatgagttctccctatcatgagttgcatagatgaggagattgaggtggatggggtgaagaggaaggaaagggcagtttaagcgggctagctaatgagtagtagaacttaatctaaaaccaagattttcagcagaaaatgctttttttccccaaaaaatgccatggttgtcaacaagctttgtagcaaatctggggcagagcactagatggagaatcagaagatctgccttgtcttcctggatctggtaagaaccagccgtgtgaccatggccaagtcactaacttttgtgagtcttattgttctcacttataaagtcatgagcaaggaatcaatgaatggcataatacttgtaagctgtaaaatctctctcttgtaaaatggtattgacaataatgtatgctttgcctatcttataaagttgtgaggctaaaataagctgatccatgtggaagtgctttgtatagtgtggagtactgaatcaatgttgtctggaagatttaggaaagggtcccgaatgtgtgtgggaactgacagccagtccacttccattcaggttttaggagaagctataataaagcactggcagcagctcaaatcccactccatcctctcctctcccagcacgctgcagagaatcacttgaggaaagttacttgagtgggtgagccaaatgctcaagttccaacctttctgagtagaagccacagtgaatcctgagccacaacacaggtgacaatcactgttcctccaggtgtgtctgaaacactgggggaccctagggaaggaggtcagacgtcactgctcctgaggacccgttttctcctgtacacagctccagcccacatgatttcacctggcagccccaagagacaaaaaggatccagaattagcaggagcctcctctcctgataacctaagtgctctgattgaaaggcagagggtatcaggagaatggctgtaccgagtcggcattgatttctccagcctttgtctgtgtctggtttctgtctcgtttggaggtggttactgttactacaagcagcatgaatcatgtctctgttaaaaaacagagcttcaattgtcttacataacccctggtaactgaacgtctaataatagcaagccatttccaggtagggaatctgtctacctcccagacacacacacacacacacacacacacacacacacactactcccaatgcttcacagcacagtgagacagacagggaggagacagaaggagaaaggggacagcacaattgaatttttttgtgttttaaaatatattgaataatcatgcatcatgggatctgataaccaatatacttagctgagctagtttaataaactgtagaaaacaagaattcttctttaaagtatttgaaagtatcccaatccataccagacagacaccttctctaacactcttatactgcataaaaaccccaaacccccaaaacagagtggggtgaaaatttcactggattgtctgctagcttgtaccaactagcttcaactttcaaaggattttttttgtcctcttttttgtttgaccagagagtgatattccaaaggttcttggccgagatcatttcataaaattccagagagtgaaaggcaactgaaaacatggctgcagtgttccaccatgcagactatgtaatgtcaggcacttttgcccgagccactttctttgacggagatgactttccatctgaggacttacatttttcccatgagtacactctctggcttgtaatacatgatgaggtctttttatacttgatccccactcagctacccattaaggtggctactgaaataaaaaaaaataataggagaggctgaaaaatgatttttgaaaaatcacaaaggtaggattttctttaaactaccaatttgtttgagaacaaatacaaatgctggataggaagtttaaaagtttatggggaataataatataaatgtataacatatatacgtccatttcctcactgcttcaccttgcccatgctaggaaaaatcacttaaaggctgtattttttgagtgtgcattctcagagtgaagtagctgtacatatcatgtaaattggactggggaaggacttcgcagaaaattacagatggcaatcacatcctgccagtcatttggtctagaaccagagaagaaaaactttcttttctcttttgattgttcagtaacatgaaacagtggactagactagttcaaaccaaagaatgttttagggcacacccactttgaggaccagcacctggctatgctacatgctcttcaattgtttaggcatataaaaaggagtgatgagatggttatatgtcaaaatggctgttctccctccaaacaggatttgattggcttatttgcttttggagtactctccaaatccataaacaaaggagtattgaattgaagaagcaaacaggagaaagaaaaaggctaaaaaggaaaagagagaagaagaggaaggaaaaatactaatttctcagtattcctatctgcaaatctggctggatttgataacaaaactcctactactgttctctaatggtctttgctgcatgccatatggacatggcttctaaaggggatgaattctaggttttcctcacaaatatccaagcacagaacagcagggatcttgacgactaaatcatcctaactcacgacgaggatcacagaggtggaacatggctgttgggactagattcttctgcttatttcatgtgctttgtgaattaaattgttcgtagagttggaaagctggtggactaaatgttttaataaaaacagccatgagacacaacagttttcttcacaaaggctttcccccctagctactgtgaatatattgctgaatggttctgacttctggaagggcaggaggtttgcctcttctctttgcctcaaaaaccaggcttattctatgcatctgggagatgattatacttacccgaaatttcaggatactatgtcagacagttccttcacagtggtgtgtctggcacctaagcaaggacttggtgggccagacacatttaaaatgtaaaagtggatgattatattattttgcattgtaacaatgagagtatttctggattgtagctgacgtgtagatcatcataaccatatgtggcacaacaaaccacacaacattgcatcagaagcttgtagttaatatttttaaatgattgattattttgaaatagagaaatggtggatgcttttttcgacctctttaaataaccacttattgaatgtctattgtcagtgatggactctttcttcacagaagggagctgggctatgccagactctcaccatgttctttctcctctaacactgaacaaaatatcagtaaaacaccaagtacagctggttttgaacctagtaagaaatcagtctgtagtaatgggccatattggtaataattggaactggtgatatcgatagcagtgggaataactgacttacaaaggcacagcagttcaggaacgtctcagggactcagagtgggtaaatgcgtaaatctgctctcacctatttatatgctccaacaaatatctggaactctagaaacttcaagagtctaatatgatcaggccacgtttataggtattataggattcatataaaataaggaggcatacatgttgatctagtgagcgtctccatatttgtacaacactcaggatatgtctgagaacacattttaatttttagaatcagctatagaatctggcagttattataaagcaaacttcacttcaaaaaaattaactgagaagccagatgataatccagatatacaaaacaacattggtgggataagtcaaataattctctaaaatgattatggagaaactgaagaaatgaagggcacctatttatcatatgtgggtccccagccacgtttgtaatctgttgtgtgaccttgggcaagtcatgaaacttctctcgagtctcatttttctcatatataatgtgggagtgttagattagatggtttttaagattctttccagtaataacatttgatgattctaaagtaagaagagatgaaagagtaattcctctttcctcttgttttggtaaatacttgctttctcctgctccgtgcctatgcagtttgcagtgagtattaggtttctggactcaagaagtcaaatagtaaatactgaagctatttttccttgtacacatggacaaatcataggggaataatccttcctttctttgtatatcagtgtctcttctcaaatcagacttatgcctaaggtaatcacgatcattctggtactaataaagatttttcctcatccttcccacaaggccctcacccatgctcatgaaagcttatgtgattgggttatttctatatttatgtcttggctattttttctctttcaacttgtttatgaagtccctggtaagcataaagctgcaaaaacaaaaacaaacaaataaaacaaaacagctctgtttgaataatttacttcagttgaagcagtataagaaaacatcctaacgccgaggggaagaaaacaggtcataaaaataccctggtatcttagaaaagactaaataaaagcttatatcaataatagtttcatatgttattgtctttcattttcaaagagaatggtacatattggctttatagtctggtgtacagacgtggctatttttccccatagctctcaggtcagtgcatcctcaaagccaagaaggcccagagcctgccgagctagctttacataaacaaaggagctacacagaaaacccaatacccggagcttatatcatatcctgactaggcactctggttacccatgactcgctcttttccatctgtgccctgattctctgctggtttaattcccttcacctagaatgccctcagtttgcctccttttactgctcagaattccctctggacacaactcacgactagcataagccccatttccaagaagcagcttagtttgacccaacttagtttgacccagcgaaaattttcatggatagcaagtgaaaattagtccttgtgataactggagtcactgaaaccaggtatctaggaagcactcagagaataccagagaaaaactttcaagggttgcagtgtcctcataggaggaaaaaaaaaatcctagctttaagaacaagcccaatatagaagctgtggtatgtaagagaaaagttgtagccatgtacgggaggaattgtgttaaaacagtctgactttttttttccaataaaggagaagagatcctctgtttcttaaaagaagtttagtcattggatatagcaacatacagtgtcataaagtttaattgcattaattatgaagctaaaatgtctacattttagtagagagaacatggggcatagctaaatggcgaagacataggaatgtgtatacaatttgagtttcacttcctccaaatctctcagttagaggatccctctcagtctgacggtcttatcatcaacagcttcacaaactctgacaacacctggctgggtttaagggatgggccatgatatatcttgagagtaaaagatggaatgaaactcagaaatgctgaatgcttttatatatgtatacaattttatttatgtgtatatttatatatcaatatatacaaacatatatatttgtatgatgtttggcaacctcactcatggtattcctgtgaagtaggcatgtggtaaacataattagcccattaaacagatggtagggctctggcatatctcaccatattctaaaatggtggagctgtaagcagggactaaagagagtgtagtttgatacatggctaactgcaaatctctgtgaattgctactttcctaaagacaatctgggtaggctgcatttggctgagaactggggatagtttaggaagctttaaaaatatacaaagggacaacttttcacattcattcagatatagtatcttcatttttacttactagaggcatttttttttaaaaaacagctttttatcttaactcatctgtgttccaagcaaacttccaaattgctgagcagattaaaaaaaaaaaccctacatgccaagtagaaacactgggtaaatgttattttttaaaattgtcttaacaaagtgcacttttggaaaggataaagttgaaaagacgtttggtactgtaaacacttagctgtcattgtagcacagtgaccaaatacgtccaaaagcacatgtaatgaacttttatccgactgaattatatgaccatggcattgccactctatagtacagcaggcttcagagatcctgttattaaatattctagcctaattctttatcatttgaaataggatctagcagaagtgaaagagttactaaaattaagacttgaatttacaagtgtgtttgaactggcttcaggaagacatgaaacatcaatacatctggagaatagaacttgcaattgactgttctttaccatctggtctcaagaacattttctgcttggaagttgcataagcaatgaaaaaacacacaaacaacttcctgtaccatgtttttggtcacttataatgacgcattacaaagtaaaccagctaaatatgagcaactgcgccttactcgagatgacaacatacattatataactaagatcaatgaaaaagaacatctttattttaagagacctggacttaaaatattcaagaataaacatccttccttctaaggtgtttgtactccttctaaggtgtttgtactgagtagttttggctagacaggtttgtagagtcactactacaaaacaatccctatattttttcaaactgaaaaaggatataaaaaagcaagctatattgaggaataaaatgttccatatattttaaaatgttttttaatgacataaacttgcctttttaagcagtaaaatatattctacacatgtttttcatagaaaacttttacatatctttgttttcttaaacacagtatgttgatgtaatttaatttttttctatgatacagggtcatccttgtgactattcattgttcctgttttacaggaatacacttttcttacttgtggtgagaactggcctcatcccttggctcagcctaacggccacagactgagctatagcccactagccactgccatagccaactggcgtcactgtcccagtttttcagacccatcgcctctaaatcctctctgctaaatgtattttctaatgtgctttggattagaaaatcaaataaataagaactgtagagacaatactgcttgaatgcagggtttggtagaagatttgggggaaactcatttggacacttgaaggtcttcagttacttctttgctcagggttgtaactcagagatctgaactaccagaaagtggattttgaggtattattgtgtaacacagagtgaaacatttatgcacttttattgcaaggcttcttattttaaacagggttgtccagaaatccattcttgattactttacttgataggtctctgatccattatatttcactcccttgatttcctccagcaatgtaactaacataatgacaattgggaagtaaagaaatagcacatttttaggataaggtgagagagtcttggtaactgacttcatcatagtgatggaggcaaaaatatacagtcaagttagaaaacttccctggactgctaatgggaactctggcctgactagacactgggaaaacattaaaaactgtgaagttatttacattaattttcagtgttcagagaagtaacatctgatcatcttttttcctcttctccaaaaggagaagtcagaataattcgcaatctgtgataggatagggattgtatcgaaatttgcctttttattacctctgaaaataggatttctaagcaaactaataaccttaaaactgttgggaggaaggatgggggaaaccaaatgtaacctatatgaggggggggaaacatctttaactactttaacatacacacatctgataagttactgaaaattcttatttattttgaagttagtgctgaagaaactctatctgttaaaacttagaaatctcagttcaaagtacatggaaatattccatgatcacgttttcagctcattctagtcgtctgtctcccagtttatttgaactgatgaaattttacaaaataaacttctttagctttctagagttacgtttttacccatgtaatctatttgttaatttttgtagcatgcttatatgataaaaaatactatgtaagtactgagtttgcttgttatggattatttctggatacagagaatttgcaagaaacttcagtttacagcagccaaggttactgcagactaaagcagaagttcaggcataaacttgtcttctaccagttttccacaactttgctgttgacagcatctgaggacatggttgatgagttctgaaaatcattcacaacattgctaatgtttaggaatcttatagctttgccggacctttccataatcacgagagaaaacctttgacgaaattagaacaagtcctcataccctcccttcctttcttctagtgatttttttttttgtattggaacaatcgaaagattcaatgtttttaaattccatagaagactaacgattgaataattttctcacatctctgtttgcactttcgcagtctggttgcattgatttgtgtctcacaagtagacatttcctttgttggtcacaaatcaatgctacagaacaaacctgccagcacattccacccccacccccaattttttgcagtttaaaaacaaagcacatttatatactttttcttttaaaaattactttcattggttagtaatacactaaaagaagacaaagcctcagagttaaaaatccccgggagaaggagctcctctctagctggtctctgattctctcacactgcctggagcaaagaactgcctagtgggagagcagcgctcgtccgccgtccgctcctggtgtgctctgttaacccaattaaggtcctcgccttcatacatcacaaagctgcccaaagcaacacactgtgatgtcacagtcagatatgatttcatggcaggaaaaaaccaaaaaggcagaaaaggttgaacgtactctgcttttattcaaatcttctaagagggggaaaaagggaagacttttttttttttttttttttttttttttctgagagaaaaagagcacaagctttctgacgtgaatgtgaaaactccgttctgaagataccctggtgcttttaccccaagtggataagcatgaataaagaagcacaaagaaacactgtcatcaatcagaatgctcttgcctacacttagctacaggtggaaagcaagcaggcacgatttgatttacctagattaaaagagcaattttctatcttccttttttccttttaaaaatagccaatcgattttggcctagctattgctgactgtacaggtccattttaatacaccactgattaaacggtatgttcatggctgaaggcactacagcaggaacaaacagaagcagctgaaggaagggggtgggggacaggcgagagctccaaaaaacactccacgaaggccacaactactcggcacttcccccgtagacagttgatatagcacattttaggcttgaaccagctataattctgggagtttgaagcctggaattcatttagctttttaattctgaccttaagaataaaaaaaaatcaaagctatgttttttaaaaaacacaaatgagggaaatattgtgtcctaaactgcaatgacatctgaaatgaagatgtgcctcagaaagatgcttcttatgaaacacttgaaatttcataagttatagaattatctactgaaagaggacctagttgtttagagactttgtttagtgaaattgcatgtaaaagaaacagaaagaaaataggacttttatatagggtgactatatgttgggattcatcaggcagctctcagaagagggagaatatctctactagttctagaaaataaccatcttgattatcatgagaaagtatagcctttatcgaagtctgggtggcaggaaaaataaattagggagggaccttctcaggcaactcagagagagacccaacatccagcagatgtttcttctgagaaagacaaggtccatctaacaggtgagacatcagctgaacaatggatgccaggacatgggaagtggctctgagaatcagcgaactccatgtttaaaaagtcaacccactttttttttttctgtttgcttactgattccttgttcccttctctcctgttttctctctccaattatcatttacttaatttgaaattctggccttaatggggacagaaccgtatccagaggtactattaagataagaaaattcaggaagaaagatttaatgaggggcttaggagtttttggaagaggaaaaggacattagagagaaacgagggaaaaactaagaaattaaatatcagcctcagcacggtggctgtagaagaatagcttctgagagacacagatggtctgcattctccagaacaaaaacaaacaggaagtaacagggccagagccccctctccccttcattcctctctccagtgtaaattggaaaaaaactgaaatgtgttcacatcaaaaagttttccttcaaactctagcaagtgaccacagtaaaagaaacaagagagcgctggttccagcaggtaaaatgctgaaaggatgtcacatcgtgggggtgaggaagaaatcagggattaaatacatacagtttggagaaaaatcaggctctatagctaactaatgatgaatggagcagacaggtggcagatttgaggtccggaggagaggaagggctccattttgagccgcccattttctggaggagaggtggtggccgctgtggaaaatggctactcctggggtgcatagggagacaactgacttagtggagggaagggaagaaataaactagggagtcatccagggacacatcgagttagtgagggttttagtttggatgataacaagctcttaaaacatggctttgactcataaaaaatgtagctgggatggatggctacttacagggttaaaagcaaactgagagctcttctattcccaaatctgaatgctgaagtgctgcctagaacagcaaacatgtacatgcaaaatatcaaaaatacacaaagtgggggtgcagaggaggtgcaggatgcaccagtcacctccttccccacacccttcaacagcacagagctctggcagggtcatcaccagtaaaactggattcttacaagccattccacagagagaaaccatcccaggtcccccatggctccaggcatcagtgaggacagttttcatgttccaaaactaattggacagtaaggagtgtctgtaagaataaaagcgggtgggaatggaggatggaaataaaagggaaaaaaagtgtccttgttgaaagttttaaattacaggctcagtaaaaaactggcattccaccacatccggtctagttaccaaatggaaaaatagggtcattaacatgtttatttgaattacattagtccttctctttcatatttaatttattctgttagaaaaaaacacaacgctctgcatgctggtgaaaggcaggggtgtaatggatcagggagctgaaatacaatgatctttacccattatctaccctgctaaggcttttcagaacttactaggatcattcagggattcttccctcacaagggagggaagggtacagaaagatgtaaggtacagatgctactgagtttgttaaaataatattgaagcacatttaaattaaggagtggaaggacgattttaatatggaaagtttacaaaaagaagaaaagtttgggataaatgacctcttctgagactgaatgtccagatgcaaggttggtgctaggcttacggaacatctccacatgatatggaagttgtagaacattgtgttattagtattcggggtattaaaaggcgaagtctgcaggatgatctcatgaggcttgctgtcatccacaagaggtcagggcaacttcagtacaagcaagtataatgcagtacattcaggggaaaatgaaacaaggtatattttcaggaagatgtccagaaatgacctggctatctttgtggcggtgacatggaaaggacatagacttagtatcataaggccagtccctgctctacaacttactaacaccatttgcacaagtaattcaatcagttttcctcatccataaaatgggaacatgaacagttaccatagagttgtgaggatcaactgagacaatctatgtgaaagtgttctataaagcactgtacaaatgtaagacatttattttctgaagacagtggtgccaagtgtgagccaagcagtgtgccaaatatcctcagaaataggattggaaacaaagcagggaatgctctgacaaagctgaagaggacaaggatctcccatctcagtgtgactgggtgtatcgctcactcaaacctgaagggatttctcaccgggatgctgaccttgggttcatagactaactccacagtaggttgccacccactcataatgagtcatttaaagttcaaatcttacttcatgctagcgatgctagcacagaggcaagcagttttaggctttttttggtcacagatttctgctgccattgtcaaaacagtagccccaacctctaactgcaacctagggcagccagcccaacctagacttgattctggtcacttttagtggaacaaattggctcagaaaacatcgccttctacttcttctttaggatatccaaaatgagcaaaaacttcagtctctagcttttccttaagacaagtttctccctttgctacaaacggaatcacatctttttgttatgattcttcctctatggtccagtttgttgaacattttgccagctgtttctaagctgaactttggcttaaatacaattgcagtcacactaagatcattctgttttgagcccagagcatagagtgtaattttgatagaggaaggggagagttaaattacgatcagctctagtaaaaggtaacggcaactcatgggtgggatactttctggatgaagtacttcaaaaaataaataaataaaaagaataggagaacgttcagtattaattaaaataatcatgacataagatgaagatttctatttataatgataaaatccaggcaaggatatggtaaatgtctataaagaaacaaaaggtctgggaaactgactatggatttctttttcaaattctagtatacgtgaactggaagtcatcttactacttttcaaaagaaacaatttatgacaaactaaagaactactttacacagtaggcaatcaacttataaaattcattaaaggtcgatgacataaatagtatcacaaaggtttagctaaattcatggataagtccatagtgggttattcagagaaactaggctatctggaggaaaataactctaattctttaagttagcaacaaggacaattgtgtcttatataacagtttcctgtccctgtgatcagaaaatgaatgctgaactgaaaggaccataagcctgaaccagaggggcttttcttataatcacatgcttgtaagaaagtagggactaactatagtgctgatattaagcctgctggggccagaaggtgcacaaattcttgaacctgcagtcacatatgtcacattacctaagctgtattatgccactccttctctgcagcaactattatcatctccatattacagatgagagaagtaaggatcagggaagttcagagacgaaaagtaaattaacaaaggtcacacagctggtaaatggcagatttgggatttgaatttaggattatctacttctgaagctctgctaccacactgctgctgttttctgcccagtagcctgatgtattaacagcttaagatgactaatttaacctgttaaagcgatatgaagtcttgctcttcatttgccttgatatctaaactgtgtgtgcagtagcttcttgtcatcaaatcatgtgctcatctatggctttacattaaagatgtctccagctctcattaagagggaacaaaagaagcaaacagatcacgaggaggtaaaaggcatgctgctatggattattatagagtacctcagactataatgtatattaacagaaactcttctctatcaactaatctaaagactcattcttagttttcctaatctaaactcaggtactacaatagaagtaatatccaagaagtgaatgaatatgatgaattccaacaacctccttgctttggtgactctaatgttgaatgggatatcaaaatggaagatgagaaacacaagaaatagctgggttgggggagaagcacgatgaggagaagaaacattagagaagaatccggagtttactttcccagactctaatttaatctgaatgagctttgtttctccacattttgaagaaaatttaagtttagtaataggagattgtgtaatgcaagagtgttgctagcctaaaggctgtgataacatatcttaggagctctgtgtccctcataacaaaagtaacaaacctttcaaaattatttgtggccttgaaatataatacaaaatacctgtatcttaatttctatccttgtaaaatgggaaaagttatttttatatgaaacaacgaatacataaaatactatatatttatataaaatatataaaatataattataaaatatataaaatataaaatgctatatgatagtatataaaatactatatattttatataaaattattatatatgtttacatgtgaataggagctatttgtgagttttattaaaagtctaggtaaaagtaaagtcatctatactcctttctctggggttctcttccctttccttttgtatatttttgctcccctttctctgccgcccccccgcacccacccaggattttaaccacagatgtaatgggtttctgtaacactggcaactcatagctttcacaaatgttcccttggctagggaccacccaaatagtgaccaaatagtgactctcactggctaatgaaaaatcaatgtggtttgatatcattaggacaaggtcaaaataatcctctaagcagaatttccttacattccctcaacaccaatgtgacaatctcgctgcaaacaaggcatagggatgtggcactgctgaacctggtaaagctatgtcattgttaactgaactaaaggaactatcagtgccaaagaagaaagagagtaagagaaaaatgtcagaaatgactgtctagattcagagaaaaacttgatgaaggggcatatagggatggaagacatcttcgactgatgaccagcagctttgaactctgcttctggctcttgatacaaatttgatgtgttgggtggtacaaaatcactacactgtctaggcctaaatgccttcacctgtaaagtgtgggactcctttcaaatctaaagttctgattttgtgtcttgtttggctggcttactcggttagaacataggtttaataaggttaacattagagattcagttttcatataaatcagatggcctgatataatactttgcacatagtacttaataaatatttgctcaatgaataaatgtcttggaatagagaaaaactctatttcatagtcaaggattctaatttagggttaaatggagtggggccaagagagagcacggggcttgatactaatgcatctgaactcctgggcgaaataacttaaaacgtgggtctcactgacattgagtcagtggtatcaccatatagtagttgtgctacaagaacaatcttactattcagactctttgaatcacctgaaagtgttcttgccagtagcctcttcccaaaagagataaccaatcctgagagaattccctgattttaagattgcataaatagctcatcaaatccctacaacattcagttgggatatgaaaattacagatatttttttcctcttcacttttcacatggaaaaacagaagtctgcttccattgcagtcaccccatctcctacaggggtgggaaatgacttagccagtattacagattgagccactacctctttgtaaatactatagttgagcatagaatttgcccacgtatggtacacccagggatttaggtggcaatcacatgccagaattttgctttagataatgagaatcaagtcataaaagaacttgtgaaaataaaaattgagacacttaataatatcaaccacctgatcattgtggtcagacatatgataatttcaattccttagcaatacttaaaaaaaaaaaaaaaaacaactaactaaatagagggattagaacctggaagataaagaatcaaacattagaacaagtaaccttggatcataaatattctctgacattttcaatttgcttgcaacatacagggttttgttttgttttggttttgcttccatgagtgtattgtatcccccactttctccccttctagaagctggctaagtatagacgcagacggtgaaactcaatcgcagagtgctgacagagcttctcttagggtctacagaacagatctactgagtctcacatctcttggtcagcagcgacaggtaaacactagctttattttagcagctcagctgcagctccatgggcagctgtccttactgcacataatcagtccctcttttcagggggttataactcaactatcaaaataccaaaatatgctccggtttgaaacttggtgtatagagtcccaagcccaggaatgaatgtggtttacttccaaatttaagaaaatattgagttttgtaggtcatttatttactattttcaaatatgtttgaagaatcttttaaatgccataggaaaatgtactaaaaaggacacaccattttaatacctttggtgattcattctgaatttcagcacaccactgaaagaaccaaatggtggtggaaaaaaagagtttgttttattttcttaccaaatacagatgttttgaccacttgggtcctcatcagtgttcaaaatattagtgtgttgtaacataataaaataaaggcgttaacttctttgttttgttcttttcagtgatgtgcagaatggattaacgagttcttgtttctggccctcgtataactcaaaaactcgtttcaacttaaataaattaagtaagtaattagttcataatatggcctaatcacctctggtattttgaaacaaacaaaaacacaaaaatggctgttgcacatttgcacttaattacttccacagaaaacactcatgtggactttattacaggtgacataaatttcaaatctaagctttgtttgtgatagaaacctgggttatggtattgtgtagacttccacgaagattctgtaaccgtccctactattttccttaagaaaatgaaaccacagtctatgaaaccacattcttgcgctcttaattggcaaaagaaagtgctttatttcaaaaactctggagaatagtttacttcctacagaggctcaaaggacgttaatataaaaggtagtatcatttctggaatttctgcagtgttcaatttttgctcttggagtctgaacagttcttgtttgcatacacgtctatctgggaattgctcttagtgatcaggacagccttatggaaatccttccagatgaatatactcaatagagcaaaaaatcttgctctgtctttaatgtaaaggaaaaaaggacttttaaacaagtgtgtaattgtgagttctagccttaaaggaactttcttggcttggatttcttctaccctccccttcagatacttaataatcaaagtatatgccaagaaactaatgatgcaaaccagagtattgcacatgaacttggatcgctttcccattgtgtagtgtgtgtagtgaccaagattggacccaaaaagtcgatgatagaaaatagacaatgcaacataatcaaggtacgcccaccttgggtaaattcactaacccatttcctatccttcataaatgcatataatgattctcagtatagattctgaaacttctaggctaatctggccatcagctgtgaaaggaagaaggatcaaccttgattagtaaacttccaggtcatttgcttggcatgaacccactgatgtgttagctgcatacctcacaattctttaggtgttatctgatgttaccaagcattcctgatgccctttgaatttcaatacagaaatctaagtacaactaaacatttccccaagctgtgacagccttatggctattactcattttagaactgagaccaacttttcttctgacatttgacctgggagagtttcttctttagctttctgagtcatgcaaatttattcaaattctgtattgcaacccttgtcagttgtggccatacattcacttagtgatatcttacacacaataggctctcaataaacatttgctttccagaatgaaactagccttatcataagaaaaaatggaatagatttcaatagagttataaatgaactagaagaaagactaatagatcttgagtatattaaaaaaaaaaaaatcaagcagtgagaacagttgggttttgatacagtttcccaagggaagtagtagaagtttcattactcagggcattttaaagtagaatagacaaaacactagtggggtatgttgaaataaaatatgcgtagtccgtctgtgaattagtgtttactttcaatataattataagtgaagcaacactgtaatgggaatttttcatacacaggaaagctatggctactatgtttccacatcgaccatatgttgcacatattggttgctgtggatgtgtatccctactgccctctagtggatgaaatgtaagacctacctgattaaccagatctaacaagctactggtttgggggtatatcaatctttaatcatttagggtagaaagaaaatagctgtgttgatgcattttccatcaaattataaaattgaagggcattaaaaacaacagaatcaaactctgtaattaagactgccatttaatgtttgttcgcacacggtattcatttctgtgtatccctgccaaagatccattgtgtaatgttgtcctcacatgacattaaaaacaccagttccctggaaaatacaaaaaagaaaccgtgctgccttgaaatacacggagttcactttcagaaacataaaattaatacagacacagtaacataatttggaacacaaataatggctacaagaaacttgaaaaccaggactgctccttaactctgagcaagcgtattagcagtctatgggtgtgctggctggtagtcagaagagggcaagcaaaatgggtttcagaacagggaagctgatttgagaaaggactgactaaacacatagtaatagggcaggaaaataactctaaacacacatttggtactgtgggtatatatttaatgctgtcacattgaggctgcttttcaagtgtagcacccagatgctgtactcccaatgaagaaagatagggacctgtacagttctttggcattttgtcattaagacacaggacaaatctgaaggccatcctctttgtataattttaattattttacaggatttagactttaatcactaagttttagtctcacacttagcatataaaataattctcctaaaacaccaagaggaaacaattatacaatctacgttgccaaaacaactgacataccaaagagaataaatgaaatccgaaagaagagaaacataccgtgtgcatgctgagtgcaccagggcaatggcccttattatgaatgtgggaaataaattggctaaatctttaaatatcataaattgttcgaagctggtgatatgtgagtagatgtacacttgaggggaggggaactgggtgggcatggcccagatcgctctctgagttagtgacagtttttacagtacataatttggtaaaaaagtattggtttagtaatgaaaggtaggtcccaatggacttctccttgtaaacttaaaaagagcaacagacttatctagatagagctacaaagcaacatgaaaactctcattacctgagtgatctagaagaaaatctaacttgataaatatcctggaagcattgttttcatctcaactagatttactgtatagcaattagcatctctatagatagatatggggaagcccaggagagctgggggtaagcagtatgggccaaaaggaggaaatacagccaatttcctacttagcaccacggacagagctgtcagcagaaagaaacatccttggagttatccttggtgttaaagaaacacaaagaaatcagtgttgcattttaaagatgcttcttatccccattgcgactggcagtctgggttggaattatgttccagtgcttccctgtagggcacccattggagctgaacgaataaaaaggtgtcttgcccgcctgtgcacatacaggaaggaaaggttgatacaggagaatgatgtctccttgacttttgtctgactcttctctggtttttgaaaaatcatagcactctgaagaatactatccagtctttcccatgtcaagacaagtccctgtgcatttcagccttagggtctctagggcacagggattgctctggggcacaactagggaaagggaataagtaaagacaactctaaaaggaagtaaaatgccttctattccatctcatgttatagaagattacaaataagaccctcttcttcctctcagttctggcctttatgaggtggaagtcactattagactctataactgaataacagattctggaaaattagaactatctctcttgcacttgagaagtcagtgggtctccttttctgtcctgctgaagccagatacagacaaatctagagaaccagttttatgaaagaaagtagcctagcacaaattatttggcattaaaccataccatcatttgctaaagacttggagtcaaagcttttctcatttgattgttaataagaagcttatatttctaaaatatcttgattaccagggaacttgtgggttttggctttaatcaattcttagggcttttcctatcttttgtttcttagacctttatgtccacaggatagtctagagagttgaaatttactttttgccagctcactatgcatgttcaccaaatggtaaagttctcactttaaagcccagcaagacaagatgagctctgtctgcccagcagcctttcagaggcattaagggtaagagagaaggtaagtaattcactatgcgtccccatttctataatggggaaggacgtcttgatacatttacaatactcctctggggatatttcatcagttatacctaaactctaatggacaataattgatttgaactttccacttagcacagagctgtaaacagcttcactgcagacggcagcaatgagccgacgttttgtaaagtggagagagattcagaaaacttttgtactgggtcatgccgtagcctaacagcttttgaatccagggaagaaacagtttgtcctcctggttttaatagctgggctaatcgagtttcaagcctgcagtaggtataggttatcttttgaaggcattccattttaacccctcactattatgatgggtttataacctagccataaaaatgtactcctgatttagacatacatcaggacacattcaaaaacataactttctgaatgttaatttcctggtgaaggaaaaaataagacattaaagtcattttaagactacagattttttttttttttaactctgcgtgggtggtgagcctttcagggaaaatattccctctcctccagtgtccctcatctggttgacaccaccctgtctctccctctcactcaacatcactttgtttcgggctgtatcttagtgcaatctcccatggaatggccccaaagactaatctgctacaaggcatgaaacaagcacaagtatagctctgttccatgactttcttttatagcctccctccagccccgttgaacacacaagtagatgaagtttagaagaattctttcactatttaaatcagctcttctgtctcactacggcatgatagagggtaaaatgaagagaaatgaaagactaactacattttacttagaccactacatcgtctgctcagtctatagctttcctattttgttccacactcctggaattctcacaatgggattcaaagctcacctagaagccactcttagacaacaaaggacacagtcccctttggagttgttgctgccacttctcttgtgtcaaagatctacaaaccttgtggctgtgaagtaggactttatgaacacacagcaagaaagtatattttgtgaatatactgcaaccggacgttacccgccttacatgaatttgacatggaatatgaattttccctcaattcagctgataagattgtaagagcaaaggcataccactgtcagaaaatagatttaccctgcacccccaattgtaattccctttctagaaatctacagaaaaaataggatataatcagacattttgtaagatgttgtccagattctgaaatgcattaaaatcaaactgaacataacttgttccacttggtcctgaaaattacattctgtagcttctagacatcaaacttagttctggttttgatgtaaccgctgattatttaggtaacactaagcaaggtactgaaccttacagagcctcaatttttccatttctcatttggggagaatgacacctgtgtgttcttatttattgatggatgagatgaaattatatcataagctactgaaaaaaatggtgttatatatattttgggtcagtcacctttacctttacagcagcatgaccaatgattggcaaagtagtcaaagtctacttcacccctcctgggtagaaggcaacatggaaagggtattttccatcatttggcagtaagggcctagctctacccatgttcttccccaggcaagcccttttctcccataatcaaagggcaacattttaatatttaatctttaaatcaaatatggcattctcaaatttgatttaaccaatgtctaaacttcactgagctttcagttgagccactaactccctctttcactgtcaagcttccatggaacactctttaaccacaaaattttgtacaatggtacctagtgagctcaaatgactttctcactgatcaacaattattagtctgtaaggagtttatactacagaacatcactctggtgtgtcaggctcagctctcatagacttaactaagcataaaatgtgctttacaaataaaatgcttataaaagttaacaaagaagttaacaaaagttaacaaagaagtggatgacttacattcaccctgtgttttataccttggaattcaaagttccatacttaatggaaatggggaaagcttagcaagggttcagagcaaaggccaaagaaccttccttccttgtttgcccaaaatattaaagagataatttgataatggtcattagtaagatgatgtgttaatagatgttccttacctataactcagattaaacatttaaaaagggggtttatgaagtatgagggattgagttgagttataaaattattacatacttcaggagatgttaaatcctcatatgaaatactctgatgttccagtgtaagttttatgaaatacatttgatccctatttatctgtgacaatttagttaacatgctactagagggcaggacaggtgaaccagaagagttctaggctttggcatctcataaaagttaaaaatgatctgtagagcttatcttgaaatactctttcataaaatgtatgtgtatgattcaatgactgagccatcccacatgctaagttgactacggtcatagggaaccaacctcatgtgaactgtttgatcccattattgaccagtctttatcaatgcttggcagaggtcaaggaagtaaatctaacacctataaaacaaataagcgatttccttgtttgcttttgaaaatgccacttactgattttatttttctttacagttgttagcagctgtacacggtcatattataattgtcacataacaaccttaattcagggacacatcttttgaaacaatgtattattcagcaactttgggtaaacatgcaatttaggagtggaaaagatgcacacagacacaagtaatcatagatacaaagcatggtgaatttctgtgccatgcacttcacaccccaactcatctcgcagggaaactagagaaggggcagaaccatttctattatgataattcacaaagggaggccatatagatatgcatgcaaagtctctccccacctctccatttacatgccaggatttcaactctgcgacactgagtcccttcatttagccaattagtccttccagcttcatgtaatgcacgccaaaaagaaggagaaatagaagtgctgacgttcactgctttgaaagttgctattctaatgccaaagctgcctcttgagcaatttccagaatgtattaacatgggagcaaagcgctattcctaaagacagggatcacattatgcaggggagccccgtttaacgtgtcacaattgcacagaacctccatcccctgcacgatcttacagttgtagtttgcatgggctcaagtttacggtctttacttaggtgaaacttaggaggtcttcctaaagaaaagaagcaatttaaaaatatctagtaagcaaggcatggcacatcttttgtaccatggcattgaccaagtccttttactgtcattctgaagaaagctggtcaaggtgtaaagcaaaccggcctctcagtttaggacagagtgaaggattcttcagtttctttctttctttctttttttaaatcaattaagtctaggttcaattttaattattttaatttggcagacatccctagaattttccctccatattaaggaccaagttgaaaaccattacataattgtgtagctgtgtatctgaatgccctcttatgcacgtgattctgatacttagtaggcaacaaggtgtcgctctgaaatttgaaaaaccattaattcttcagctgaccaccctgtttacagctgaagcagtgatagagattttaatatcgccttctcccttactcttggcaatggatttacaaaagccagtttgtgtcagcctggccctctacaaatttagctgttctttgcttaaatcatgacatttgcaagagatgactggacaagtcccccactgaggcagcatagcagaggtgaaggggcacttgaagtcctatttcttctacacgttgtctctgcttacttcgaccacatctgtcttctaggtctccttttcccaatacacaaaatttgaatactgactgagacgatcctgcagggttccttctagcccttttttgcttttttaccctaaaacgctcaaaatgatttctttctatgtctttggcttctataatttataatcttggctcaatcttctcccttcatttatttcctcaatattaccttttgtaactcttaaatatgctgtccctcaaagaactatcttaaggccatagttttttcttcttatactcatgcatctgaagggctgatgcactcatccatcttttctcataatctacctcttttagttagggttaactaagttagttaacttagataacactttctcttcagaatatctctacttagatggctgctagcccctcaaaacccaaataataaaaagcattctctctttccttttaaatcattctgctatacaaattctgtgtaaccacagtctaatatatccaatgcctcaatcttctgctaaacgttcacattttaatatattgcttctcatatagagccacttatcaaatttagaaattttcttatgatgatgttaactcaaatatacctttttaaactaatattcttggccagctcctaatcacattgtacctaggatatgaaaattgcctcctcagccgggtgcggtggctcacgcctgtaatcccagcactttgggaggccgaggtgggcggatcatgaggtcaggagattgagaccatcctggctaacacggtgaaaccccatctctattaaaaatacaaaaacaaaattagctgggcgtggtggcgggcgcctgtagtcccagctacttgggaggctgaggcaggagaatggcgtgaacctggaggcggagcttgtagtgagccgagatcgcgccactgcactcctgcctgggtgacagagcaagactccatctcaaaaaaaaaaaaaaaaaaaaaaaaaaaaaaaaaattgcctcctcactccaaacatattctcaatggtttgactgtcacagttccctctttagtcctccagtggctttctaccctacttcagatcaattgtgaattatagactcccagcactgaaagccccctccctgtaggtctgcttgtctaacctgtcagcatccggtgccactaaggcccaccttaatccacacagcaagtcgcttttgtcttctggcttccttccgctgagaatacaccctctccatctctgaactttttccacataagcctgcatctacggaataatccctcatgcactgaagaacatctttccttcattcagatgataacttaaacctcacttatgccagagagatttccaagatgattaccagccaactgttaaccctctaaaacaaggtaagaaccactccacccacctttccacacatttcagaaaaaaattatatttttaattgtgtattgtagttgtttataaattattttgatggcagcaaaatatggtatttaatacagtttatttattgccttgcaacttttaagtcttgatttcaaattggtataaaaaacaaaaatgaaaaaagtcccattttgttactttaatatatataaagccatttaagtctcatgctttttgagatctgtcaaccgctatgcacatgataggtatcactaaacacacacttgttgaattgaattgaggaggaaccatcttaaacagtttactcacagaggaggaaggaatcagaagactatgaacataaatattccatagcagcatctgagtgtaacaagaaataataccaaaatgagagtttcccaaatttctctcaccctcttgattgtttaatattatattcataaaactatatttttaaaaacagctttgattttaaaacgttaaatttacacaccaagaagtagacactagcaaagtctcatagtctgatttatttctctgtaatatatctgtcttgagaacatcagcaggaatacaccaaagaaatatgtccctcacgggatcaactatataaaaagacagaacacatcatcagcacaaaaatcattatccatctaatttctcccattctagatggctccagtgagcccctcgatcattactgactagggttaagatagagcttaatggattaattaagccaaagcaggactgcaatgcagaccgaagaggagaaggtcctgacacagatgagacaacaactctgttcctcttttattcaaatgtgcaagacttgcccacccccaagtactacacatttatactgtaaatagtctccaaaaataagatttggtgtctgctgtctgggtcttcccctcagcactcaccaacatctaatacttgggtgttaatcaaaatgtatcgtgtaataagaaattaaatgttaagactttctttttcttcagaaacgtggagaatgattgttaacagaggtaaagcagtagaggcagagcactcgttttggcaatcaaggagcaccaactaagggagaggttattgtttgaatgtcaatgtgactctgagagagggccagggacacagaatattcacaaagagctgaaaggaagaagtgcccacagccataaagtcacggggactggggggcatgcccaaaggcatctgtcgtaatagaaaccttgagatttgttcatttaaaggggattttgaaattcaaatgtaaaaagagaacaagataatccaaagggcacaatttggggcctttttcttcttgtaaaaagaagagaaaatagagagaatcccccataccccccaacaaagtactgtaccatagtggcagtttactctcacttttacgaaccaaatcaacatattaatgacttaaaaaccacgttcacaatggggacaatcagactctatcagacacaacattaaatacgcaggtattaaaagaaaaaaatgcaaactaccaagaaatacctcactccggaaatggtaaggctgacgaaagcagactatgtcattaataccaagcacaccagaaaggcatctatggagctagactgggagggacaggcctcatttgcaccaaagaggaagtgccctgaaggggcccagaagtggggaactgggtagattttagtctttttctttttttggtaggtggggggaatgacagaaacctggcaggctcctgtggaggtctggctgcccccaccatgttgagtcccagtgtctaagtaagtaaagaaatgaaaagacacctatctcaatggttgtcctgaaacagttttaaaagcaagtacaagtccccagcccctagtagaatacaaataatttcatttgtgattcttgcatcaaggaaaaaacttgtgctaagttcaaacaataggatacctctcaaaaagatatgacttctcactagagagaaagaatcaaattctggagtgggaagtgttttttaccttagtgatcttttagtcattttgtaaatgaggaaactgaggacttgccaatggtcacagaagttaattctgtagttggcaattctagcagtaatgaatttacagatagatttggggctatgaggaatccagtggaattgggtccttcaaggccttttatttaaacaattatacatatatatacaaaaaaagatacagggggagagatctatagatatagataagtctgtataaaatatattgctgggtagtaaaaagaggaccggtgttgtagcattttcactaccatggtcaagaagccacggactagattcatttgttcagtgaacaaacagttactgaactctgtgtgcaagtattataaaagtaaaaaagtacgattagacatagtttgtgctgtttcaaaaagagttaacagtatagttgttttatatctacaatacaacctcttaaataatcaagtagtcaaactaattcctattggattaatacaaatcataatcattaattttgaatcttgagagaaggcataaactctgcattatattttagttagacactggaaataatctggaatgtttctggtaccccacatctaaagattggatttcagctattcggtgcatttggatgtttttttccctttagaatccatcctaaattcaatgccctaactcggtagctcagaaacagagctctctaggcattgctgctctccttctgcccagtctctgagagggtattgaggttgaggatggggatgaaactaagaataaggcagagaacgttgctaagtcatgcttctttcagatctaacacatttgtagtcagacctctggccctccgtatccatgggttctatatccgcaaatggaaaatatttggaaaaaaaaaacctccaataaaaaataatgataccacaatgaaaaataacacaaacaaagaaacagtgcagtataacagctatttacatagaccttacattgcattaggtattataagtaatttagagatgatttaaagtacacggaaggatgtgcatgggttatatgcaaatactatcccattttatattagggacttgagcatttgttgatttcggtatctgtgtggtgggctggggtgggatggggtgtcctggaaccagtgccctgctgattggatatcaagggatgactgtacttaatctccaagtcatttcccttacagttatattttagtatatggcaaagcacaatgatttcctttgagatgaacaaaaattgagtagctaaaacctaatgaatacaattagtttaagtaatctggttatggagaaaaatcactagtagtaaagaagtgatcatattacccaagcatttctcttaaaaagaagaaaggagaaagataacatgtgagtgcctactacatttcagtactatgctaggttctttacacaaattagctcatttaattctcataaacatctcccagagcagagattgtttccatttcttctggtaaagaaactgaggcacagcaagattgtgttttgagcagacatacaaagctagaaagtaatttatggcactcatatttggatccaagtttgtccatctacaaagcctataagcctgctaagggagaaacccaaaaatgaaacaacaatgaatgccactggcagtctttttattggatatctactatatgatgctaagttatgtgcccaattaattcgaatataaacacacattttctgccaccttgatgtttaaatatatgagcatgagcaaactaacatttggatccaccatagaatattgatgtagaaaattcaaatcactcatgtatttttttaattttagaagacaatttacctgatgttgcaaagttatcatgcaaaaattaatgctaaaaacataaaaaataccctataaactctttcagtgccagggaacatcatgcactgctcctacaaaaacctggcacagtgaattccctgttaactgccagtagatagggttttatccttaaaaatatttaaaggtgagcacatagtctgcttcatttttactccagggttggcattctcactgcctctacttaccttgttttctgtaaagtgtggaaaggaaaacaagtgaatttttctctcatatatgaaggcctagatgtggggaaaggttgtttaaatgaaaacatggagtttctcctcgtgctaagctggggcatttggagagtcccctcctccctgtgcccctccatccacacaaacatacaccccagttcacgttctagtttcacgcgggataggaaaagaaaacgaaaaacagaaaaagcaggaaaaagtacagaagaagaaggaggaaggataggaagagggtctaaggaagtagtgtagtcttccagagtgctccagaaagtgaaacgatgaaaagggtgagcctcaagagcaaggcacctcccagctctccatggatgaagagtctctatcagctccagaactaaaaccctcagtaggcaggatggtgctaaaagaagaaaaactctggaagggggtcagagacggatattgcagagctttctagccccttctacattacgtataaaaacgattattcaagaaataatgtaattttccagagcatgttcaaatgcaagaaaaaggtgcattctaagattaaatgtactacgacagctaatgattcattatgttaaagttatttattatttacaattattttctatttatgacattgtagtctttcattgacacttgataatcaagagttgacaaaataccatttgaactgctttgctaaagaacaaaaaaagagggattaaggtagacaggaagtgcgtccaccaacaataaaaaggacacatgactcataccccaatattaatgacaaaaatatctacagtgagatcctaaagttctgggtatttgtctaatttttccacaatcagaaccaaaggtaaaaacagcattgacagctactgcagtttggtctgtttaacagaccaaatgctgggatttcaaagattcatggctgggattccaaagatttgtccatgttggaaacagcattcacagtagcttttcggtcaagtggcacaaaggagtgaaaaggtagaaaaggaaacattagcaccaaaaatctctagtcatcttttaccaccttaacatgggttagctgaaggccatggagaataacggatgtgcagttgtctctttcttatacagacagcagagagaggggggaaaaccacacacttatattttgctaatgtaaaagtcccagtggaaacattagcactcaaagacattaatgtggatttgggacactccctgaaggattttgattccattagaaaaaaaaaaaaagacagtgacagatataatcctgctttgatatgtttaatgccatttaaagagaaactgtacccatttacctcaggccaggacaccaagagttcaaaaagtgaaataccatttctcagtgcaaagaaaaagcttggaaaatattatgtgaaaattaatttggcatgcttctttgaaattttagatttctgggatgagcaaatgggtacagttttcttttaactgtttttgaacaccatgtgttgagaagaaaacaacagaatggcaattgctcatccaaaatgctaacttgtggcatggcacagtcaagatggcctgccacagccaaaaagcaggtgtgtgctatgcctctcacttcagtagcatgcacgccacatgtccctgcattcggcaacctcttgcatttgcttttggaacctttctgagggggacagtaaacatgactcaacagaatgtctagctgaggagggactggctctctgagcctgctgtgagacagactttttgaggaagaaccaaaggaaaactggaataatgtatttattttggaattctttggtatcacttcctgtgacctaacaccaagacgactggttccagatcattttgtgtggatgaaatttagcatctaatcaggtcggagagtaatggtgaagcttttgtgtgactggagaggacacattaaatcagctacctcatttggactgaggtcaaggttaatgtagctggtacagatcatacgaacctaacctaaaagcttagagtaataaactcctcacccctcaggtccatggataagcttgaaacagggtgtacaaaaccatttggtgtgctgggatgccaaagcttcttcaatctgacattatgaatctgttattatgttactctaggaattaaaatagttttacgtagatataggtccttttcaactatacaacagtcctatgagggagacgaggaaacagaaaaaaaagattttccttctgccctgtaagaagcctgataaagaggccaagttaaaagtcatgaccacgtctaagctcaagtcaggaaccacttggaatgaaatcccaggatatctgtgctgtaggaatagacaaggtctgaagataaagaagtagatgaaaatcaaaattactattttagaagacaggagtgggacacctctactttattctatacttttaataaatacatcaataataatttattaaaaacctactatgtgcaaatgtcaagagtggggaagaatgaaacctataagtaataaactggaaagaaaaaacatccttaagcttttctgatgtaactgagtgatgttctctgcttctgagtagaaatttatggattcagaaaaggtaatttctttccaaacactcacatgccattgttaatttcactcattcaaatcacaacatttactactataccttttatttctgatggcacattctaggtgttgagggggatacaactgtgtgtaagtacagtctctgtatttattaagcttactgtgcagtggcaggaggaatgagacatataaacatgctctagtataagacagtatgtaatcagtgccacaggagacatacaaataagtgctttagcagttcggaagaagcaagtcctcctggctatagaaccacccctccatagacatactgaaatgactcaatgcacagaaaggaaggatctgtacaactttaagtcaacttacaattgatgtgcattaggggattggagggttagctaggctgtgaggggagggatgtgctcactgtgtccacagctcctctcacactgggtcaccccataattaatgtttatcaaaaacatgcatggataaaagtggaagtcaattgaatgatagaccaggtcaatgggtctgtgttagttctagatattttagatgattattaacaccctgctagaagttggcattataagaacatcattttcttcccacactagtgtaaaaagttcagttttttacccattccagagtgatgggaagtaaaattcagggcttcagtcttccaaatgagggaaatacttggcctgtgcaaaatgctctcggtaggggtatcaaaatgtctttcaaaacagcaaaaaatacatttcctgatagcccctaaggagtatgagttggaatccatgttctctagatgtgacgatggagttcgggagaggcaggtatgctaggatccatataagatcgtatttcccatggtagtgggaaatagaatttgaatgtcctggcttctaggtctgggttcttcctacagaaacatctttttcattttgtattcctcttggacactctagtcctttacctcatgaagagtagccttctgcaattggggtgtgtgtgtgtgtgtttgtgtgtgtgtgtgtgtgtatctttctaagagagaggatagccttactgatgtgcttttgtaaaggattcaaggttgtctggatcctcaaataatgcaattgaaaaaatacggtttctttgattcaatggtgcttacatttgagcagcgttttctttttccattctcaaacacagtatttgagactatctgccaacaataaaaaggtttagagcatcaaaagtgtaggcgaaccaaatcagaattaatctctgtgaaaaccgagattcaggcgcatggaaaaagtttaggaaaaaatccaggtgggaggcaatcccatagaaaggtgtctggcatctttcctgattcaaagtgaggtgtagtaggacacatgtggaagagagatgagcggttctagctattcatatgatccattgtctcaccaatgctcacacaacttgggactgtgttatcagggggccatttgatttatcatgtagtccatgtatcctattgtatgtatgatccggagagaggttaataaagggaagtctaagcttaactgggactaaaatgaggtggcaaacagccattcactcaaacaagactcaccagattaatctgtggagtatccagcagcatttccttttattatcatatgaaaagctgtgcattttattggaaaataattaactctttaaaaaaaaaaacttgcacaccatagcagcaaaagggaggaagataacagtgatcacttctgaacacctggtacacgtttggcactgtttttctttatgcatggatttctttacatatgttatctcatttgatcttcataccaactacgaatgattgatattttgcccattttttttgtataagaatcctaaggttcagagaagttacgtaaatatcctttggtcacacagctagtagggactaagctggaattcaaattggagcagtaggacacaaagcctgtgctcctcaccatgccttgccaggccagacttcatgtgcttttcatggcatgaaatcagtgttgggggaattctgcccagcatctctggttagcagagtgaattgcttttatcatttgccaacatgtcacagaaaaaaacaaaacaacaaaaaaattaaaactcctggctctagatttcctatcaacctgaagtttggcttggttacatattatttgaatatctgacaatcttataaaaagtctaacgagaataaaaaaattcttcatttatgctagctcctatgttagctaaaaatctcctattcctacataacaatgtgcctggggaactctctcactgccagaaactcatctgaaaatgctgaaaagtcagaatttggggcctatatactgactaatgttaccagctgtgagtcagcttgaacatcagtaatatgatatttcccgctacaatttgatttggttaaaatgtgtttgaagttcacccttttattaactggaattaccacctcctgtaactggagggcctctgagaacaggctgctggtgcaatccaccttcccacccgccaacggtgcatttcctggcaacaaatactattaaattgataactacagaaataggtcaaaatgtcttttcaatagttgctaatatttctctaatgctccatagcctccctttgattcttgtgctgacatttttttttgatgagtgcaggagcaacaactgttaaagagaaatgaccagaagaaaggaaagctggctggggtggatggaggtgctcttaggagttcccgtatcagacagaaaagctagatctccctagaggcccaagggccccaaactcagctctgctgttgagtttggtgacccagaagaaaacctgtgtcccatctgagcctcaatactctcatctgtaaaaagaggagactcgagatgactgattattcaaatttgcaaaatgcccagagttcacaggaggtagaagccctgacttatcacaaaacatttgggttttaaatttgtttatagtactcttataatgttacctgttaaggccttggctatccaagatagaaacttattttcatacaaaaaaagtaatattgtgttatattttcgtaagagagaccctttgctatcatactgggttttattcactatgtaaacctatattccctccctctctttcctccaggaacaaagtttgcttttctgagttcacatcacatgtgtgattacagcaaagacagaagtttgaggctgcagtgagccatgattgtggcactatactccagcctgggtgattgagccagacttcaacccttaaaaaacaaaaaagaaaggggtggggtgggtatagtcacattgggaacatagctgattgtgagcctgcaagaagaaaagtccccttgctaaaaaaggttttccagcacttcttctgagatgcaaacataccacggaggggtcaagccattcatgccttcatgctataaccacttcaactccaagagagttatctcagtgtaaagcagttttgaactggagctggagggagggatagggataattctggaacaggggaaggtgaaggaagcaatcagattaactaacacaaggaccctaggctctgctggcagaggagaagatgaagtgggtgacaaggactgaaaagaacccagtctctattgcagtttttgcccagggccttgtctggagctggtgaaccactaaaaaaatcccttgagagatgtcatggtttatcaaaaatgcctttggctcttctgttgctccatggttgtgctgttgctcaacaggcggtcagcaaactacagcctacttggttgaggtgagagtagcttaatctcatataatttaaactcacaaagactatctctccatcagatcccttctgttttccttcctttcctagagcagggaggaaaaaatgtgtgaaagtaagggcaaagaaggaggaggaagaggtagaagaaattaacctttcctcagcttccaagtgagttaggctttgtgttaggtaagcatctctctagatccttccaacagccctgaagatattattagtaataggaagtattttatagggttgaagcagctaactagagctcaaggtggccagtcaggctccttgttacacagcactcttttctcagctcctacaaaatatttatttatatgtatatatttctttttcttctcctcctcctttcactcatgggtgcttgaaaacaggtttaggagccagtcatgtggaatttatctttcaggaatgtcgaacaccccttgagttatccaaagcatacctgactaggagtcaggaggcctacattttctggattaaggcttggtcctaacaaactgtcagtgtggacaggcccatccatctctggggtctgctccaggccttacaattctgtaattcacactcatcaatgtggtggcaggcattagtgtgtttgtacaaaactcagcaagaagtagtctccttagatgctacatgtagactgaagcgaggaactgcctcctgctaatgccagttgtgttttgagtaagaagaataaaaggattgatctgagctgaaagcagaagggaagatgaggggaaggccacagaacacatagctagcagtggcattggtgggggtctgagagaggcagaagcccagggccagagctgagagatcagcttgtttttagcatacacggatgtgtttgatcacatgatggttgggaggtacctaggctaagataatcttaatgttaggtgctcattttaaaacatcaatttaatgactgaagcctattttaatgatccaataaaggccaaagccctcactactatgatacaactatttctccctagtattcactccttgccaaaaaaaaacaaaaaaaaccaaaaaaaaacaaaacaaaacttggctgagacagctatagagtttctgattacaaaacaagatcaccttgatcataatcatctcaaggtgcttggaggaaagaaggagagatgagttcttctgaaccacattatgtggacagaaatcttcaaagagtttaatggaggaattaacttttgaggaattgaaaaaggtatcattttcagtaagagaaaaaatgactgatactttcaattggtatgctagggaaagataaattctaggcaagaccagctctataatttgtggggctcaaggaaaaataaaaaaagtagggctccttattaaaaaattattaagaatttcaggacagcaacagaagcacatcaagccaggcatagggcccgtccaaacatgggaccttgtgcaactgcacaggttgtatacccatgaagctggccctagttttagttattgtttttaccaaggtattccagtcccagagctacccagacccaaatggaaaagcacataccacaactctcaaaactctcagttaaccctgtcttcctacggtaaggacacaactgaattctgcaacaaggatcagaaaatcctggggtctgccaacatatttgatagattgcaactgcactggcttctgcgacatttgtcacagtcactaatccgtgtttctgtcacaacctaaggatgcccaggatatcaatgtctgggaattcaaacatattttctaaaaacacaaatttatttaaaaacaacaacaaaacaagcagaagtcactaaaaagaagctgagtcccctggatgaaagtctgctcttaatctctttctggctttaccttgagtaggtcttgggtgtatgcacacaggttcagaagtgcaggtgaattaccacaataactcttttcagttagagaaaaaatagcagaaacagaagaatctggtcatagcctagcagaaactccctcatttcaccaacagtatgctttctccctttcttattatgctaagttgaagcgatgacttcactctccatggaagctaagtttctctttcctggatgcttggaatgggcctggtgaaaagctattggagggtaacatcatgtctaaaaaatgtatgtatgtatgaagaaagtagagatttaaagagctcagaccaacatcaaaagaataacagcagtccaaagtgaaatgaatgtggcctcttttccaatgaccttagggactttatatatacttagcctacttcttgagtggatagaccagtagcttggcagatgcctaggatgtctgtacaggttgaaacttaattccgtcctttctatacatctttgtcccattaaagaaaaatatctaatatagagaaccagttcactcctacagccagaattatactttgacactagaccaattgctacatccttgatttaggattttttaaaagatatctattggcaaagctaatcttttatttggcttaataggtttgtactgctgctctgcataaggccattagggtccataagtagatggaaatgtgtttgaatctctataatcatgcttagatttcaaaagtcttccatttcacagaggtgatgtaggctcagccatcattttcaagtgttttaacaaatggtaatcagcagagaaggtcttacttttttttttttaaaaagtgactgaccttcacaatggatgcacacataaaactctgattcatttattttaaaaccattctcccctgctgtaaatagatagctacgatatatacattaatatatgtgtgcacaatcagccttagcaatactgctgtgaagtagatgaggatagatggttttctatttatttgacaaatacactattacacagataggttaagcgatttgtcctgtaaggaagggtggagctgggggaaaaaaaaatcctcccacatctgctcttacatgataccactatggaattgggtatcctttattgtttttgagtgacttgatctaaataatgggtaatgtaattttcctgaaaaaaatttcactatttctctcattccctcttactttcttcttctctctgcttctcctctgagattattataaactattgataaatgtggttgctctaaatttacacttgctcttcatgggctttgatgggtttcagcttctaaagagagcataggggagaaaaaagcttatttctaaaaggttttaaaaggatagataacgctgggacagtttatttgaattaatgtcactataaagtggatactggtacgagtactgtcttggacccttctctcgcaagagctagtccaaaggctctgaagtgataccatgggaaggaagagctttttggaggcagaacctgctcatcaacactctgctattctcctgggatatcagacaaaagccagagctttctgtgcaccttcctgttgaactgctttaacttggaactattctctacattagggctgtcctctctgagtccctgaccttagatggtctttctctattttggcacatatttgcatatcagttacggtgacatatttgataaataatgggcctcactgttttttggccagtgaaaaactattttgctattattttaactctttattatctcttttgtcgattatttgtgtgactaaaaagatttcttgtctcttatcatgcttctggttactgtttctcaatgtcatctggtaaatgcttagaaaatacaattttattttgataaattctaaacaaaacataattatgaagaaaaaccaacagagacaagtatataatgaattttgaagctaaatataataaatagttctgaattttctgccactccggctcatttagaatgtaacattgctgacaaattagttattcatgctgttttttaaaaatcaggggcaaaattataagtttcaattctcctaataggagttataacccctgcagcatgaaagcacttgagtaatgtttgctatgtgaaactggcttcggtgatttctcctgaaggaaactgcactatcaaaaccttcatcaaggctgcttctgtttaagacccactgcactacgaatgtccctgtacccgtcagaaccttggctggctgtcatcccatcaagcacctcatctgcagttgccactcagacatgtaaagcgtgtgtttggggacgacgcgcggtggaatgagaagggatacagagctctgttgtaccactacatttattgtaagcaaccacttacacggcaactgctttgctcttttatattctaggcaacacaccggtgaatataattcataatgaacatattcaacattttttccatcagttcaatacattattcataaatattagagatggaaagacctggaagattacagagtccaaacctcctttttgtaactccctttcccctaactgttgatggtagctcaaaaaatccaaaccaaaaccaaaacaaaaaaaaccaccaacaaaacaaaataaaccaaacaaacaaataaaatacaaacacacaaggaaagcaacaaatttacaaattttataagtaaagtgaaaagctccaaagctcgtgtttggtgggggttgttgggggcaggatttacactgatggagctcgctgaagactaggagtatggatgactctttgctttgaagacaggccaagggagggaaatgtcagtttcccccttttagataacaattcaaggtaaagcccaagaggcaataccaagttcttggccaagtgttaactatccatctctacagcctgttgtggactcaggactcaggcactcttctcttcatttagaacttgagatattaatgctaatgataaaaagaaaatgtataaatgaatagagagtgaaaactactagagaatgctccctgggattatctgtactatcaagataggaaaactttgcagatgctactgtctctctagaggaataaatgcttgcattttaatattctcagcagctggttcctgttgaatgccatcaggatgattcagccacccaccaggaacaccagtaacagcaagtgcacacacagaaatctgcaaaactttcttctcttgatgccaacaccattactctggcaaagtcaaaatcctttattgaattatcagttctactaaatgtgaccttgttcccctcacaaataccagcttattctcaaataaatggaacttctggctgattaaaatgtaacattccttctgacttgagcacaccctgctgtcagtctctcttctgccatgttcatgtgatctacctctttttcgttttcttgctatccactgaaaccttgaaggactggcaagatccatacatactcagagtccactttgtatgttgctctgcttgctaaacccatacatttaatgttatatctctacccttacatgtctcaagttatttcatcatttccattttttagacattttctatttccacagaatgtgtttgtatgtctggaaaaacagaaatgtgtagctgaactgcatttaccattgacctcattaatacagaattaccatgccatattcaagctagataaaaatgctatacttgccctcttcttcaaatttagaccagattacacactaaagggaagaaaatgccaaagatgacagctagctatcaaaaagatctcactgtctcattttcaggtctccaaagtaaaatctaaggacattcaacacagattcaggtgctctcaacagccatgaaaatatatggctgaagagggaatctataaatgtaatgaatacacaattggcttataacagatgcaaccaaaattaaattcgatatcttgacctgctctccaaagtgaaagtttctagtttaggctacagacagaggtgtaacaagctcattaatcacatgaaccagaaatataagctgacacttctggggatgctgcaaagagcagtcttaagctgttgggggtctgtggggaacctgaaaaatcatgtggctctgacagtccacagcaagcaacaccactgcattttacaatgtatgtgggtcaggcactggccataaccaccactattttaaacttccaggacaggatttaaggatctttgtagggaaataataggtccaatatggacttttataaaaagattcaatatatttttattaggttcctgttacacaaaaatcattgtgttcattgcatgagaagacaatgaattaggtcaatctatgacctcgagaagtatataaatgggaaagaatcagaggcaggggaatattaataagtaatagtagcaataacaataacaacaatgatgagtgataaccttgagctagtcattctgctaagcactttatatactacatttcatggaattcttatagtatcctaggaaggcagatatcgtttttctctttacagacgtggaacgtgaggcccagtaaaattaagtacattgcctaaaattatgtagacctgttctttacattacaaataaatacataaatagcttgcatataaaatgaaatatggcaaggctcattaaaagatacaaagtgttgtagaaataaaggaggcagaatgtgtttctatttgggaatactaggagaaaaggaacatggatgggaaaatgtggtgtgtgcttaggaaacaaggattgttccagtttgtaatgttataaacctgttgaatcatcaatgtctcattagaactcatactttgataagatagtaaaatataccaatctgtacaggaatatttctacaaagaaatacttctttccaaaagatcttctgactacaatttctcaaaacttttcttgttatttattttttggtggcgatagagggagaaaaaatgtgagatacaaggctatggaggtctgggcagcagtgttaactccagagtctctagggagtacaatgcatttgggtgcattttccttcattcctcagaatgccttatcctcatcacacatatttgtccctgccacatccgaggtgaggttactggcatagaaatagaaaccctgagggtctggtttcttccacttcttcaaagtgggatatcacttactttttatttttataaattagttttagtggtcagccttttggcataggagtacatcaagaaaacgtgagttagaaaacttgagttctggtcccagttttgccttgctcatcttgaaagcattttatctcttctctgtgtttaagttttcttattggcaaaatgagtagtttaagcctgaatatcatttcttaatctgttggacaaccccctcatcaaattttttttgataaaaataaaaccttgttttaatgtagatccttctattcttctctatttaaaattcctggttcacagaatgcaatatatagtaccattagtccagataattttgtagagctttactttctctattttgttaagtttttctcgtaaattttgttttccaaatataaaacattgtaatatatatgtattttcaaattctacatggtcctcgaccagatattccaatattccattctgaagagttggttaacccactcacccatattgagatatctaaagccccttcaagctccaagatacagtgattatgatgctctgatgctgacatttgctttgtcaacgcttaaagcagagcttttaaacttcaaacaatagcataacaagttgctataacaattacacttacataaatctttaagcagatgtgcataacagctctttacatctactatcacactggacaaccaaagcttatgatgttgttataaatccttgcaatagtaaattctacagttaattataacctataggaaaaagtactgtccatatttagaattgattgactcttattttccacatctgttaattttgcacccagctatagggctttaaatagctcccataactttaatcattagcccccactcagtcatgacttctatgtctcacccttctgaccttgcccactgagttcactcttactgatgtaatcaaacatgtttcattgtagttgcattcgtcacagtgctcattagaattatcatcattcctacagcacctcagtgcaatgaaattgtgtgcctatgcaatttgttgttattttaagttcttcagctggaattttaaaaatctagatggacaattttattttatctgatcgataaatatatatccagttaagtgcctctgaaaaattggtaagaaaattatttattagagcaaaatcttaagtctagagagatttttgtaaacttggacagcagcattcactgaccttgaatccacaggttcaaaatttattagtgtcaagttagtcttttaaagcaatccattaaagcaataagtataaaatatatatggtttacatttatgtatgtgttgaatttaataaattagtcaggagtcaaggtatttttaaagaaatattaaatctgttctatattgatcaattaactgactttctaacttaaaatattcttttgctgtagttaaaacctttttttctttttaaaacaaacagagtacataaactgtaaggtggcaatgtagttcactgcgacaatctatatattccttaacgtttgttctttttatggtcatggtatgtagaaacaaataaatgtataatagtttaagtccaggagtttttgcctgactaaattctaaacacatagcttaaataaagggttgaaagcctggcatctcatcattactgtttatatgttataaggtttgcagggccaccttataaaatatatagttgtttattttcatgttcaataaataagtagtgtggggtttcagactgagaatggattacagattgttctctcctggttatttttggctttaagtatattgatcattttatcattttcttgttttaaactactttaaacacagcacaaatgttattctcatcatgccagaaatgggtttggaattgattctgagtttccatcaattttactctttgctctttgtgagaagttttgcactgcttaaattcgaaaggatagttttgtttaaaagatgtcacagtacaacatttagagaaccttagctgcccagaaaaactcagattttctgctttacaaaagaataaaaatcatcgaatttattaccctggactttattgaaatcagtgaagaatattcatacaaatacagtttcacgaacttcctctctctctttcttcatgtaagtgtttgacaaaagcatgtatcttctgagaagccggcctgattggtccaggttggcactgtttcagtgtttggcctacggcggctgcttaggaataatttcatctcatcctctctattttcctggactgtatcaaactcagacacgtggtatgcaaaggaaatccaagtcttttaaaaatgctatttcttttggtactaaagccaagaccagttctactttggccaaatgatcttatcaagatttaacaagagatattcagtaatatctccaatctgtgagaagacattccactaaggaagataatttattacatacagtgtacatatatttctccacttggtaccaggaagagacatgatcaaacttattctattggtactgaaaacaatgtaacactgacaaaaattctgtggcaattattcatttcaattaatttaaaaagaaataaacaagtagctcttcccccattaaaacagatactggaaatctattttcagttattgctgaaaatattttggcttccacaaaggcaccttactaacacactactttgccctccactgtgctgtcacaattcagaacttgtaacattttattcaggtactctagactaattagatgaaacaactgcattacagtattaagatgcttttgtagaattaaatgaaaggagatctgcacagttcagatagcttggaagatttgcaatgaatatcaccaaaatcctgcatgtgcaatatatttttctacatttacaaattagctaatgaataagtgtattccacaataactgctaggatttaatttcacacttaagaatatcaacaaacacagagagaaatttagataggtaaactccatttcccttcccaccccaccctagtgctcccctgcactgtttgcatttcagaacaaatgcttcatgtctcttgaaaagcgccaggaaatctcttctctagctatgcaggcctcaattttatgtgtgtagtatgacacaccttaaaagagagagccccacaaactagagtgggacgttaatttaaatacagacttaaggagaagagctccatctactgaatcagttagatcatagtgtgtaccctatagttatcccattcactactttcaaccacttagaggctctggagggaacaggaaagttatagacctgagcaaccatgaaaaacagctttgagcctaatgccatttgggatatttctcggataccctgagcccctttcctttgcccctccaatttcaaagctttccatgttgcaatataaaataaaaatggatgttttgctatatgaaccatcccttggaagtagaaagtcattggttgttgaaggaaatgtctcagacagttgaagagaaagctacagaaagaaaatctctagctggcaggttgggcagcctaggtaagaagggaaaagaagagtagcctacttactcctcctgccttgcaccattgctggggaagcctgcagccacccaggatcagctcttctggcctctccccggctgcacagtattgttgtggcattgggaatttgctgtggcttcgtaagattatggggatgtgcttcagcaagccaaaaaagtcacaaacaaaattcaagaggaaaaaaaaaaagtataaaaacagctgatcttactggagaagctcttggcattttcctacatatgccacaattttctctggtatttcctggttctgtgatcagaaaaattatcgtatcatatttattactgttgtttttttcagggttgctggtggtgacgggtggtacagtgagggcaaacagatggatcaaggagaagcaaagtaaagattacttctcccacttgtttgaaagctttccaagagattgcaggttaaaaaatctcttcttcagaatactgaagatgtatagatatcacatataggaaaagatggccatactctttctagattgggaaagaaaaaaacttctaacacagtaacagattcggaacaaagcaaattgtatcagaaaaaacttaaacgttcatatagctgcataaaattcagcagcatataagacttataaaaatacttcataaattaagataaaatatttgaatataaatgggtgttaagtatatatataattggatgaaagcaatagttcagtgaattttttattacagaaaaataaaatataatgaattaacaaaagttttacagtaatgctaaccttttctcttgtaggttaaaatagaattaatgtaactgtaaagtggattcatgtttccctgtgggtgtgaatgtatatatatacctgcccaggtattactgactgacactgaaaggtgatatgttgcaaagaaattcaaactttgagcattattttaaattgggtatttaaaatatcagtattaacctggcaggtttctttctttttctttctttctttttaatacatttaattttcagggtctgttttaaagcacgaaaagaaaaacagattagaaaagcattgcacatcaataagtattttgtaaaataatccatttgcatttattagaatattcagttctcaaaaaacggctaattggattttcttcaagccttttcaagacaagttcagttctgtgtcaaggataactatgagaaatttcacctcaaaaggtaatttgtttggttagttataaaagcctgaaaaacaagattatctccaccataactataacaaaacagctaatgagtaagtacattctggtaagaatcgataagaatggcaaagcctgagagggtcatcgcagacttgagaaaggtaaccaagtgaggaaacatcaaacagagttaaagcattctgaaaaacggaaagtgttaataatcactgacaggaaagaatattcttcgatagcgatgacaacaacaaaacaaaacaaaacaaaacaactaaaacaactggaaatacatatctccagaggcaaactatgactacttattaagcaagaggagaacctgcttctttgtcattccctttggaagcctagctttaaaaaaaaaaaaaaaaaaaggttgcacaaaagatacatgtgttccttttctggtattattacaggcccacctagatttagctttcgattccagatgagatcaggcatgttcagactagcacatctttgctctgtaagcacagagctgctatcatttcactggcaaattctcgtatccccaaatttatgcacaatagataccctttaaaatctgcaaattttctatttcagtgaaataactgattgagttaattttttttcttaatttacgctgctcgtattaagctgaaaagttaaggcaggcaactcctataaaaaaggaaagttgaacagtacttaccctaagtgtaatgtgcaagccttaatggggcaatttacttttgctctatgatatttagaaaggtgtccaggtctaaactcagctctcgcctttttcccttctggaaaactgagtagactcacagaaggtgcctctgcgaaagatcatacaaatcaacagccttacctgtggccattcagaagactgcactttggtgtgtgtttaaaactatgaataaagtcagatacagcgcatgctcagcaggcaatttaaaaatatttataacattgttgtttcaaaaacaaatttcctcaaacaaagcaaaactcaaatttttttatccatgccaagtttaacgttctgagacaaagctgttttggagttttccgctgaaggaaaaaaggcttttaaaattttttgttgaacgaaaaatagttctctcttcccttttgggtacgcttaaaggggtggaataaatttttctccaagtttcaacaaaattcacctctggctatgataaggcattacaaatttaaggtctgtaaaaaataattttagagaaactaacaagaaactaaaaactatgggtttaaagaatgtaatggtcatctgaactttcaaggcagtcttgcatgtaactatacaaaaattatatcctgatacaaacaggatatattatatgtagataagaataatgtgtatacaaccatatgcatacctagagaagttttatttttcttttgctaactaaaatcagaactctctaaagccgaaaaagaaatacaacaaaaatttaggagaaacccagtaataacatcggcacaattcatctgtttttcatagcaagcgtggaaaagaaggcaatcataccaattgattaaattttgagatatataaaataaaaatttgataaaagaaggtttttaaagtatgaattgcagtagaaatgcctgtttcgttcctggttgaaaatttctttctcttccttgaatatccctaagcattccattttaccatctatcaccaaaccctgaacagctcacagatctcacagatcttatttaaatctcttacttaattcttaagtctctgaatgaatttcagctcctgctctactttccaagggtgctcagctggcctcacaaaagctccacagacacatcgttcactatctctgatgctttcaagcttaacagaggatgccaaaaaaaaaaaaaaaatcaacgattaaaaaaagtttattaaagtgaaactaggagtgcaaatttgaagaagttgcttctacttttatttctctctcaactcagcacaggtgtttcctaacttatactgctgtgcatgctgatgaaggggagggttaaattaaggtgagggagtgggccaagggcagaccaacaagcatataggatctccagcctcatgtgttaatggatgtgtttaaaaatggaccccccaaaaagcctagaatgaggtttctttttggcaaataattaaaccagtatactgaaataattaaagctttgtctttaaataaagcatcagatcaacagaacaaaaacaaagataaaaattgcacacacatatgcatgtgcgcacacacgctatgacacacacagatacgcaaaactagtgggtgaggggagaaggaaattaaataaaagaaaacaaacagagtcctaacaggccattctccgaaaaggaatctaaataaaaagtcatatgatatctgatagtgcaggacacgtcgccaagaactggagcggattgcctacaggaagaaagggccagtgtattccagctcaaagagcttttctttcctcctcctctattttttttcccttttctcctcgactgtgaatgtgtcactctcaggtcagatccacgaagaatcccagaatgacagctatcacctgtcactgtactcttggcggcacaactagctgataggagctgcctgagttgggatcaagaagagctagtgcagctttcagtaacagcctgttatcccagtccctctgcccctttcaaagatccccttggtcacatcaaaaacagaccaaaaagaaaaagaaaaaagaaaaaaaagggggggtaccaaatgaaaaattaaaaatgcagggacaacagcccacagcaacaaaagaattcagggagaaaaaatagaacacaagcaaaaaggaaaaaagcaaaaccaaaacaactcttgtcttcaatataaaactttttaaagactgagtttctcttatttggatgacattctttttaaaagtatttttctccttaagcactattaaaagcattaaaaaattctacaaaaatacagaaaagtctgaaagcaattcaagaatattcctaaagaaaacatgtaagtgtaagaagtgagttaccctggaaaattctggatttgccaaaagttcccctacttctaatatctttcagtgagttcaagtgctaacactggccacctagtacttgttttttatctgaggatcattactgaggcaacacatacatagtaaggtttcccgaaaagactccttgttatcaagttacttcaaacataaggcactcacacctcccagccaggagggttttttgatgagcatcacactctgccctgatatgtattacacccttaagaagcagttacataaatgcattctataattatggaaaatgtatatatctatattttcccctacattttccctccccagggatatgaatagattttattttcagttaatagaaaaaaaaagaaaagagtttctgattcttgaaacaactgttgtagctgttttctacttagcaaaacagttatctgtagttaggaatggtacataatatatatttaaggatttttgtagagcttgagaattgttccccttgtttagtttcgtgtctataatgtaccttaaaaagatttctaagtgacaatcaacatataaatgcattaagaggagaactttaagaaagaaaacattatcttgggtttacaaatccaggatattagcataaagatataaatgtacagcatatataaaagataaaattgtttactacattttacacatacagctcacatctgatttctttttgcttttgttggagcattaatttgaaaatgataagcattctgaaatgtttgctacaacacaaattcatggtaaaaatatacatgcataggcaaaaattgaaatggagaacacaaagctacgtggcaatcagaatcgttgacaaaatctccatctagactatattttgcatgaactagtgtatcatagaaggggcaagaaatctctctgggggttttgtcatttacataattagaaacaaaaataaaatacaaatatctgctcccttactaccttttcttaataactgacaagtgacacaagtggtaccttttaaacagatggatgcaaaaacttgtgagatcgaatgaactgatgtaccccattggtattttgggaacccaaattccataattaactttttacccaagtggcaaaagtagaagatgttctagtcaccaaattgattatttgatggacttttgttctttcttccacaagattttggcgacccagaaagggtaaagacatgataagagaagatgcatcctgaacaacttttattgtgagtagaaaaaaaatagcataaagtgagcataagaacagttggatttggaaagattaaaagaggagaaaagagcaacatatgcaacttaactagtctttttctttttaattttttcatgtacatatatgtatatattgggatgatggggagaaaagataactggatttcttttgaatgtctttgtgtctttatagagtgaatgttctgttcctgtctctttctttttaggcgaaaaactaataaaaatagaaaaacatatatcagacattaagctcactccccccccccccacccttccctttgtaaagaactctttgttctctagtgaaaatgctgaaaaatccccgggcagctactccctgaaacaagtgcaaaacacttagaggcttttgggctggctgggagccagaaaccctcccgctgtctggttagaagaggaaaaaaagaagagagagggagagggagagaggggaagagggatggggggcagagagagaggaagagagagaggaagagagaggaaaagagaagggagagagagagagagagagagagagagagagagagaaattggagcttcctttaatagacataggaagcagcgtttttttctttcttttttttcaaaactggcggtcaagcgttaagtaactcccgtctaaatccacctgctagaaatgaacttgggtaaccccccaggggtgcacaaagacagggaagacagtaacatactccatactctttcccaccccccgttgtactgcttccattctttctgctctcatacacaaatgcccacagcttctcacgccgcccctcttaccccccaacaacaaacacagcaaaatacatgctccctcggtctcctaaaaaaaaaaaaaggcttttccatctcggttgcgacacagtgataaggggtagcgaacatctcatacctggtgtgaatgctaatcagtcaggagttctccttttcccaagacagggaactgtttccttccaaatttattagaacctcctccactgcctctttgaaaaaccttctttgtcaccctctcccaagtcccgatacttctttaaaaaaaaaatggcttcggagctccttctattcttgatattgattctctctctctccccccacccctcctcctctctcctgtctgtgtctcttctgagtggtctattgataagtccctggaggcactgggtcagcctgcccgtaggaaaccagacacaatgcacaaatctccgagtgccattctgccatcagcaagcagaccacgtttaggagagagagagaggaaaaaaaaacagtagagcaagagacagagagagagagagagagagagagacaccaaccgagggagggagagagagactgagagagaggaagagagagggggaagagagagaggggggggagagagagagagagagggagagagaggagagacggagagagagagtgtgtgagaaaaagactgattggaacaggagggagagagagagaaaaggagaaggagagagagcgcgagagggagagcggcactgccagtcaggttaatcatccctactttaattagctgttcggcttagacataaaacaattgaatttgaatgatctgtcagcaggctcggctgaaccaaaggggaaaagcgaatattacaaaaagactgttggtgtgttctgataagcaatactgctcgtactgacaaatcctcaaagggggaactattaaaacttacaactaaacaaaaagtgcaaatacaaatggcactagatagaggtctttaaaaaatggagttttctcctctagttttatgaaccatagatatttatgtgcaggtgccaacatattaggggttttcgtgtaatgtgtgaaagtttattaacgatggtctaggagtgtagcagacagatgctgcagagaacaagacaggtacagtcagatgccgaatctagatcttggagggagaaggatgctggaagaagaggcaccgtggcaagagatcagcacagacaaagtcagtgggcagataggcagacagattttaggcacggcacgatctcatctaaaaaggcaaaagttctgatgcaatattaggtacaaaacaatccatccatcctcctctcccgggtgcactccaaggtacagttaaaatggattaatctttgtgacaaacagagctggcaaggcagacactgaaggcgatttgcagacccagagaatacagagctagaaaaagccccagagatcaatctctccccctcccaatttagtagagaggaaactgaggcccagagtcgacactagacactaggactccaggagcccaccaggccagtgctctttccaccacaccagctaacctagagtattctttgaagatctggcccaacaggtatgaaaatcacccttacctcccaaataagaagattactccacctatatagttagtgcacaaacctccaatttctcaaaatgtttaaatagccaaatggaaatataattacatatataaatacatttccactttatatatatgtgtgtttatgtatatatatatatatggagagagagagagagagaccattttgaatgctaggaacaagggatttaagtctttaattcattctaggagaaaagcagaaaaatataatattgtagaggcctcgtctcagcaagatataacttgtgtcacattttcaagctaatgaaggctagtggtttgatctacaaagacctcaccctgaatttacaattcgctctatgaacatcatctgctatatatcaccaagtgagaagatgtggtttttctcatacacctcgtttctaaaatataggcacattgtgggtgaaagagattgagtctttcagcatactatgtagttttaaagcactgatgagattttccacctggagaattaggtatgtacaacctttccaatatatttcaattgaaaatgagctactaaaaaggggaaactatattttccgcccatgaaagtgatggtatctttttcgggacacatatgatcatgttcactaaggattcccttttgacaatgggtaattgaaggtccagtttttaaatggtgaaagaggtgcttatgaagagaacagtgccatcagatgttactggagagattaagtttcttgccctaaaacaagactcaggatgtgtatgaaaccgaaaactatctctcagtcatgcttcagcaacaacattgctacttagggagaaagaagaaaaccgaaagaaatgtcaggcacgtgggagcccactcaaagacaagtaatctgagagaagtcatagccagagtaatttagtttatttgcacaccaacctctttaacaatggctgctatgccatgcctaaaacacacggcctacagttgactgatttggaaagggggaaggaatcagtgattttgataatggcagatcctttggcaagccccaaaatacctgataggccagagcccagaagaaagcagtggagtgcttagtaaatgtctgttggtgaactgagaaaaaagaacaagagctttggagcaaacacatatttatatataacactgcaaaagtcacagctactctgaaagcctcagttttcctttctgtaaaaggtgatgatattggtcccatagagttgtcttaaggatgacatgaggaaacatataaagtacacagctagtcattacacggtagttattatggaggaaggtgtgtaaacaaaagtgtatattatggatgtgctgagtgtgttatattcaaagcatgtaggttcaagacatgaaagcatatagcaaagcaaggatctaatatacagatctctactagaaaggattggcagtagagattataaagtttagaactaaattcctaaaatctaaacttcaaggatgttaggtcatctggggttgtattatttctttgttcccagattttactatatttcctggctcataataataatgatggccaacatattactaattggcttgccctaagcagtctgctaaggactttacattttaaaatcatactttagcatcacaagaatcctatgaatgaggtactaccaatatccgcatttcatagaaaagaaaactgaggtatagaaagattgtgtaacttgctcaagatcacacgcctagcaagtgaggagctgggaattaaatccagccaatctgattttaaagcccgcattctcagccatggtactaaactggcacacagtaggtattcagtcaatgtgtgttgaatgaataagcaaataaaaaaaacactagaatttttatttcattggagatcagtaataatctgtgcaaaaccacttgagagaatcttgttttcgaattatagaatctgtccttcttctgtagctcacttcaggtgtagtcctttgtcagaaaccagggtgagccatgtccctgcatggtgctgaaaatggatgaagggaagagtgctgaccatgaccacccagggcatttaaatatctgacggcattttcagcactttgaggacagtgttagcacaagggttattaattggcttaattccagttcggataattacatcgtgtctctttaattttcccccgactatgccattcttcacttcctgtcacaaatgtgctctttaaaaaagcatacgaatacacacaaacatatagttatatttaaggtttgcataatcatttagggtgcttttttttctaaatgatcagtgtatagtagctatgtaataaatgaatgggcaaaagaattaaagtcattgtaaaataaagataactagttgaagctttttgtttggcaatgaaacagatttttaaaacatttccttggtgacagaattccaatcacatttttttctcatgggcagatatttccagagctgatgacctgctcatgataagctgattttcttacactatgtagtttccagtataaaaaaataccaatgaaaacttcgatattttagagtagaaaatgagactaagtcctgagtggtagagcatactgaacgtacgggttttcagtgaattattaacccatttattagctctgacttacttgacaggttttttttttttatctccaaacatatcactagaataatcttcaaattatgaaagaaaaggacaacatatcctaatttaataagcttaggaaagtttgacagtcataaacagacacaactccttttcctttttccaaagaattcttggcctttgaaatactgtgcctgcattatactaaagaaacactcccagaaaaatatgcttaaaacatgtacacaaataggtaaatgcacccatggtagaccatagtttattaggcctttttagtgtacatttgtatgaataagtcatcaaatatagggagtgtggaaaataagagaataaagggttaatttatttattatgcaggaaggtttctagatctttgctccttcagcttttagttcaaaattccatgcatattctgcacataataataaatgccataattcaacgtatctcataatttgatttactttcaagcacctttttttctggttcagctcttgaagccttccttcttataaacttcctccaagttattttttgtagcgctctgtaaaatatcatttaaagttggtgttcataagataaccctcatgctatagagagatttgtatcaaactagtccatatttccttttgagaaccagtggtcaagtcccatgctcttatctgagaacaagccacaataaatatataaaacagccctttcccacctgtttgacccctgtaataatgatagcagtctctcagtgactgccctctggttagttactcattccttaagactgagctcttccaggacaaggtctttccattctaccttgtatatttaatgtattgtccagcatcacacctgccatggtggtagatgatctcccagaaaagctggaagcaacaaattttaattccctttgttcttcatgagtaaatacaaatttttctctctgtgtgtcaagttttcaacatgtaaaaggggcatactttatcctaagattagtgatttgatgttcagaaaataatattggagggtatagtatttaagaattagctagtgaaaagcacttgttttggttattttcatagtatcgccactatttttatagcaagaagtacttagaaaacatgttttaaattcaaaatttaggtgaattttgaattcaaaagaaaagtggacaagatttatcctgaatattagagatagtaagcacttggtttttaaatgccatttaggaacagcctgacagattttatacaagcagaaggtatttaggaaattctctggttctctcagtttacagagaagagctgagtggcagagatattttatctgacaagcttaaggtaaaaaaacttggtagaagtgaactagtgctggaacccagtctgtctgtccctggttccacactcttctcactcatactttgaaagatggcttttatactcttgactccagatcccctcttttttggacatattttactgacggaactcttaaattctggtgctgataaaggggtacaatattcctaatgtagtctgataaacacactacaaaggaactatagtaggctgaggaatggccccccccaaaagatatccatgtcctaatccccagaacctttgaatgttaccttacgtggcaaaggggtcttgcaaatatgattaaattaaggctattaaaatgaggagattatcctggattttctaggtggactctaactgtaatcacaaaggttcttataagagagaggcaggaggatcagagttagcagatgtgatgacagaaacaagaggttggggttatttgaagaaggggtcatgcaccaaggagtgcagggtcctccaaaagatagaaaaggcaaataaatggatcctcctttatagccgctaaaaggaaccagccctcccaacacctttactttagtacagtgaaactgatttgagacttctggtttcagaactgtaagagaatacatttgcattgttttaaaccaccaagcttgtggtaatttgttataacagccataggaaattaacacagggaccatcagctaccttgatctggacataatctttcaacacagttgaaatatttcttagctctttaaaaaattattttagcagatatattaccttactggttcaaactgagcttgtgatacaagaacccttaccagtcttcagaaaaatattgactaggataagtcaaggagggtcttttctcctgacactaagagcttccttctaagttgacataaagcaatcaatctaatgattattggttaattgatcagttggctgcagatccatctaatcacatttgcccacctcctgtcttatagtaactcttcactggtggtttggcaattgtatctccaagttaatctacaacagtagttctagttagaagcaaagagaagggtttcagtgtccatttcttgagtgccagagacctgaactcattcagaagtgagtgctctcttgctagacccccaccccacatttttttctgagctttcttaacagaggtcagaaaaaagaagcatgaggcagcttaggcaaaaaacaaacaaaacaatctcctcccccccccctctttttttttgagacagggtcttgctctgtcaccgaggctggagtgcactggtggtgtgatcacagctcactgcaacctcaaccacctgagctcaaggaatcctccagcctcagcatccagagtagctgggtgtgaccacaggtgtgtgccaccatgccaggctaatttttaaatttttgtagtgatgaggttttgctatgttgctcaggctggtctcaaactcctggcctcaaatggtcctcccacttgggcctcctaaagtgctggattacaggtgtgagccactgcgcccagcccctatccaaactttaataagactcttttgccatagtgtatcattgccattcagttaccgcttacattctataggatagtgctcctaaaagagtagtccttgggccagcagcatcagcattgcctagaaacttgttagacacgtaacttattgtgtcttattctagacctactgaatcagatgctcagaggtggatgtctgagtgtgtatattttaacaagccctttaggtaattctaaagcctagctgagaacaattgtcataggacaaatctgtgaggctcatcaaggctaatgaaaaaacacgttggactcagagtgagatcacctgctaatctaggtgtcatggtgactctgtcatttgccagctatgtgactttagattatgttcttagtctatttgtctcatctgtaagatggaaataataataattaataataataataaattgctttatgtgaaaagttaatgtagaagttaacaagatcatgcatatgaaaacactttacaacctcagggttattattgtagaagaaacatcaatttggattgcaagtatcctaggaccacattgttggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatctgctggcattattagtctctagaaccaagtgctaaatttcttgatttgaaagtctacctttctatttatcaggtagcagaatttagtgacagctttgaattctgtatgccagtgaaagtctatggcttgtgggattcagaaccacaattttttatcaatttccaatgacactcagttttagtaaagtggcccatgatctcttgcatttccataccatattctcaaataagtaagaagctccagggagctcgctcaacaattgattatggtcacatattttttcaatagaaaatatgtatatcctggtaggtgggaaggatggtcctgatcaggactgagatctttttagaggttcaagtccaaactcttagtaggttgaagggaactcagatgcaaccagattagacacaactatgattttcatggaaaatcatcagaattttatccaatctctgagtaatgaaaatttgcagtatttctcaacagctctatatatgtggagaaaaccacctcataagaaagctaaccatgtcttttccttctttcatgaaataatagtgacgtatgcctcttggcctgaggactcgtccttcctctgaagactaatgtctgcacgtcaccttttggcaacccctctgtgccttgcaggacagttgtgtagcaaagattctgtttgggttgctgtttcctctgagccagtcacactggtgcatcaggagatgcagctgcaccttttaagagctctgtgtccttaagcaagtcatctgtccttttacatttcatagatttttcatttgtaaaatatgaataatatgtgccttaccaatcttacaaattgttctgaagatcaaaatggatgatgtatccaaaatgctttgtaaactaagaatctcattcggttggtgttactgatgttgttattatttactctttagcaggagagtaaagatatatacagacatattgggtacggtagcttgaatatttttagacatctacgttgtatatgcctccaaggtttccccctgaacttacattaatccctttttcaggttacagctaaggtggtaactaaggatgttaatttcctttaggtccctataggatctctattttgatcatgattagtttatacatgaaatagacactgctgcagaatttacaatgtttccattctggccaactcaactttgaacatattccctaagtaagaacaaattcagtactataacactgaagaaaacatagcatccgaagctggtattgagggagtgaaaatatcttcaaaggctttttcttgattgcttaatataaaaaatctgcttagaaatgtccactagttcaacaagcattcctgaaggaaatctgtaacaaagctactgtgcattaacatttaaaagaacaggaacatgtagtctacctcaaaacaaattattattgcttgaattgcccaaactttgttaaccaaaattgaatttcgcctaagttgaattcatgtgaagagctcataatgcattgttgctatttagatagttgtcatagtatgtggtactcagtaagtcctctaaaatggaagggaaattaactacatggtataatttcaacataagtcattaatataattgtgcgaagaatatctctgaatatattgaactgctatttgaatctttaattgtgcatacaattctaccttttctgctatgcatccttaactagactatatgctccctgaggacaattcctgatttacacatctccaaatttcccgctgccttcagtacagtggtttacaagtagcatttgctttcaaactatctgctgtttaattatattcactttttattggcttttcttggggggcaatttatgcacataaagtgtccatagataaatgcatcattatcactgaggtgaaagttgtgattcttaatttttttaaaaaaacatatacattgggccacttatttttcctgtgtgacactcaatctaattatagaagtgaatagaaaaacatgatctcttttaaaaggcgcactttacgtgaaacaattttaggaattcagcttatgtgtcaagtacagtcattctgcacagtgatggtgatggggaggctctatgtactatggttttgacagaaaatattttaacttaaagccagctacccataaaattacgtaaacataaatatgcactctcccacaaacacatttgcacatctttaaacttagattaatgcaaagaaaagatatattcttttgttctagtggaatacaaatgataaagactaataaatgaataaataaagctctaggtaaccaaatcaatgtctgctcaattctggtcaaggaggtgaagggaggtttccctttgagtcagagaatgtagtggataaaaaggacatgaatagctggggggatttcctgaggccattgtagaccagctcacacactgttaagaggctcattttcatgagacttttggttgcatttgtaacacttgctctaggtcccctagagcattgagtgccacatcacagcactacaataacaggactaaatgcaagaaggtacattacaaggttctttttctttcagctctgaatatccaggagtttgtagatgttctcaagactttttttccccttcgtttttccttctcccccaacccccacacactcccttcaaatagaactaagtggaaaggactgttttgtttttaggtaaaaacctaaattcttgtacttaaaaaaaaaaaagccagttgtaaaatctgtaatataattaattatttccataggtaagagatattttattttttataaaacctggtctgactggtaagtttgttctagattaaggatttagctacagtttggtgagtgtttgttctctgttaggcttggtgcatattaattcgtacatattttaacatttcactactgtattaaattattaataatttgaaatcattagcttgtactgacaccatttttctgaaacagtaccacctgtttcttctaagtttggtccagaacaaaagtctgaaatctaatttgtcaagaaaacaaatgtgtagttcagaaaaaggataggggccaggtgcggtggctcatgcctgtaatcccagcactttgggaggccgaggcgggtggatcacctgaggtcaggaattcaagaccagcctggccaatatgatgaaaccccgtttctactaaaaatacaaaaattagccaggcatggtggcacacgcctgtaatcccagctactcaggagtctgaggcaggagaatcgcttgaacccaggagccggaggttgcagtgagccgagatcgcaccattgcactccagcctgagtgacagagtgagattctgtcttaaaaaaaaaaaagaaagaaagaaaagaaagggataggaatcaccaaaagaaggaggtccaaagtccaatgttaggatgattatgctcatgacacggccatttaatctttaaaacaaatataaaagacaggtattccctgtggcagagctgagctttacctcaggtctgtgtgacagagtctcatctcttctcttatacatcctcaatcttcagacatttaaggtctctgagtatccaggatttcctttgcgacaataattaacaaatacatgtatgtacatttgtgtgtgtgcattatgttttaagcatatatatatatatgcaggaaactcacatctggagtaccagagtctacaggccaggactagatacttagatctctagggaagtgatccaaatatctagttgcagctatgtagatttcaagaatgcagtgaggggagaaagagtatacttaatatatgagtacatatacactatatatatcccatatatgtatgacatatgtaactaataatagtcaaccctcactaacacaatgtgcctaatattattgtaagcacttcacaccccgttactttgttctcataacatctaaggtaggcatcattattattatcatctagttttacagatgagacaagcaaggcacacaactaataagtggcacagtccaagttcctatctgtgatcctgtctttttcatggaccttttcctatctgttgcctccatgagaacatatctgaactttggcctattcttttttaagactttgctccctcttaggagataacaagtagcagaactcacatgttacccagccaatagtgtacttagcttgggaacaaaagactaaatttgtggaaattcctcacatttgtacaagagaacgtcccaaagcaagatactatggcctggaaaatggaagagatagtttgggcaggtggatgttttgggtctcccaaatcacaacacatgtgcaatgcgcaaccatcaatacataaatccaatttaattcagtatatatttaataagcacctgctgtgagcaagggactctgctaggacctaagctctagaaagtagctacaaagattagaagcaataatcctaatatttagaacatgggagaaaagaaataccacataactaaaacacgatgcaaataagttaataccgtaaagcgttgctaaaaaaaatctgtaggtttcagtgacttgaggaatatcatttgctattcagcggtggacactgacaaagttacctgaagcaggcagtgtttgagatggactttggaatgtgggaaaattccaacaattagaaattggagagataggttttaggcaagggaaacagaaagagtcaaagcaagggataggaaagcacaaactgtgtctggggtcaatttgactagcttctagactactcaaaggatagcagtaggagtttgagatgttgtgggtgaaacatgtggaaatgtccattgagcagcaggaaacccacatgtgcagtaccagagtctacaggccaggactagatacttagatctctagggaagtgctccaaacatctagttgaagctatgtggatttcatgaaactgtccacagatttcaagaatgcagtgaggagagaaagacagacaaacttacattttgtgggcagataaagggaggatggatgaaagatcattcagatgaacaggagaaccataaaaacagacgctatagagtgtaaaggtgaagaatgcttcaaatgcttcaagaattagagatagatagtcaaaacaatcaaatcataaacaggatacctaggattgctgtgaggaagaggtatatttaagagctagagtcttcatcactgtactcatctttgaaaggaccacctcttattgctttctaccctttccctaaactcaagcatgcatacaatcacacacataaacaaacattattttttcctaggaaaaatgttggcattattaactctgaagcaaaactatatctggaagtttttagagtagttagcaagatccaaactttatggtttgattttaattcaaaagataactgaatttttatatgcaggttaattattccttggtgggaatgtgaatttatttgtattttattcaggaagtatttttgagcatttcctaactccaaggtattgtgctaaacgctgggatcagaaaaatttccataaatgcttggatggcttttacctgggagcactccttcctatggttggcaaaaagctgacgcctttgtgatgatgagtttcagtcctagcctctaagagtttttgtggtcatgttattaagtgcaatgtttatgtgtattttttctgttccaagattttttttaaagttttgaatatttttttatgtcaccaaaaggtgctttagaagaacaaactaactcaaagccaacacagaaactggttctcttgctttgccaaagtggcagtgtagcatgtgggcaagtaagaatacttttctcaagtatttaaaacaactacagaaatcttattcttcattgtattctctaaagaataaaggtaagaaggaaaatcaggttttgatagagaattaaaaaatagctttagcatatgttcaaaccattaggtcaaaagggactaacaaagccctgtagaaggggacccacaaaagctgcccttgggacttacttattcacttatttgtttatattttttgtatatgtacatatttttctgatactgctttgacacatcactttagctctttttctatatgtatgaatattcttctcctacaacataggaatcttgatgtatacatagtttagtaatctgcattcattctttcaagataaacatttttaatcctacatggtattctattctaaggatataccagcataaaatacaatttaaacaatcacctatttttggacattttggttgcattctgacttttattcttttcaataattctttgtccagtatcattgggcatagtctttgcaatgctattatttaatgaaaagaaaattttggaaactttaacaggtaataccacaagcgaggaaacttaatacaacgaccacaagcaatgaaagaaaagtcaaatgcctcaaggagccagggtggaagagcaaatgagtgaagtaggtgtggcataaaatatggggtgatagggactttgtcaaactggagagaacatggtttgtctgaagtgagcagctgctactcagttccagatattggtgccacatgtggatgcagatctaatgttgtcagatctccaatttttcaagagaagcaaaaaaaaaaaaaaaaaaaaaaaaatctagtttttttttggtgtgaaatctctttaaccttaaaggttggctcaaattattttaaatattctgtggaccaaacatacattttaaaaaattctatctgctagctagatgcagctcataggccactgatttgtaactttctaattaaagaaagggcaagacggtgtttggaaatatatttctaggtagagagttaagcaaataaagttttacttcaagttttcctagtcacaaggaatgtaatgtggagagactgaacctcaatgtgcaaatcttgaaagatgggtaaatactgctccccacttaacacccatgaagaatttaatagaagaggggtctaaaatgcttttaatttcacaaagaaacatgctttaatgatataaaactctaacccagtgcactgtatgatgatatctaatgataatttcccttcatttcccatctgaacaaacatttcccattaacatccacctgcactacttcctttcataaagaggaggtggtatttggctatgttctggttctgattcatgagaaatcagcccaagcccaacatttctgttcttaacagattttggtttttaaatctgtagaacacaatgtttccctgggctgagttctagcatgccaagttttggctggccacagactttgacatctgagtgaaaaatctttcaacaatggcatttaaactgaagaatcaacagacctttaattataacactgcttgtaattccctccctctcttatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctcaagatttagattaaaaacaatatttccacttggaaattaagcattaaagatatagaaaaagggagtctctttttagtgagatttcactaaatacctctggtatctctccataaaatgttaggtgatcatttcttaacagctttttaaaaatgacacagtctcagattaccctatgtttcccttatataataacaaaagacacttttatactactaaagtacattaggaatcctttgaaagtttctgttttagaaactgatgttgaaaaagtacttaatttatatttaacctgcctatctgaatatacttagtggaaaaattagggttaaaaatgtaaatgtggaaaatgtttatttccatgttttatagtagttagttttttatttgcttttaaatatagatcttggttatatgtggaagacaggcataatttcagctcctttttcatcttgaagagaaacctggctctcaatttccaggaaatatatttatttagacctaacaatataccagaattttatgcattatttctaatcttcataataagtctacaagttgggtgtcattaatctgttactgataaggaaattgaaactcaaataaatttaatgcttttaccaaggtgatttagttagtgtctttttgtccatggattttaagtggtagaatttgcatgcaaacccagatatgactccaacggctctgctttctcctttagaagaaaaaaactccttcctgaaatactaacatcttttctttgtgtaattgaccatcctttcttaatacaattggttatcagagctatcatattcttaattatcagtattaccttacgactctaaaattcatctttgtccagtgtatagaattcacatcctaaggttagatataggagattaagtctctgatctcctggagcagacctggtttcaaatcttgtcttttattatccccataaatatgcatgtatttataaaattatgtcctaagtctttgttcagaaaatatgtagtgtctgacattattttgtgtataaaatgctgaaaaggtcacatccaggaaactagtcctgaccagcatacaacactcaagaaaggttctccaaggtagaatcaggggagaatcccaattgaagttgttgaggggagtaaagataataaataatattaacaataataactccatgcattgaactcttaatattcttcatcctatctatatatcatatttaatttttacactactcccattttgcgtgtgagaaaacagaggcttagagatggtaaataactagttcaaggtcacatgactagtggcattttactccagagctttgctttttgtactttgctaaactctctcccagaatatgggaacaaaatctaaagaggtaaattcaaagatcaatattaagatgataaatacaagatgcagccaggaatcaggaattggagtgggaacagatgaggaaacaaggtggtgggtccagcagggttgcatggttgaagtcagcaaatgtctgatatatgggggtgtcatgtcacattgaaagtacagctacatcagggaggtggagcgactgagagaatatgtagagggtgacagatataggactgcttggctgatttcatgtttttcctttacaaatgtaaataaaacattgtgtgttggaggtcagagggcaaaggagatataactgaggactctactcaaaaaaacatctcgcttcatgtgtcattaactgaacaggggaaagaaactcagttgtctaacaagatatttttaaaatatttatttctccaagagggttaaacctcatttacaccttggagtaaattactttaataaggttaccagatcacctaactgaatgtaactaaagtcaagaagctgcagtttgaatggggaaaggaaatggataactgtggaactgaagggtgggagaaggggatgatagtgacacaagcaaggataaaaaggatttccttaggcgaataggagggcaccaaagataattttatgaaaagacagttcagggctaaataaatgtaaagtactaacatcatcattatcactagttctactctgcacttatgtctagaatttttgtagtagccagtgtacagacaaaatcactaaaattggttgctaatttctgatttacaagctgagcagaattccctacttagagtaactcctcaaaacatacttgttgagcaaaatgggacgtcaaaattttgcctggaagttggaaactttcagattttccaaattccaacctgtttttacagtctaggttaatccagtctaacctatcaagttcatctaactgggtcctccctgggaaaaaggaagaaagaggacataggaagtgaataaagaattgatacctcagctgggcgcgcagtggctcatgcctttaatctcagcactttgggaggccaaggcgggcacatcacctgaggtcaggtgttcaagatcagcctgaccaacttggtgaaaccccgtctttactaaatataaaacttagccgggcgtggtggtgcaggcctgtaatcctagctgcttcggaggctgaggcaggagaattgcttgaacctgggaggtggaggttgcagtgagccgagattgtgccattgcactccagcctggacaacaagagcgaaactccatctcagaagaaaaaaaaaaaagatacctcactgctctccttcccttctgtgtggcccaatacagcatgctgttgaccctggggaagcttcagaatgtatgatctaggaaagctgaggcaatgctgtaataacaagagctatgtgaaaggtaaagtatgaaatgtatgatggaaaccaaaccaaagagggtatgttaaagataagcccattaaggaaatagctcacctgttggactggaatctcaactggctcttttatttcacgctaaacctgtgctgagtctgcacagaaggacttctgaaatgcttatatatacaacctgacaggtacaatcagaaacagtacaaggactgcgtgcctcaacaagaatagccagagcactgaaatcaattgcagagcacagacatacttcaactgtggctatgcagacagtccccaggtatggctggtgaacagcacgctttatgtgtgctatgtcccagacttcctggctttcttcccttccgtcctaccccttcggcacacactacatatctttcacattttataaaatcacaggagatttccaaattattgtgtctttcaaatactttaaaaatatattgtcctcctaatataaaggagagaggtggagtatttagctgatgaactgaatttgaaagtaagtttgcatttttgatatatttccttccttatgagtgagtcatgaaaaatgcatattttgtctaaatattgataaagctttagaatataagagctggagtgaacctaagaggttttgtagcccggcaatttccaacccaggatgtgtctcagaatcacatagagaggtttcagattcccagccaggcacagtggaatgtggctgtagtcctggtgactgggaaggctgaggcaggaggatcactggacccccagagtttgaggccagcctggggcaacatggtgagacccctgtctctaaaaaataaaaagtaagtagaaaatacaaatcacagattcctgggccttttccttcccctgccttccccaagtgattctaattctatgtcagttttggctgcttgcaaccagttatggagaccagggatcttgatcaatctcttcatctatctgatgaggaatctgagacccagagaagtaagaggtacagtgatttctctaaggttacacagtgtatgagtccatttgcacactgctgataaatacatacccaagattgggaagaaaaagaggtttaatggactcacagttccatgtggctggagaggcctcacaatcatggcagaaggcaaggaggagcaagtcacatcttacatggtggcagagaagagagagcttatgcagggaaactccccttttcaaaaccatcagatctcttgagacttattcactatcatgagaatagcacaggaaagacaagccccctgattcaattacctccctctgggtctctcccacatgtgggaattgtgggagatacaattcaagaggaggtttgggtgggggtacagccaaaccatatcccacaggaatatgttacaagtgaagatagtctatggacactgtaaaattgaccccattagctatatcccaaactagttcattattttagaatctattttgtgtgtttgcatgcatacagcaatgcttcacatatctgcacaccacttatgtggcattccaaatatggttaagaacaaacaaagtgaaaaagacctgcaagcagccaaaattggtactaaataaaccacacataatcctccaagtctttttaaaagcctcttctcttgcttctctatctagtgaggcataggtgactcaaaatctttatctccaagcccggcccttctgctgcactatagtgtcgtgtctccaaaagcctagtggaccactcacagatacccagtcggcaccttcactcagtgtgttcaaaattaaacgtgtgctttcccctcccaacccttctcctgctttgctgctctgtttatgactctactaaggttcaaaatcatagagatgtgtttggtgtcttcctctcccttgctccccaaatataatggattaattctcccgccacatttcataaatcagtttgccatctctgttcattccctctgcccctgccctagttagtgccttcattgcctttcacctggactattgtaatagtctcctgcctgatcttgtgtcctctggtctctccctactccaatccattttactcactgttgccagattaatcttcctgaggcacagctctgattatgttactctcctactaaaaactttcaatagctccccactgtctcctgaataaagtccaaattccttgccctaataatcaagtcctttcactttctggtcccaatatacttttaccgctttatttcccactacttatcttcacacattccatgctcaagttaaactcaattacttctttgcagaatctttaccctttgattcttccatgcttttctcatgatagagtaatgttctttccttctatctctgtatgctcaaatcctgcttgtttttcaaagcccaaatccagtgtcatcttttctgatgaagccctcagttagccctcctctgagctccaagaataccttatctgtactacttttatagagcatttcacttttcactattaattctagcaaagtagacacatgtctcagctccgttgctagattaaaacttctagggcaagacatgtcttatctgtgtatcctctccagtgccaagtatacaagtgcacgactcacaatatttgtcaagtgaatgagttcatgtatgtactttacacacaatcaaaacatgtttttttgttttattgtctaaagaagattagaaataatgcatcagagaaggaatgaggatcttagagacttgcacaacagaaagtaacttaatagctaaagaagaaaaataaaaactacgaaaagaaggcatgagaactaaagatatagcagtcagagggtaaagaaacacagaagcaaataatcttatagaataaggaccaaatggttaattgagaagcttggaaaccataaaataacattcaaatatgtagcattatttttatacttccacaccctcatcaatagaaacaaatttgaattgtagttcaagataacaaccctgaatcatttagaaaagtttgaattatggtaagtatattcttttttttgagatggagtcttactctgtgaggctaggtaaataagctgcctttattaatgaagaaattcatatttttctgaatattagagaaatattaatttttcccaattaagatatgttcatgatatacaatttagaaaatataggagagtaataaaaaatcttaaaaatcctaaaaaaggtgggattataccatatgtattactatgtatgctgccttttaacttaatatatagtataaatagttcatactattataggttcttcataaacatttactggctcaaaattctatctaatagatatgtcgtactatacttaacacagcactctagagttgaacatctagcttatttccagttttataatacaaatatgtctaacaagatttaccatgggctgacaactgttgaagcagagtgaggaactcatgagagttcactatgatattcttcctacttttgtatatgtttgaaatatctagaacaaaaaggtaaaaaagcatatttatgtcttaattcatttgtgttgctgtaacagaatattataaactggctaatttaaaaagaaaaaatatatttctcacagttctggaggttgggatgtctagtatgaaggtactggcatctggtgagggccttcttgctagatcatcccatggtggaaggcagagggcaagagagcacaaaagccagagagcaagaaggagccaaactcacttctataatgaacccactctcatgataactaatgcacacactcctgcagtggtggcattcattcattcatgaaggcagagccctcatgactgaatcacctcttattaggccccaccttccaacactgttgcatcagagattaagtgtccaacacaagaacttttggagacacagtcaagccacagccatatgataaatatcttgtgcataatggcttttgtttacttgtaattattttcttaggttgcagtttagggctagactgcctggatcaaagtcttaccccatcattacctagttatctaaccttgggcaagctgctgatgctttctcagcttcagttttctcatttgaaaaatgggtataatggtaacttataggggctgttctaaggatcataagagaagatgtgcttctaatcccttccacagtacctagaacactgttagtgtgcaataaatgtcacctttgaaaaagcaaaatactggttgcataattatgcgttgtgcttataaagaaacatcacatataaactgaaaaacatacctgaaataacatgcttaagtgtgcaccatttctatctccaggctaaatgcttatttcaaagatacgaccactgctaaaataatttagatccataattaccattacgaagcattttctatgtggttgatattggccttactgggctacatgtttgatgtgtactatctcatttaatcatcataagagttttctgattactttatagataaagaaactgatgcttaaaggtgaattaatgtgcccaaaaggacacagggtctgttttcaaacacaggattgaacctctggaattcatctctaagctactgaaaatgacctttgttccctgcactttttttttttttttttttttttgagatggagtttcgctcttgttgcccaggctggagttcaatggcacgatctcagctcaccgcaacctctgcctcctcggttcaagcgattctcctgcctcagcctcccgagtatctgggattacaggcgcccaacaccacgcctggctaattttgtatttttagtagagacggggtttttccatgttggtcatgctgggcttgaactcctgacctcaggtgatccgcctgcctcagccttccaaagtgctggcattacaggcatgagccaccgcgcccggtccgtaccctgcactcttttgcatagacttcagtctttctttctttcttttcttttttcttttctctctctcttcttccttccttccttttttctttctttctttctttcttctttccttctttctttctttctctgtctctctctctctctctctccctcccaccctccctctctctctctctctctctttctttcttttttttgaggcagagtttcattcttgttgcccaggctgcagtgcaatggcgcgatcttggctcaccgcaacccctgcctcctgggttcatgagttctcctgagtagctgggattacaggcatgcgccaccacggctggctaattttgtattcttagtagagacagagtttctccatgttggtcaggctggtctcgaactcctgacctcaggtgatccgcctgcctcggcctcccaaagtgctgggattacaggcgtgagccaccacacccagcctagacttcagtgtttctaatctttattcctcagaggcagatatgaattttggacaaagttttggtccaattttggatgtttaactggacctttgggtaaagtacctttctccttcccattcactttaatcagaattatttatttaacaaattttattctagcaaacaattttagagaagaaaaagtagtactccataacaagctgctcttaaaaatgcatatctcattctggaaaaactaatagctatcatggttttaaacaataattttccattggtttgattatcttatgtccactgtgaaacaacagttcattattaaacaattcattatcaaacacacaaacacatatacacatttaataactttaaaacagtccatatttacatattttactttaaatatgtaatctgaaatgtgtatgcatatgtgtatgtgtgagagtaagacatagaccccggaagtctgaatttggaaaaaccctgtgaaagtctgaaaaaggtggttttctacaaaccttatgaaaaattaagtcatagaaggtcacaattttaaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacataatttgttttgttttgaaaaactgctcagcaaatgcatacaggtcataatggcaggtaacagaccatttattgaagtgctgaaacaaatagaaaacaaagtccaggacaccatcacagagcagtacttcccttgtgagatactctcagctaagtaagaattgagtgagacaacaataaaacaaatacccataggcttttcaaacagtaacaacccgctcagggttagcagcatttctagaccttgatggtacaatgatgttctcaacctttgctttcagacactggatcactgcttaagtagcctttatcttttccccctaatttttgttgaagatgcccttgaaattagattatatttgttcctaacaaagcatatgtatattgtggcatcactcttaaaaccaacaattgggcttagttttatgaagaaaaaaaatccaccaacctttcatgctgagatttctcatgctagttctcagcacagaagtgattttttttttttaagttgcataaagcctagcaaggtttaagttttcccagcaaggagaaagtgtttttcagctgttaaatttttcagatgctttttttgaatttggataaaactcaaaaacatgtttgttttaaaatgtaaaccttttcatgtacagaggtttgcatatagagaaatgctattactatgtttaaagatacttgcttttgaaataaggaggtcacatgcatttaaaaataacaaactgcatgttgctttatgaatgtcctattaagccctaacgtaaatatgatgttctggaggagcactgatgcacacgtttgctgataggatcacttacaacactgcttgtggatgtatttccatgtgagagcaaagggtggtcaggtttgaactgaagaacatccatatagtcagctaatatgctttttaaagaccttttacctcagttgcaacacacttctttgtcctaaacctgctggattactcaacttgttggctggactaaagctgacacaatacatatttcaagcacaaaaatgatgaggaacacatagggatgtcagcaaagaggcaaagaggatggtaagtcatcggaaggctggtcatttttttttttttaaacagttcaatgtctttactgttttctgtaatattatcattttccatttttcaaacaatggaaagaacaacaattagtttcatttttaaaattattagatcataaaggacaagtttaggaatattgtttctagcatactaatagatgaagttagttgtaaatcaatagtcttatttctctgttttaaaaaaatagcaaaatacagtattctgaggaaagttctgacagattggagtgttacaggatagtctgaaatctgtttcattatagaagtttggccaatatagagataatatattttaaatggcttaagtatatattttttgtggattgcacattctgtaagacggtttgagtgccttgagatccaagtctttaggtcaagactgaactctagaaatggccccatcgaatctacaaaaggatacattaaaaaaaaaaaaaacctcatttcctgtaagctgctgatgctactcaacagagttgaaactcaggtcacacgcatcctactactctagtgctgccccatttactaatccaaacgaggataaaccctgagagatccgttatgtttctacataaggagtgtacaagcttctcttgaaaatcattgcattgggagagacacagagaaataacagaggtgagaatccctccccgatttgcttgctaaatccgtattcattcctgaagatccagatcaaataccacctgactgttaggccttctctgagaaactctattttgcaggcaagtattggaacgactctatgcgcatctccagtcccaatgcatcctttaaataatctgtttcctctctgtttcttgctgcattacagacatctgtgttacacatccatccttccctaatagtcagtggactcttttaggtgaaggactgtgtctctatgtccctatgctgaaaggacaatgggaagagatggtgctattgatgcccagaggcctgggtcaccagggaagctggagtcacagcaggtttgttcagagggagtaaaccacaaaggaaatgtggctggtgatgatgatgatgcaaagaacggtgggggaaatctctggcctatgccttctactgaccctcttgccactcacaagtgtctcacaagcaccaaatccaacttggaatctagctgacatgggtcagccactgttgtagagcaagggtagggtgagggttgggtctgagggtaaacacatccacaatgtgggagcaggaagatgtctttgcaggggggtgtctaggactatggacttaagataacctcacagggtcaccatgccccagcatgacccagaagggcccagagcaaggaagacatgacaaaggagcctgaagacttgaggaggccttggagctgggacaaggaagacacatcagggatctacatggacaggaaactaaagatgaggtgggctctcagacatctcagggaatttgagctcagaagacaacactgagaagaccagacaccatagtgagtagactgtatctaactgctctccaccctcactttcatattgcatttggatggcactccaaggaaggggagaggagaccacctagcagaatggaggccaaatctgagttacctcatagataaggaaagaaggcctgtgatttttaatgggtcagtcactcttaaattttaagcaaactgtagattttctgaataggagaagatattatcttaatctacacaaattttttgttgtttttttggcagggtttaaaatatttttattcatgacttatagtagaaactacattttatattgtgacccagtaactgtttacacacatacatggatgtatgtgtgtgttctggaggtagaaagtaaccaatctgctcaaattttaaatattaagattattcataattctttaagtagtttattgtttggaaagttatagaccaaggtctagaaattcagcagacctctaacctctaatcaaggacttttaaaaattaagaacagtacctgattttctgatttagtctttgaaatgccagtgctattcattctttgccttattcactcataattatttattcattctccaaacatttattgagagcttactgtatgctttatactatagacctgcagcacaaatataggcctattacttcacagctgctttaggatttatagcagtactggtcagatagttcttaaaaaggaaaagttttcagagtgcaacaacctgttcacaataattcctatgtagcagtgaagagccttgacagcatctcttttactttctcattgtggttctagtttaataacataagtctatttttacttttcatatttaactttaattaaacatgctatgagtgcaatcatgagattttaataaattagactatttgaaaataattttcccataatgatgtcttcctcatatctttcatgatacacaaaaagaatatttgtacaaatattttgttgcttcaaatatgcagaaaactgaccattatttacagtgattttgaaaataaatgagtgaaagcatgcgaacttataaggagagtaaataagcagcacaccattaccatctgagacagcatggctgctcccctcttggtgagggcagtataggtacagcaagcagaagacagatcataagtatttactatcagaccttctttaagtgaatatgtcctattccagtagaaagtatcatataagcatacggcctgaatccaattcaattatttacatggctctaccagtaaatggttaacactgtagaccagaaatttagaaaatgcagaagactgaacgatatgtaagtgactgagaacatgagtctctctcctcatcatgtaggacatgggtcgaggtcatagacttaattggtaggagttgctactttcgaagagtgaaatgctttgaggcttttaagagaattttaagttgattaactttttatttgggggaattatgatgtgagctttattaaaatatcacaattcggcattgtttcataaacataattataggccaccttttcaaaaattgcaagagtagtactaagaaggtcctttgaactaaggttcaaaggaccttcttagtaactcttgtaatttttatgggtacagttagttgtctgcataaagtcattccattttccaaagctgcttactctttgcacaaatgacaaattggcacatgcacaatggcacaggaaaagaagtaactgctaaggtcacatatgtgaggacgttgcagcctttaagtactggaggccaaagttaccagaaacatgggcagacagattaaaattttcccttcttatgtttgtgcattgtttctatatggaaaattacatttttctgagagtatatgtgtaaatatgcatctgctagtgttttggcaactctaagttacctaaattagttttgatcaacactgtcggatttttaaacccaccaacgtaataaaagcaagtttaaaaaaacacaaacaaaccctacagtacattgtgtgctctgctgttccaagcctcagcttcaagacaaaaggagagcgagactttgtcattcgctagctgttaataatcaagagaagatctgccagacaagctcttcgagggctctgtctgtctggaccaggtatatactgcaatacacaaagggctttgcagggggagaaaaatgagtgttcatggacaatgatgcagctttcttaattaagattttcattactgatacatacattaagttctgcaactgcaagagccaaagcactgtcatgtgcaggtagatgtccctgattccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccctggaccacagacaaaggtaacagtagctgatctagaagtaatccccatataataatataatagctcaggtcttaaaaggaactttgatcttttaaatttgccaatgccgattgttgagacaggaaataaaggattgatttggtagcttttggaagatggtaaggactcctgcatacagccagtcctgactctgcccctcctgggtcactcagtctattttccctggatccgcatgctggtctgaaagtcaatgcagtctgccaaagtggtatactgttcccatgaaataatccaactgtggtatggagaaatctttttttcttagaccaagttatttttacaaaaatacttttgcgaagaaatgagaggaaactaaaaccctacacaatcctagaagtggattactgtctagagtgcatgttttttattccatcttataaagcctaactcattttagggtggctagtgcagttaaggtgcagacatctcttggttgtttttctggtgcttttacttgcatgctttcctgtttccaaatctgcatccatattgggggttacccacagagagctgttgtctcctctctgaagaacatctccatcttttggtcactacttgagtagagatgagtgatgcttaatgaaatatcattttattacaacggtcaaaaattatggattcatttcttattagattatatgctctgaatgttcaccaccccccaattcacatgttgaaacttaattgcccatgtgatagtattaagaggtggagtctttaggaagtgattaaatcatgaaggcagagccctcatgaatggatttgtgcccttatataaaaggtgtgaaggagctgtctctctcccttttcctcttccaccctttgccatatgaagatacagcaagaggtgcgatcttggaagcagagaggacttcaccagataccaaatttgcaggtgcctcaatcttgaatttcctagtctctgtaactatgaaaaataagtttctgttgtttataaattacccagtctcaggtattttgttatagcagcaaaaatggactaacacattaggtacaagcatttatttgacatttaaatgtaatccctcattttctaagaaggaataagccagaatccaacatcaaaatgtttcaaaaggaatacttcaaagtgttttagctgtagttctttgtcgattaaataaaaaaaaattccaaataatggtggtcagtaagagtgtgtgtgtgtgtgtgtggggggggggggcggtgtatgaattcctgtgctaagattcagatctttgaaactgttttctagaatgttatcctacatgtctaaaactttttttctaagtgtatcagagatttgggatggagtggtaaacacataggttactaggaggtggcttgcctctgtacccattctagatgagtaatgttaatgactgatgataatgtaatgatgaaaaaattggttctttttaagtaaatagatagtctacagacaccctgtcaacagatagtgcatgcttactgaggaagttaacagtgttaggattcttcctaacctttactgaaaggtactgttataaaactggtagaggagtatgtgaaagctactggtgaagaaccaatgcagtgaagattattcaagcatggtggtgatggataaaagcatagaaaaaaaactcagaaaattattttgactgaagacttttcattacttttcttatgtgtccttgagtagcttataaggactaggctgaaggctactattaaaagatttaggtgtacctttcactcatgttctttcatgagacacacggttctctcattcaaagtacaaggttaattttaaattagaggtgagaattattcttcatgtatcaaaaagcctagaaatttaccagggattaaaggtagaacccattttagcctatcgaagtgtgagaggtaaggtgacctgtttagatgaatatcttgaaatgattctctggagcatgcctgatctgttctcaatacccacacattagaagaaatgaagaataatatagagactacacaaagagaccatgtaaaagaagaaccctgataaaagaaaaaaaactcttaattttatcactgcaaagacttcttgtacaagatgcctctgcaagtgtcctagtagcatgactccttaaacaagtaggatgcgtgtatgtggaagatatatatatgtatatataacatttaaaatctccctcgaaccccagcttctgagtataaactatgttacagaagcatgtggataatatgtgaagctttctaggagcatcattaagaaaatgagacatttgacactctgagccctaggtacactgagtcagtggcatggtctccaagggcactgctggcagcactaaagcctggctcataaccatatgtgcacacctcaagaggtgtttgactgttcaggtagaggataagccatttcctaggcctggttccttccattctccttagcttgtagttggcctgaagggacttcctagactctaacatgtttgcctctcttttgcttcctttctggacactgtctaaggatttaaaacacacatgactttcatgtccacaattttctgccaaagagggggaaaaatgccccagagcatgtcatcccttaccatctgcaaatgaacttctgtggtcaaggaatgctccaattaccacccagaacagctttgtacaactcctgaccctcgggaagactcgaggaactcactcccagaacccagatgctccctgtcccagaacacagggaagacgccctgtcatcacagtttgcacggcagaggcggaggtgatgctgttagtgtggtatttccaattctctagcgtctttcactttccctgaagttgctgaagaatattccatttcattaagtatgtagtaatacacatgggaatcagagagcggggaaagatggaggacgttgatgacatggcctctagcactttatttatgagaacatccagaaatctctatctacatctgggagaagaataatgtcaatcctgccctggagacatggatcaggcaatgttgccagtgtgtatttttcccttcccaataatttactgattctggagtctaaggcagagcgctgatgataatttttacattcatgtgagtgagcctggccctttgagggctggtgatgccaaataaacataaatgtatgtaaccaggtgaatacttaccacctcccaacccagaaatgtcataggtctctggtggtgctttgcttcccacaacactcccctgaagggcggtgagggtaggtgttgccatcagagcataagaagcagagcttgaggtggccttggaggacttcagggagcactgcctttgcagtaaagaatgagactaagcaaacaaacctgttagacggctcatttgtcttttccaatttttttattgtgttattcatcctttcatcattgatttatagctattcttaaaatattagggatatatcacaaatatttttcctagtttaaaaaatgattttctaccatagtaatttttattttcatgtaataaaatttaaaatacatgtattttttaaaaagttttcaggctttggttttatgcctggaaaatgcatctcatacctccagtatgaaaatattcatgtatatggcaaaaattatcactgaaaattacagaattagtgaggatgcagagaaatgggcagtctctttttttgttggtgaagatattaaccaatgctagaggacagtttagtaatgcattttacttttgcagttccactataattaattgatcctaaggaaataatcatgtaagtgtacaaacatgtgtacatatgcatgtgcatataaagacagttattgtggcattgtttagtaagaagaaagttccaaattcccaactgtccatcaataagtgattgagtcaataaattatgcatatactgaagtgcaacgttgttgtcaaaagataatgtagatctatatttattaacatggtaaatgactattacaatgttaagtgaaaagaatagaatacaaaacagcaagtaacttctcctttcagtctggaaagagaaagacaaagagaaagaaaaagagaaagataaacaggactgtatggaaatataatatttcctaagttattaatagtgattatctctgggctgtgagatttcaaaggaatttaaccttgctctttataaatactatcaatgaaacaaattcaagcaaaactaaatgtatacttttttagaattaaaaattagaacttttattttgggggaaaaagaacttacctaaaacctgcaataaatacttaaaaattccaatatgatcttcagtcattagcaattactaactagctctcttagtagggtgacatcaatgtctgcctcaagtttcccccaagtttgacactttgagatgtacatcatagttcttcccttaaagaattttaaaatataaaatttcaagtagtgaatataacccaaatatttttatctagggcatggttaggtaaattctgggggctttatgtgatattattcagatgttatagtgctatttataaagagtttttaattataccaggaagtatttattatataatattgaattaaaatgggatacaactgtatacatgcaatgtatgctcaggcatgttaaaatctagagaagacactagaaggtgatctaaaaaattattaataatagttggttctgtgtagtggaattatggatgtttcccctttactctatactttctaaatatttcacaataagtgtgaattatagaatcataaaaaaagtaaatattaaaaaaaagctgttttgctcgacagctgccaaattttaccccagatgtatcagcaatttagcttttagtcaaatgaccctaacatcatttcctaaagggaatatcacagaatggaatgtgcccaaataaagataagccatcacggccaccacctctttctaagctatcattttataatgcttaaaataaatctgagtaagggatctttcttctgttggaagttataaacttccacctccttcagaccctctccatatcttctcttgcattaccagcacctggaatttataattaacctatagtaccctggtacgtttctaggtctggaagctgtttttggaggctgatggtgtagatcaccattagggatggaggattatttattcattttaaatgggagttcccttgaataacaaacagggatgagctgctatataagatcttgtgtagttaatatgctttcttacccttcttatatatatatttattgattgattgattttttgagatggagtctcacactgtcgcctgagctggtgtgcagtggtgcgatctcggcttgctgcaatccctgcctcctgggttcaagagattctcctgcctcatcctcccgagtagctaggattacaagcacccgccactatgcccggctaattttttgtatttttagtagagatggagtttcactgtgttggccaggctggtctcgaactcttgacctcgtgatctgcctgcctcggcctcccaaagtgttgggattacaggcgtgagatcccgtgcccggcccgcttccttcctcttctttccatccctcccttctttcttcccttgttccctctctcacctgtctacactcctgtctccagccctcttaaataaatagcttttctgtagtgttagatgccagctcttaacatttagagacaattcacactataccaataccatacttcaagtagatgatctaattgtttctaaatcatcatattttagcaaaaagataatgggagaaatcaaagttgtctctcacatatgtatgatgcatactagaggcttggcaataaggcagagagtagatattttttgagaaagtaaataacaaaacaaaacaaaaagccaaaacacaaaaacaaactgggtattgtgaggacagggcagagggaaggagcaggcataagaaagaaaaggaatgacatcggtctcctggtccttgcaaaggttattcaagtccctgttcctggtgttttggaccagatatcagcctacaaaccaccctggactgtgagctatttgaaggcatagatggtgtcttactcacctctgtattttctgtaccaaacacagtgcctgatacaatatactcaacagatgcctggagaatttaactaagccctttcactgccctttcttactggcctcagctagaaccaaaacaagaagctaaaactcctaatgccacaaatgctaggtgaaaccctatcctaattcaaactcatttcttctgattttgcaccttggtccccaaactgctggagaaaatcccatgacagagcagataggtatcaacatcaacccaccagactcacctgcaccttccacactgccaaggagagtcctactgtatttctctggtcaacttgctgtcccatttgtctcaagaacgatttcaaatctctactttccttaaatctcttccccgcttattcttagcaggaccttgcccctcagtgcccatcacttgggaaacctcttaacctttcagtaccaaatctacacgtgggcttgcatctgctcctttcctttactcctcctttcttacaaaaatagaagatgtgtccctccttccatctctccacttgtactcaggattccatctctctggccttatcagtaatcttatactgccagtcatcctatgctcttctctcttctgcacattggatctctcctctctacggtattcttcccatgaaaatacaaaaaatactagtgtttccatgcttttccaaccttcttttgacctcacttcccccctcaagatattgcagtagctcattttcctttccttcatagcaaaacttctgagtggcccacatttgctgtttcttcacttctcattctctcctcatcccattacaaacacgttattgttttgaccacttcaacaaaacagcttttgctgaggtcaacaataagctcaaaattaatataagcaatatatatttgttagtctttaacctacttgattgctcagtaacatgtcacatcactgaccactacctttgaggcactctcttggcttctgtgcctatgttttctgattttcctgccaccttcttggtggctccttctgagggtattttatggcctcatttttttctaccagcggattaaatattaagagctcttcaagtctcagtttaggtcttcttctcaatctaaccctgtccctaggcaatgttattcatgccaacagattcatttaccactatatgtcgattaccctgaattcatgtctccagccttcatgttacttctgaattccagttttatgtatataaatacctgtgcaatatgctcactatgtatctatccaaagtacctcacactcaacatctcaaaaacagaacttacaaacttctctccactccagtcctcctttggtgtttcatgtaactgtgaatggtattatccttcatatagtttgataagccccaaaccaggagtcattgttgccacttctctcttttatttcacataaccaaccatgaaaaagtccaggaatattttacttctgaattatctctcagttccatcaatttcctcccatttccactgtcaatactctagtctgcctcttatgtggtctactggaatagctccctcactggtttcctcatatccatttttgatccttccaaattatttaccaaagttaagctaccttgatatatatttttaaatttttaatttcaagataattttagattaacgtgcagttgtaagagataatacagagagatttgttattctttttacccagttttgcccaaatggtaacattttatataactgtagtacaatatcacaatcaggaaattaacattggtgcaatccatctgccttactcaggtttcatcagttttatatgcacatgagtatgtgagtgtatatttagttctgagcaattttattacatccatacactcatgaatactaccacagtcaagctacaggacagttccatcacaaaagatcccttgcgttatcctttatagcaacactcacctccatttctatcccaactccctaactttgtcatccacaagtatgttctcaatccttacatatttttttcatttcaagagtgctatatagataagaatcgtaacagtacatcatcttgagattagctttttcacccaatgtaatacccttgtgattaaaaccagttattgtatgcatcaataatttattctgcttagtgctgagaggtattccatggtatagatataacagtttgcttaaccactgacccactgaagaaaatgtgggttgtttccagttttgggctattacaaataaagctgctatgtacattggtgtaacataatgtacaggtgttgtacagttatgtttccatctctctgggataaatgccccaaagtttacccttttaaaaaacaacaatgatcatgccacagtccttcttaagtttgctcctctactgtccttaggataaacacaaaaatccttaacatggcctaccaaggacctgttatcatcaggccttacgtatctcttcaacctcaacctgggctgctagtcacctttttctctctgtgcagctctcttcagggacttcatgctgttccctctgcctggaatcctcttccaccatccatccttactttttgtttttaaccttcaggtgtcatctcaaatgttactatttcagagaagcttctcctgaatttccagactcagttaaatcttcttcttttatttgcccttagagcacatggtacttttattatatagtggtaagcacaatttgtaattacaagttatattgtgagaccatttgcttagtatctgtcttacattccccagattataagctccagaaggagagagactatgttaatattcctttattatatatacctttagtatttagtagacactcaactttgtgtccagtaaaatttggctgaggcttttaagacatagtcctggaatcaagttctatctctaccatttattagatgttcttataaaataaatcaaacatgttaaatctcagttttctgatctgcacaattaggattatagtagcatctacttaatagggtagttttgaaggttaaatcagatagccatgaaaagtatttagtccagtatctaaagcaaggcaagcactcaataggtatttcttattgttattattagttgaacaagaaactagagtttttgtattttttttcctaactaggcttttgtccattatcttcatttcttgcctgttcccccaggttctgattcttgtaacttttgagactctgaaaaggggcccttagtttagatcttggataaccagtaggactactggttcttaccccaggtatatgctctcagaccagatgtggctctggttcccattttcatctcactcagtacttcctcctcttgttttccagtctatggatgtcagtgtgggtaagaatgcctcttccctactcctagtttccagatgttttctaaacactgctttcctcttgtctcattccttataattccccatggaggcaaagtatcccattggtgggaaagcccttggtctatatttctcaggtaggtagaactgatctatccaaatttgtaagcacaggagtttaacctctttgtccttccttttctactgagactatcgggaggtgatgacctggaaagtgttgctcatatgcagatccacattttcctgtaagagagcttttgaaaggtttgactgaagggaagagagtcagcaaacccatttcctctttacactaagctatgctcttcaaccaacctttataaaaattttggttccctagctatcagttcttttgtcttatttttcaataggtttagaattcaagtggggaaaagtgatgctatttatgggccccctcgaagattccaacactttggtatatgattttgcttggaatatgattctgtttctcttcatcttttttacattttagccagttttcaagactcagctgaatcagttttacatgaaactttctagcctgcaaggctctttcatgaatgaaaccctatggtacttcctggactgtatcattccttttggaacttagtcatttattatcttatgtgcatacacaacgctcaacaatataactgtttttcctaactcaattttaaattccttaagagcaagaaagggtcatgtacttatggtatatttatgctttaactatccaataaaaattattctttgtacatagcatgtttttaataatatcttaaagcgtgaatgtgggggagagtggcctactgaccaggctttgatttgaaggcccaaggtacaacggaaatggcttagtagctggatggttcctgaagaggttgtcgcagtgcagtggtgaaagaaagaaaaggttactatgggcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagagggaggtaatattcctggctatagtcgattggtgttcagagtgttttgattctctgaatgagtcaaaagattgaaaaaaaaatagccactcttatcactaggaaaagaaatgaggaggaagggtcctgaaaatggtgtctgagcaatgaaagacagtgaatattttaaagatcacaaaatttaatttattcaacctaaatgcataaaagtacaggtggggacattatttatgcaggtatatgcaaatcactttataaaataggcaaagcccttctgctttttataagttgccaaggtggttcctgatattttaaaagctatgcacctttaatgtaatttcctaagagttggaatccctctgtcgaaatcatagtcattgtcagagcaagttgatttttttttttcctatcctctgggacatttacaaggatcttataaccatcacaaaaagagtggtttccacagagatgtgactggaaaaatcccttggaaattgctgaggagcaagtcacagtgttcaaagcaaagaacataggctttgaaaacatgaacccatctgacctcttgaatttagtacagtgaattcctgagctctgaaacatggggcccggctgtgcatgccatattggtgctataagactggcagtaggttggctgtggcatggtctatttcaaactccttcacagtgcccagtgttgcatgttcccagatgacatttggttggcagaagctgggcttccaaagctggcagcctggaatgcagcccactgtgttttgacaaacacataattgaccatctgatcaccagcctacgttctgcactcaggtcactgggggacctgggctttcaataggtccctactcctcgtcttgttcatcttcccaaacctttctccagaaagcaatatagagaaggcttaaacacacccacgcatatcctcccatttgcaaaagagaacatagtacatgaaacataagctgttgaaaatttcctttaaattgtcctggcagcccaaagtgaacaagagaaaagcacacttatggtgaactctaattcagagagaaggaatgaatacactgaattgtttcaacacccggctgtgcataagttgcaattcagttcaatggtttggaaattttgcttagaaaaagggagcaatgagaaaatgataggaaattggggcattgattgactttaggggggcattatttagaaactgtttcattttcaggtgaaagaagagacaagcaggacactgggaatgtcttctccttatctgcctgctcctccctcacacccactatgggcagtaggaggcacgcgagcctggtgaccagggggcagtagctcaaagtgaggtcatattcaaattgaggtctttgctgaagatcccataaggatgtattttggtctgaaatttgactccacacaatgtttcagcctttctcctagaaggcaaagattatgcaataggccaagatatgctggaattacacaaaggttaatgtctatttcaacactaccaaatagcctctccctccatcctacccctactgcacagttcaggcctttggcttttacctttgacctggtctccctattctgagtcagcctctccactttcaccaagtgctctttctaaaacatacatctgcttacaattcttcaaagcctccttgagcctgcaggatcaagtccaaactcctctgcacggcatacaaggtcctccgtatggcaggcaaggtcccctgcctgctttccagcccaatctcatactactctttcaaccaccatgtttcaatcacactgaactattcactcctctgaatctcgctgctacttaacgcctcctgattttgtaaatgctcttacatttttcttgattatgatccccttttctttctgctctttcatatctacctggtaaactgcaatttactcttctgactttaagacccagcctggtcaccttaccacatccaagtgggcactcctccttcattcctcttactacgtcttgtatatacctgcatttcagtgcctatcatatgctatagtctttattcacttatgtatctcccctatcagactgagatttctaacaaaagaaagcatttcttatttatcccggagtttccagaaccaagcacagtgactagctttccataaatgtttgttgaatgaaaactaaataaagagctgtacatgataattaatcaaaacgaagccaagtagtagtgttagcttttataagcatagtaggagcccattagcaatctaatgaaggcagaagatcccagcagtaaggcactttctgatgggtatggcaggggctggtgactggctggggtgacagtaagagtgagggataaattctgtgatggaggaaggtctttttaacagagactgccactaaggctgtaaattaacacccttttcaagacttaatattcaatactgaaagatattgtcctgagaataaatctgaatctgaattgtatagagacctaacttataagaaccaagtttcccaaataaggtaagtctgtgctacctgcttcaaggtagcatggcagattatggagggttcctctttgtttctgctaaacagtaatggaatgggaaattcttgggggaacatctgagagctcttcagttcctattgaaatccaggtcaaatacagattgtgatactggactaaatgcactgctaagagaagatcgaacaagcagaattctgtacctgtttagaggaggccattgaagaggcacttggagtcaaagcactggggagataatgttctgatctgttctcaagggacattggacatttcttttccttttgtcgagcctctggggcaccactctggagccatcaaccatcaactgtgtctatgggatacttgaggacagtaggactgtcataagcccggtcaccctgctgatatgagggcagcttcaagatttggaacaagccaagcaaacatgaagcctggcccagggatggcacaaggtcatgggtatatgaacggattatctgctcattataggtcactcccccagccttatgtgtggttaaaaaataggatatctctagaagctatgcaactgatggctgatgtagcatagaatcagatttgcattttcctatgagccagagacagcctttcaactacactttttatctcaaaagtctcccccttgattcctaattggtgacacaggtcccctgtactgcttgtgtctgaggctcgccctatagcactgacgtcacaatagctgagccgtgcgggcaggagtgcactgtgctgactcatcccggtgatgtgaggattaatgccttgtctaacacagagctattatgtgaactgtttttacacaaaagaactgtaacaaaaatgatttgccagtcagaggactagaaatatgcagtgctaggtaactgaggggagggctgtgcagatataaagtggtaaccataagcatgcatattgacatcctccaaagcatttacagacccactctatcaacactgaaatagagaataacaagacttgtcagggacaggtaggacccacccctgttgtataaatgcattacacacagctccagtctttggggagtttaatcaatctcctttctctgtcaaataaactgtcacgttacactttagccttagcatcctttggaggattctgcctccctaaatatatttgccactatcttctaggaatgttagtggaaggcacgcataaacaaaatagccatgggaacctccattctgtgcaaatgattataatacaagaaataccttggagtgaagagtcagtgaagcaagatataatgttgtgaataaggaacagagctcaccagagagtgagaagcagccagaggataccgataattatttatcacattaggtgactatcactacctgtaggatcttttgggtggtgtctcttataagtgactttgattatttgggttcattggcctagaatctttttcaagcagttcaaaataaaatttatttaaacccattcagtgcagcctggtttgaattttaaataatgaacgttctcttttttttcatataaaatcgtgtttttttttccccccgaatacctttccatcttttctaaaaaagagtggtacctttataaaccttctggcacacgtgaatctgggatttctttttttcccctgtagacttcataattttgcacaaaagtttagtctatttattttacagtcttgtacttcttagtaaagggatattagaaattttgtcaataaatgaaagctctgatctagaagttaaaattaaaaactattggacctagggatgggtacataactgaagaatacataattgcccaatgattgacaggggagcaaaagcccaactgttgctggtatttggctgaataatgtaagctatactttaaaagagcagtgacttttgcaaacagcagctgcagccaagtaaagggcagcctttatagaagtacagtatctgggccactggtattttctgcaccctcatggatagcaacttagtattaccaccaacagcatacactccaaacgcaaaagaaactaatacacactacagaagcactagaaaccacaacaaagtcaactaggaaatatgccagtgaaaaccacaatttcctaaatctgacacttttttttttaaaggtaaagaaatcacttttacttacgtaaagagaaggggcaggtcacagactgatggtcaaagatctgaaaatcaaagaaaaaataaggaattaaaagcaaaccgatatatgatgcaaaaccaatatataaaagcaaaatgatacagtgggaagaaagaaagcaaatctaggcatagatgggactggttgttcctaaaggagcctattttgtcacttctagcctcaaaataaaggagacccagcttcataaaaactttctaaaggtatgaccccctgctatgatgaccaagacagtacttcccagcacaaggagtgcaaagacctttctttgttcatttcattctaatctgtatcatataggatttggtagagctatgttaccatttaacaaaatagccactagccacatttgtctatttaaatttaaattatttaacatttaataaaaagctaaacatttagttcctcagtcttgccagcttcatttcaagtgctcaatacccacatgtggctggtgactgccttactggatagcacagatagaaaatgtttctattattgtagaaacttctattgggcagcactgactagaataggtaaaagctttactatacagtacatgaccaattttagctaattttgacaaagatgagtcaaaccctgataaactttgtctcttttaaggtatatttagtatgtttaatgtccagaagttcctctgaacaaattcaatacattcgtgtgtagctaagaactcagtcctaagtttgccccggacttgccttctaaaactgcctctaccccttctcaccagcctagaatgtcccctctatggtggaaaataatctgataaagtgattttaaacaaagcttctctcccaccaaacacaactctgtttggtgatgaaaatttcagatgaaatgatgaaaattttagattttggagaagctgaccctaacagtgttcttgttctatgtttaaaatctgatatttcactctttaaattacaagccaggctaggcgcggtggctcacgcctgtaaatcccagcactttgggaggccaaggtgggtggatcacttgaggtcaggagttcgagaccagcctggccaaaatggtggaaccctgtttctactaaaactacaaaaattagccaggcatggtggcgggcgcctgtaatcccagctacttgggaggccgaggcaggagaattgcttgaacctgggaggcggaggttgcagtgagcccacatcacgccactgcactccagcctgggtgacaagagcaaaactccgtcaaaaaaaaaaaaatcacaggccaaaaaaaaaaaaaactattataggactggtctgcccatcattgtgctttgtttttttttctttcttttttttttttttttgagatgaactctccctctgtcacccaggctggagtgcagtggcacgatcttggctcactgcaacctctgcctcctgagtttaagcgattctcctgcttcagcctcctgagtagctgggactacaggcacgcaccaccacacccagctaatttttgtagttttagtagaaatggggtttgccatattggccaggctggtctcaaactcctgaactcaggtgatccacccaccttggcctcccaaagtgctggaattacaagtgtgagccaccgtgcccagacccatcagtgttttgatagcttctcttagaaggataaaactgaagtaggaggagagccatgacaaattaataaaccaaaaaaagatactgagaaaacaaagcaggtccccctacctctagcccacttaaatatatcaagaatttaatacagggtgattcaatcttgcctctctgacaccatgattttaacaacttcacataaggcctccagaaatatgcaaaacaaacttcactaaaggagatcaagtagaaggacctgattaagtatctttgcattgaaaaggctaaagcagaaaaccagcaattaaagacatcacccttcctggaaagtttctgggacaactgcactattgtagagatttcttcaaagaaatgatttccctttgtggtcaatgtgaaaccttgctcaagtacatgcaggtgtacttgatgcaggatggtgacaagacgagttaagatgaaaatctccagcctggattattataatgctaatacaagagaggctggagatctccaatgctttcaaattgtttcacaaaattcatgagtttaatgaaaattttaggcaagagaattagattatgtatgattcattgaaagcacatacaaatttgaaatatatatataacactgactagtcttcaaagattttaaagctctaagttttgctatattctagtcttctctgcaagccaggatattagactatggcacaggggcatattttcttaccattttcctccctccctctctcctttcttccttccctccctccctccctcctttcttacattcctctctctctatttctctttctttctttccctctccttttttgaacttgctgtcttctctaaccttggggagaagaagaaaatattattagcaattttctatgaaatatgttcaatgatcatttttctgttgcatgttataaacccaataactctcaacaatattatgctcttctaaaattatacctagtgtttatgttcttatatctaaacacataactttcttttctaaatttcaaggtgcatttattcataaaattagttaaaattaaatttttgatgtgatcaaaagagatcaatgtaagttgtacccaaattgactaacacatccaatgtctggaatgaaaaactatctttcctggatgtcaaatgacacacaggatggctgtcaatgataggaatccaaaatggagagaaaaattacagtgtgtatgtcacagtctaaaacaaattaaagccaagttagatggaagttttattggatataattgttgtacttatatgttaatataaaatgataatatgatcccaaacttaatagtatggctaaaaatttaatctcagagttcttacacaattcataaatgttcataggcatcaaaagacacctacttcttgactgaattataatctgctatgtaattctgagaatatgtattaatctacatagatttatatttgctcaattcaaattgttatttcattgatacatgctctttccacctaagtgatattcaccttatatgtctataagttgtttttatctgaaatgcaaagaattatctataaaagtttcacagaggattaaaaacatttgcattaagcacactttgttcaaagcataaatatatctagcaaagagtataaaactgtaaagcccaagtaattcaggacgttaaaatatcagggtggaaggtgggggatgagcagagagagggggatgacgaggggtgaagtttaatcttcgtattataatgtctgagtggaaattattatatagtgtcaatctccaagaatcaaaaatattattaattataactttaaagtcaattctagtgtagtttatgtaaagttctacagcagtggttttcaacattttgaagtgataccgatccctatgagaatctctttctccagaaaactcctcaaaaacaccaagtttcaaggaactcctagactccatgaaggccattcatgaatcccaggttaggaacccctggcctaggcagacaggggagaaaaaccctctttcaatcccatagctactcacctctacagagttttcatgaaatgctataaactaaagccagcagcaaagaaaatgtataaaaaagagttctaagtgggtaagggtatgtggttagagccacacaggcttctttgaaggcctgccagactcctaccttcctagtcctttataatttcttttttaaaaaaatctacaaagccttagcaacaatggagtagaggagtaccgagcagagagatgataatgatataagaatcactatctactgagtccttcaggtaccttgagaaataaatccttcccaaatttggatatgagtatacccaggaatgtgagcagtgtaacgggagtagaaaaagccacaaaataaatagtaaatacatggctgtcttcctggagggtcagtattccttgtgggcaagtaatttaaagtcttatttgcacacgtgttcatttatccaataactacttcttcaatgttataccaaaaagaaaacagatactgttcttgtcctcatggaacttccggttgagtgaaacaaacaagaatatattgaggagctgaaaggaaaatctgtgtatatattttttgggtgaaacctgagacttcactgaaaagtcttgtttgtggcagactacttcaagcaatgtcctggcaggcacccttagtattggatcactcactctaacttgaggatcacccaagtggaagagtttgagaagcatggttagcagtgtatcatttaatccccactacaagagaaaatactgttacttccaatttactagagaaaaaagagaaatttgagaaattaggaaacagctcagatcataccgctgctggcgtctgaataagtgtgtgccattccaaaatctacatatttttaaccactaaattacactacctttaggagtttcccactttatgtttccccttgaatctgggctcattcaggattacgcaggctagtttaagcttctctttggaagcagacaggtttggcttgatttgcattctaaatatttcacagtggtaagcgaaagctattattatacccattttatggtgaggaagctgaaccacttgccagctgaggtatctggctgggttaaaaacagaatctgggtcgtcagactctcattcctcttgactaactccaagcctaggcactattactgtccatgggcttttctgaacatgagattcacactgggtgataaagagtgagacaaattctgctaagagaaaacaataatagtgcaattgaaaaaaagggaaaataagtaatcataactcacaccaaaattggttactttcagcattgtgaatagaaaagggagagattattcatcacaaatgagtcagaaaattagaatgtgtcactgcactgatgacagagctgaggaatttggatgaactgaagtttgacacttatccttctagctgaagagggtaaatggtgtgacaacaggacagaaatgacctcttatttccaatcttaattaatatttccaatcttttttccttaactactctgtctaaaagttagatgggtttatatgtttgttttctatcggtagagataatgttttaacatccctttaacgttctagaagtattgcgttaattaattcttatgtgggagtcattccaaatagtaggatgatgatttttaccttattgattttcctaatacctttctggtttccagtgttttcaaaggatgaggcactattagatttttagatttatatgtctctcaaaattaagtgcctgtcaactgatattccatctttactctggatacatgatttcctttatctgacagattcaaaaaaatttgtactagatttaatgacatttcatgcatcttgaatttgggagtttttaattctctattttctatttggcaaaaggtttacaggagaaagccagatgcaagggtatttatatgtgcatacagaacctgtgccatcactctctaggtactttggggtttcctgcaggacagattcttgatgtattttcattccttttggtcaggaagaagaagactataaatgccacaaatggtcatacatatcttggggtctgctttccaaaacgcatattattttggatccgtctcaagaagaacaataagagaatgatactgagatctttttttcttaagatgctatgataacaatcctaaaaaatggcctgccttcaaaattttgatgatgaaataaggttataatcaataaagagagaagattttaaagttcagcaattaggtctgggactgcttctgcgcctgagacattgccaagatacaatgtaacactccatcccaccccatatgaatctccctgttccttcttgattcttacggggatagggtctgacagactagaatgaaatgaaagcagtagtgctgggaggggtggcaaggaccgaatttgtttaatacatttaggatggttttttattgctgctaaactagacacaattccttagcatgatgacattcaggaatcctttacaatctgattccaaagaactttctcttctatatcttaaactactgaaattgtagctctataaattccaaagggattgatgtaccaggacctttgacttatagtaaactgatcttaagggatgctgaaaaggtttggcactgctatcatgtggtctaatcatttagacttgtcactaccaactatttgcttaagagcctccaagacctttcacaatctggccccggcccacctctctacttttaataaaaaattttcccactgctgcttctttatatacggtgacagcctatttgctcttccctgaacatggcctgggacatctatgtctctgagtcagctaacggttcacacttgaatctcccaagcctagcatagtgtgtgaaacacagcacgacactccaatgtttgttgaataaatgctgtccgtctattttaggagacagagatgacagaagaaagttgttaaatcagtaaataaatagcaccagagagaggtcaaggaaaagttaattttagtgcattttaggagtgggggcaagatgagcttgaagattaggaaaactgatgctctttattcttgggtctagccaatgctatgagtcagttactttttcgggaacaagtttaaacctcaaggttaaatgaacacaaatgccctgtccatcagcatataatgaaaaagttgtggctatttccacatcagcacagtgaaattaaaatatgcagtgcctctctaagaggcatcacatatgacagagcttttaaaaatagtcccctttgccactcaggtatagaaagagctatagaaacaaaagcaaatgtttgaaaaactgagataatttagcttagggaagaaagagctgaggtgtgtctttatggttttttgactataagaaaagttgttacaaagaggataatgatcagcatttttgtcctagggcaaaatgacattaaaccgtccagtgcagaatttaagacttaaagatgaacattctaaatatgcaagtggtaaataatcaaatagattgctaagagcagttctgaaatttctttcttcctgactctcttaaaataggaaaaatcttcatctattttggataaaataaatgcagctctgcctccagtcaggagaatgaattcaataacttttctagtcttgtttaactctgtatgattctataaaattctataaaatgttcaccctaaaaattatacagaatcacaatacagttgagtaaaatacattctacagtttaaaaagaaataagcaatacagatagttgataagttattacattcaaaatagtaatatatggtgctcacgttttttattcaatttgccaagtgcatataacacaaataaaattgggaaaaatgtacttgaatctactaaggctttaacatagcgattatctagagtaaaacagtctaacaattaattctttcatgtctaagaaatttgctgaatatttcataaacctcatattgaatatgtatataaactcaatttccaattaaagaaaaagttttttgaaggtccagaaagtaatatatgaactcactattattatttcctggaccatcttcaaagacaacaggagaaccactaaacaattcctttaaatgaccaaaatgtgccccatatgattaagaatgtaaatctaataacagactcacagataaggtctaacaggggtggcaagttactggctttctttgtctatttaccttttagctttggagctcagcagaagtgtccattacatacagcacagggttagatgaacagctccaatgaccttgtctgaaccaaattcatttaaagcagtttgccacttttcttaaatagaagatgagtccattctatctatggcccagatttggactggatcactgaactattgcccaactcttataagcaaagcactaacatgtaccaatcaacaggcgaaggcatcaggaaggtaaaaatacacatacataagaaactggcagtagattaaagaagaaagctatatctaaagatggactttggcttttaaagcctttgagtgttattcgaatcttgttaacaaaaacaaaaacaaaatctgcattccaatgtaacttgtagagaagatccagtaaaaaaatgaattcaagagagagagagaaagaaatgtagttttattttgcaacccattatttccataagaacatgaatcaaagagtcagctatgccaatttcttcatagctgactagttataggatattgttctagtcttcactaatgacttcttgaggttggttattactgtgatcaggagttgggaggatagaggtctaagacctttcaaaagaaacgttttgtttagtatcactacagaaaataaagtcagcattaagctaactttgacaacctaactaggataatggttggtgcatgtagccattgcttatgctgcttcataatgaatggaacagtaaaggtgtcaagttaaccagcaacttgaattttgaaaagctgtggcacaataagctgataacataggttgttagaattagcaaaacttactttctgcttcccccaccttctagtcctacttatttccacatccacattcctatcaccaggcagttaaagaaacagaaacaaatgcggctgagactgcttctttggggatactcttagtgagctctccatctccccaaccacaacttgctctcagtttgctaaaaatatattcatttaattgttttaatgcctctacttaggggaatttgcattttcttaactgttgatacaagatctacattcagtttttttcacaggtaataagcaaagtatttggggagtgtgtgtgtgtgtggtggtggtggtggtggtggtggtggtggcaaattccgtcctagatgcttcgagttttccaagtatactgctaaaaggggtcatttgcttccccacctcaagaagccaattgtgcttatagttttacttcaaataaagatatatacctataaatgcacacatcatacgtgcacacacacatattcttcttctcaaaagtcataaacatttggtgactctctgtatactccatgaagtgctgttactactaaagtcagagtaatttaggcagaaacataagaaaccccaaatggtttgcactgaaattttattaacatatttgtcagtgttttcctcatggataatctccattggttcctggctccttgtcagcatatgctccaggagcctctcacaatatctttctgccctagaaatcctggcctgtgagatttccttgtaaatatctgaattcttgtattcacctattaatgatccagggatcgaggatgttttctatctgctccttaacctcccacttcaaggattagattgtaaacaacctagtgggaacccttcaggccaaaccacagctgaacgaatctcagcaggcagggaacccgcagcagtctgtgaaataccgtgaaacacaattacgaaaatataaagtattcacccatactttggggaagaaattatgttgtttccaagatgagacctcaaaaataaggctagtatcctaattgagaaagacatgattttaaaaagtgtcagcagaggtaaatttttaaaagtaccagatttgccaggtccttctcaaaccatagattcattttcagtatatgacagtggcctgagccgacacttcaagggaagtccattcatctctgaccaatgaagcccaaagtactcactgcatgaaagggttcctttcttgtttccaaaggcaatcaatttttgtcctagagtctgaaggttcatgggctttcttttaattttgtcagtctgcacatgcatggttcctcctgcatgatttggtctggaggaagtgacccacccacaacgccacagagctaattaaccccacactgagcttttttttttttctcatttcacacatccactcaatgctttaaatgacccagcagcagcatgatcatatgatttcttccccctcagtgaggaaagcatggtgatgggaggagcagggatatatctgccctaatcaaaacagcagtgtgatcctaaaatattatctaattgcattgcatccgagggtgcaaaatactaagaaatccctgaacgaatctctttcatgtcattcatttaacttcttgcagtgtccatttgaagtagcaaataatacataagaaacactgaggtagagaagtttgatctatactcagaatgtttaaaaaacatccgatcttacagggggtaaaagaccgagagctccttccctatcccgaatagcttcaagagaagggccttttttccatttgaaggaacagactcatgtttttccagatttattttttccaaagggaatgccttgaaaactctaagatgatcactgttttctaacttttcaaaaaagaaaaaaaaaagtgaacatgatggtggtgggtgatttaatggaatcagcttgtcaacatgatgaaactgaaaaaagcttttatagactctgtccacatgctaaaaaaaaaaaaaaaaggcaacctttaaagttatgtgtatagtatagagtggtttttgtcatggcaaagaaaagaaatataattatcttatgcagtaaatgtaaggctctgctaagaatctcattggataaatcatagaaatacatcctggccagataaatggagccagacaagttctaggtcttgtaagaagctttcaaaagaatcatcatattgtaagtctgtcatctctgtaagtgacaagaaaaattctaggctatttccctcggttctactagtaacatggcttcagagttttaaagatttagacttaaatggacaagaaaatgacttctgaatatcccatcttaggcaaactatcggatttctctcattcttacaagtaagtgtagcaaattggttcaccttggaaggacttggttagagatcatatatgtcttatgtgaacttttaacctctctttcctttgcaaagtgatttatgcatacactattaaatacacaggaattctataattcttagttcagtgaacagttagtacaagggaaaatctatctaatattttaaatttttgtttagtgtcttaaatcctacactttagaactggagaccttatagataagttctataaggtcttcagtgtgctgaaaaacacatttgctactgctccctaagcttctcttaggtaaggctgccaactggggtaaattgatggataaaactagctcaataggcaaaaaacaaaggtccagtgaagcacagtttatttttatttatactggtcagaaatatcacagttaacaaatagcctaaatcaagctcttatatctagggctccagcctttggctgaagtgtctcatctggtaattctgaaaaaaatagggttgttgtgatttcaaagactctcctgcccagtagactttttcaggctcactgatgcttaggattctaaagcctttactatggtctgttagaccaatacagtatgtcccttactatttctctgacttcatctcctaacattttcatgcaaaattggtccaacagacaataaaatagacagggataggaatatgaatggggactaaaaggaactaattaataaaaattagttgctttatgtccttgttaaatatcaactctttcatgacagcctaataaagtttctgaacttatcttgagagttggttaagataggggagaatatacaaagtatttccaacaccatgcattcattcattaattcaacaaatagttttcccgagtctattattgattactctgccaactggattctacttctgccctcaaggaccttccactctaatgtatgttttggagagtttctgtctctattatcactgacaggttattagcccactttagacaagttataaatataaccacctgccatgatgattcctcttcttgttctttatttgtttttattcatttgccctgtaacatccattaacctttcatgaatgacctgatcctttgtgagctatactatcaacacagctaatttttatataaatgagaaaccccttctccactcccaactaacttttctttctcaaacagccatgaaaatataaaagtctacccagaattatttaagtttttgaaatgagtccttacaatctgatctgaagcaccatttttttcctttcttttttgaaagagggaatggagcctcagcccctaagatacatatctcaagttacaggcaaattacacacaagttactggtctcccagacgtagtactcactactctctggggtagaacaatttctgcattgaacagaggaccataatctagctcaagtaatctcaatctcagagaacagttaaccaagtgcatatttctggtccctatattctcttataaggagttaccctctccactatattttggtattttctgaacctggctaccttaggtaaatgacagtggacatggtaaaaagaacactaactcttcctcaatttgttaaacttgtttttcctcctcatatgctttataaacaaaaatgggagaatttaatgtatgtatagagcagcaaatgttctctctgttgctttcagacatttttatcttatataaacagtggtgatgaaattataaataccattattccacctctatgttaatactcttattatcttgcatcaacagacgtgaacaaatacgtacatgacaccaatcaatcccttttctaaaaatgcagtttttgtatttctaaacagtggaggaagaattttatgaattcaacatgtagtttacctatttatattttgaattttaataaagtaaaaccaaattatcgcttatgttctttcacacttacatcagccattaacactctccatgctggcatggggtagggggtgtgtagaactaatggcaatgggtccaagtcccctgggtcaggtggttaggggcttggcaggctggagaggatgtttagatgctggggcaggatatttcaacctgcttgacaggtaagagatattttctggcagtaagaggaatattttttatggaacaaattgctagggagaggtcattttggggcactaggtgagagaaatatcaaaaccaaacctaaaagcagtctaagggaactcgggaaaagaaaatcactactttttcaatctcctcactggtttcccttattccatagtgtgccttctccttccatcttctagcacttcatactcttttctcctccatttcttcaggttttctttctcctacctctttattataacaaaaaaaagcatttaggaagaattctaggagacagggagacaaaaaaaaaaaagaatttagagaagacataataacatactgcataaatatgtatgtatgtatgtatgtgtttatgtatgtgtatatgtatgtatatataacagatattcgatttaccaagaaggataaactgggacttttgagatttaaaaaattcatggtatgtctggtcatattaatctccaaaccagcttgtttttagcattgctagagctataacagaatcaggagtagaaaacaaaaggaaaaaaataaaatttaacaaaggatttatatttgcaaaggaaagaggacttatttagagttgtttattgaaattcccccaaagctattttttgaacttatatattgacaacatcaagagaaggagcttaggaattctcatagggtttaggaactactaaaccttgtatattatgttcatctcagtccactcaagcaagtaaaggataactagaggatggtatctcacagtgcataacatggttggttactttgctaggctgacatatggagacagggcccataggagcagagcttttcttacgaataccagagagagacacccaggttcatctaaatgtatagggcatgagggattagtggtacagtgttatctgcaaagtacctaaaagtgttttctaaacaagcactaacttcttagcccagtcttcttggggattaaacaaaatccaatagtaagtaatggggaatactttatttggtcactgggttggggagggttgctgagacatatgacaacattcaatccattaagataggaggaaatgaggagaaagagaaaacaaagaaagggagagcgagggccagaaaagaagagtgtcacctctgtagactctctaacagaataaatcgataatcttaagaaaagtaaaagagcatgcctagagggaaacctcagcacacttttggaatccaaggcaaaaaataaaacaatttgcttcttgtcaagtttattgccattgacccatgggaggttcctatttattctgctcttacatgcacaggtatttcttctactcttacattcttttcctaaggattagcattctgtgataatggtggtaatgacagctgccttaaattagtggcaagttaggaatgaaacactgaccaccaggctatgttcttgaatccagtctatgccctgtaatgtgttcattctactttctgcattttctctgagacctgtcgcataagacttgttttgtaaggccgggctccttacggggacacatatggctccagaaaacaagtactctactttctcaccctgactttttggttttcttgttttttcctcttttctcccagactattattttccagtttcttctctaccagtctggacgcccatggttgttaactttagagatacccaccagctccatcaattccctcatctacagttctcaactgtatttacctagttctggagctcagatgaacccacatgtatgttctcctcagcttccaggctgctgatccttgctggagaaaaagcacaaaactgtacagcttgatgctcctgcagaattacggtttccagcataagttcgaatttcagaattagtttgcaattttaaaatttgctcctagtcagtttcctttttcactccacagtttcattcattactctatttaactggttataacccatcccctacccttcactctcagctagtaaccttgcctccttttgcatagagaaaacagaggccatcaaatggcacttcctatcactccacctttgccaccaatgaatccgcctgtaacatttcagagatctttctgcctagcactgataacctcatccaggatcttattatatcagttacttttcctttcttttgtattttcaattttcctactgcctgccaacatgctttagctgtcttcatttaaggtaacaacaataacaatgataataaactaacaaacaacaaaccatcttttgcagactttatctttccctcttttgtgccaccttcaagcttcctaagctcccgtttattcctcaaaccattacaatctggtttctctagctgtgtttctaattaaacaatttttttttttttttttgccaaagtcaccaaacacttctgaattgttagcttccaaaatccattcttcaacctcattgttttctttcttttaaaggtcaggttcactgaggtataatttacatacaataaaattcatccttgctatactcatttaccattcaataagttttgccttatatgttggaggcctgtaaaatgaagcccaacccccaagccgctttgcttcatatacaaatccctttggcacctctcagcagtcttccccacataacccattgtctggtgacaccacactactcagcattcaaggatatatgccatgtacattcatgccccttgtactttctttatgtttcctctctataaacatatatgtcttggtataacacagtaaatgctatttaatattaccacatcaatttccatatagaatcataaatctatacgttattttgagaagctgaggttttccaaatagaagtcatccatcaaaatgctactacctgaagatctctattattttagtattatgggttgattatgttcccttaaaattcatatgttgacattctggcccccaattctttagaatatgaatagatgtgtgaatagggtcattgaagatgtgattaagatgaggtcatgctgtagagtgggcctgcaatccaatatgactagtgtacttataaaaaagagaaacttaaacacagacatgcacacagggagaacatcatgtgacgatgacggcagagattggggctgatgcttctataagccaaggaacaccaaagattgccaggaaaccaccagaagctgggtgggagtcacggaactcacagccttagaaggagccgaccctgttgatactttaatcttgaacatctagcttctataactgtgagacaaaaaatttctgttgtttaagccactcagtttgtggtagttcgttacaaagccccagaaaactgatatactcagtaaaagaaaaaatcttcagtatattggaatcagttctttcactcatcaggtacttactgagtgcctactatgtgctaggaactgctctaggatattgaatgaatgactaagaacttcatcacgttactgcattttttgttcactaataagtaatcaatctatcaatcaatatattaatagatgaaatgcctatcatttattttatcagcaaacatttgttgagtatctcctatgtgtcagacatcgttctaggcacagaggataacattattggcagatcaagttctccaccttgtatagtttaaattccagtagagggaacatatattaaacaagaaaataagtaaataagatatgtaattttactctgtttctgacactgagagtcataggcatttatcctctaaatcactgaacaaagcttggaactagatagcgaacatgttacttcacagtttacaaagtaataaggaagacaatgaggtctcatactagaggcacgttaaaccacaggcagtgtgcaggcttaaagtgtttgggaaggacatcccaaaagctaggtttcttagtcagttcgtcagtcaatcaacacatatttcttttttttttttttgaccaaatttctctctgttgcccaggctgaagtgctgtgacacgatctcggctcactgcaccctctgcctcccgggttcaagcaattctctgcctcagcctccctagtagctgggattacaggcacctgctaccatgcccggctaatttttgtatttttagtagagatgggatttcaccatcttggccaggttggtcttgaattcctgacctcatgatccacccgcctcggcctcccaaagtgctaggattacaggtgtgagccactgcacccagccatttgacatgtattttttaagcgcttactgtataccaggccctatgctgaagatagtagaactgtggacagagccaacatggtactattacccactgagctcacattctaaggggaaaaatttgaacaacaaatctcacagtccgttctttatcatatatcctcataagaatacataaagggggttaggagatcacctgggtcagaggactggcccatgaggggtttccaaggggccttccttgaagatgtggtgcccggacactgctttagggctggggtatgggtattggtttgagcagggtcatgaagttttcggtttcttcttcctcatcccctttcaaccatgtacacacatttcaaatacttaaaagcattcttcaaatatactaagaacaccaagaactaaacacaagagaaggactctccagaggaaaggggccaaaaatagaagagaaaaaaaacccctaatctcaccatttgttttgaaaacacccaaaatgattaaaacatattataaactaaaacatatgaactaatcacttgccaagtttcatttttaaatcaaagccgttttgaggttcataaactgaaaaaagaatcttcaaatatgaacttgtgtttttcttttcttggccctcagttggcttgaagcatttgctgttatgctgtgtggagggaaggggaacctgctagttaggaacatgtggcatgcatgtactagaaggtaagctccacaagatcatgactcttcacagtggtatccctggtaagtagaagagtgcctgaaagataacaggggctcaataaatacctgctgaatgatcaactagtgaatattctgggccctttaagggattctccaactctcttttcttacccaagctgcatcttgctttaggccagtggttctcaacctggggctaatttttgcccccagtcaggggatatctgtattttttgttgtcacagttagagaagttcctactggcatttagagggtagatgccagggacgctgctaaacatcttacagtgcacaggacagccctgttccacagagatttatctggccccaaaggttaatagggccaaagttatgaaactctgatttatgccctttgtttctattgggctgtacctgggagtcagatcctctgcatatttggaatgaagttcagtcctaaaggaagcaccccagaaaagcctcattgcttcatcctcattcccttcaagacctaatagaactgcccccactctaaggcaggctcagagagagccaattttgccttttgtcctccctgggtcaacaatgcaattgctagggaaatcatctgaaaaagtctgtctctacaatgcaagtaaataatttttacagtacattggtaatttccctgagcttacctaagcatatatactaatttagtaaaattctcttgtttacaaactagtcatgtatctgcaggaaaaaaaaatctcctcaagttcaaccagtttatccatgtctgctcaggatcagtacatgactctagctttattcatgataaataagatcaacttcaagaattccatcaaaccccagtaatgtgcctttagagagactgggcttatagcatttcctctgccaccctccttgccctgcatattaaaatacaggtatctgattccagtttcaatggggaaacttctgtcgtgccagaggagggcatgcgctgatttccccactctgatggttgctctagtaatcttggtgttgtggcatgtttcccagttaccatagagactgcatacactaagactgcagcattgtgattggtgggaaagatacattttgcagaagcttttctggagagataaaggtaagacacgagaaagaaagtgagactgccaataaaggggcagagcacagagaagtcccaaacaaccatacattctagaaaactgggacagcagagattacaactactgctataaaactacataaactgttcactcaatggctgcctgtcaggaaaatttcaagtattgtcagacagaacagacacaagatattctagaataaaaaggtaaacaagtaaacctactgaggttataggggtgacaaaagggaaatggcaagaaaacatttaaaaatgattcaatgctagaaaaaaaaaagaatctcagagagcaataaaatttaaagttacatttaactttaaatgtaggctgacctttggggaattatttaaattctgagtacctctgcttccttccctatgaaaaagaaaaagaaaaaaagaataaagatggaaatagaaagaataaagatgacttctctctcactgtttaacaggagtctctttaaatatctcaataatttgacattatatcagttgaatatgatgtaccccccacacaaaaatcagacaaaaacacttaaagggggtgataaatagggggacgtcattaacaatgcaaattgactcattccatagtttcttagagtaatgagtcaactgactacgtgatctcatgtacataattttgttcggcatgagattttgaggtatacaattactacagaaatcaaggtatacctgcaatgtaaagggtaaatcgtaggcattttaaatgaaagctggggataggatgtgtgttggtttgagggatgagtgggagtggatttaagagaaaatcagtctaggaaaatatcacataagtgtttgtaagttccttgatattcaggtctgtatcttgtaatgctttattaaacatatttcagactaatatgtccattgcctactggacattcatatctccctgtttttaaatacctttcaaatctgtatcttgagccattacttatctcttgacctctaaccctttatatcaaatgaattactagacaattacaattagatattccaaaagcatcctaaattcaacatgtcaaagctgaactcatcttttccttcaaactttctcttcctcctatgttccctatgtgagtaaatattaatagtattaccattcacccatctgccaaagttccatacctaggaagaatcatggttgcttttatctcaccttcaaataatcacccgtgcatatagatgtgcaatcctaataaccaaaggaggccttttttgaatagaaagcaatatttacagttaattgggttttgaactaatattaatttattaaacttacaaattttaaaagcctagttttctttacacctttacctgttaaaaacacacatatatttttctatgtcttaatatagcaatttttgcataaaataagaaaaattactttcaggaagggtgagattactagacaaaaaaatttgggacctcaaactatttcaactgtcagtcagaatgttaaaagaatgagagttagggtctgatctgggaacacctttcaaatgattttgccaaggtcaccagtagacacactgaatgtttttatagtcactctgaaaatgagaaattttacgtctataccctacaaaggaaaatttacaatccaggtcctctatgtttaagtttcattcttatctaactcttttataatcactttccactttatagcctgataaaggtagacaatattttgtgtctccactaaccaggtttcttgaatctagtgccctttcacttcataacgtttttcacatttctacctctctcatccccattgcaccacattagctcagagcatcattatctgtcacttgtaatattgcgacagtacattgtactatattttcttaagtttctgagtctttgcacatgtcaccacctgtgtctagaacacccatattccctgataaacatttactgaatgaaaaaaaagttaataaatgctttggatgttgctgctttgggtgctgaacagaaatagtggcctatctaagattctggataagcctgcataaagcactcttactttcaaaattaattttgaagaataagaaaattttgccatggagaatcatggagcctatgccacaatattatgttttgcatttaataaaacacctccaaacccagggaaagaatcagttattacttccttcaattcatacaacgaatatttactgaacactctctatgtgccaggctctgtactaggcactgaggatttcttagagcatagaacaggcaaaaaacaaacaaacaaaaccgaaaaaaacctcacaatcatggggcttatattccatggcaagaggaaataaatgtgtaaataaaatatatattttgtctgaaggcagtaggtgctatgaaccaaaaggggtggaaagctaaatgttaaatacagtggttatgaaaggccttacttagaagtgaaaattgagcaaagacctgaagatgataagcaaacaagccttatctggggaaaacatttaaggcggtcagaaaagcaagtgcaaatgtgaaatcatgcatggtaggctggaggttaggaagggggtcaatgaaggttgaggggagtgagctagggtggagcgctaaatgaagacagagaggtaatggggaaattgaatatggagggtcttgtgaactactgcaaaggcttttcttccaagtgagatgttgagccattagagagttctgagcagagaagtgatgtggtctgactgaaattacattacatatattgcaaagcatcactctggctatcattttgagaatagactgtaagtggtaaggccagaagcagggaagacaattaggaggctactgcaataatccgggtaagaaatgatagttgcttggattagggtagtagtggtgatgaggatgaggagtggtaagattctggacttattctgaaggtagagctgcaggatttgttcaatggttgggtttgtgagagaaatacaggtctgggagagaaataaatttttgatttgagtaaccctaaaggtggagcgttatttaccaatattggggaggctatgtatttgcttggtaaaataaggaattccatttctggtatgtcaagtttgagatgctcattagacagacgtggagatgttgaataggcagctgaatatgtgagcctagaattctgtgtaaaggcctggactagagatacaagcttgcaccataagcttgggtgcaaatattaagagagtgaatggagctgaagagaagagcttcaaagattgagctctagggccctctaatgtttacctgcttgggaaatgagaatatgctagcaaaagagactgaggaggagtagactgtgaggcaggaaaaaaatcaggagagtgtggtggactgaacgccaagcgaagaaagtgttttaatggagaatgaataatgggccatgtaaaacaattctgagacatcaggaaagacaaagactgccgaatggttaatggatttagcaacatggaagtcattggtgaccttagcatcaacagttttactagactggtaggtgcaaaagctaactagaggggcaaaagagaaccagagcataggattggagagtgtttatagtgactatacgcatttcttgagaagttttgctgtaatggaaatcaaagaaatgggacaggagctgctagggagtatggtttataagggtatttttaggatgagataaattatgtgtttgtatactgataggaaagttttgatagaaagagaaaatttgataaaacagaagaaagatgtgagctttttcaggagcactgtttatgcatgtgcaagaggagagagattctaaggcacaatgagggatgggctgagccaagggtacacagagtttatccatagttgcaggagagaaggcaaaatacatgggtacagataaatatgggagggtaggtgtgctggacagcaagtatttgtgaagttgtcttttgatggtttctattttttcagtgaagtaaaaagaaaggttctaagttgagcgtaaggatgggggaggaggtgttagaaatttgagagagggaaaaatatgaaatattcttgtacagatatggaagagtaaatgacaaggaaacatattatatttgctgggcagcattaacggcctccttgagggatcatgaatttaaactgagagtcatacatttgcttgtgtgtttttctccagccacattcagctggcacacaggcatgaaatagatggcgagttgcatatgatcagtatagttgagatttgtcaagagagcacagttaagtcagagaaggtcaatggtgttaaaggcgcatacaaggaaatgattaaaatcattgtccatggaatctacgctatataatgaagtgagcatatgagaagctatgggtaaaatcaatgaattaggggtcctagtgggtttaaggaattggtgtattaggggtaacaaagggattgaactaccaagacattaggctgtggttggaaaatggaatgcttgaaattgagattgtggaatattgtaattattagtaattaaaacatcagaaatgtagccatgggaatgagtagctatggcagagtggagaatcaatcatgagaagttcaagaaattgagaggaggtattagagggagcgtgtatttacacagtgaataaccaataattgtaatggggtagaaatggaaagagtgttagtgagctaggggctaacgttttcaaggaattgggaaacttgcctggtagacaactgcatcaagggggagttatgggaacacttagcttttctactacctcctcaatgtttcctctctctcactttccatctttccagcttatatactggcattacaaactttaatttcctagactagatagctacatatcacctgtgtctaccctttctcctccctatccaaattatctccaagtcttgagaatttccaatttttttttctgagatggagtctcactctgttgcccaggctggagtgcacagtcatgccatctcagctcactacaacttccgcctctcaggttcaagcgattcccctgccgcggtctcttgagtagctgagattacaggcacgcaccaccacacccggctaatttttgtattttagtagagacgaggtttcactatgttggccaggctggtctcgaactcctgacctcaaacaatccacctgccttggcctcccaaaatgttgggattacaggcatgagccactgtgcctggcctccaattttgaatactctctactctccccctttgggaccatcactactctagcctgtcactctctattttatcactcagattaatgttcttcatggcactaatcgctctctaaacttaacttgttcatttatttgtttgctttttttgttggggggggtgtctattttccttcattaaatataaatttcataaggggaaaagttttgtttaatttgtgcctggaacataatatgccctcaataaatactttcaggatgaattaataaatgccccctataacatgctgatgaatccttatattcttgggttcacacaacagctttgctttactatcctaccagcttctccctcctttcctgctcaaaccatccatttcaccgagtaaagtcatttcactactcccccaaaacaccatgttcatttctattcagatgatttcatcatatttctcccttgtttatgtctattccccacataccaattctttgagtcccagcttaggtcttacttctcggatggtttttctatgattaccatgaggcctgctgatttctccctcctctaaaatcctgctatccctaacaacaccagctgctttatattttctaattgtttcatatgggttattcttaccttttcactttaaaataggtttatttttggcctaaggatcctgacttacaactacagtatactcagtaaaaactaacacagtgtagggcagataacgggtattcaaaaaatactatggcctccttagatagcttcatagacttccatcttcctcaacaaacattttctaccttttaccctgctgttagctaaatctaactattcttcctgctctatgatactgtctttgagaccagaaccaacccctatgtccactacacagaattctacactcttgcactgcaattcccacagctaaatcattgtcattgccattattgttcctggattctcttggcaattttagtatattcaaggcatagctgccaagatcatcatcctccttgattgtttggaatctttatttttttaaatccctgcattttttccatcaaactttaagtgttcctgtgggatttgtttttccttggctccatccttggcctggttcttctccactttcttatgttcagtcactcgatttgccctttgtctcatttgaaggaatcagctttcacaccttcttttaaactaccttgcatatttagaatattttctcaaataatataaaatttataatatttatgaataaatgacacaatgccaagatattctgtctcttctttcaaataacatctgaagatgcacctgcactagtgagttctatatttaagatattgaataagtatcattcacccatctgctttcattctgtcctgcattttttaggacctgcttcagagttgtattttgaggtcttttggacggggaactgtctggcatagttcacaaactggcctttgctctgtatattcatgttcctttgataaataataaataataataatagcccactgtgcatttttacattccactcataaatccctggaaaaagaaaaactaacaaccagggattataatagaaacacagaaacaaaactaaccttttaccaggttttgctacagtaatatatacttccatagacctatattctaacaaataattacctgcttaagtcatttgtaaattgttcctttgccaacattatgtataatagcaaatgtctacgtggtttataggacagggaaaacaactagaacattacagctatgtgggggatcagtgcaaaagcagcaaaataagaggtttactctgttgggtgcacagtttggaagaattagtctcacaagtagaactacttgacagaatatatgcctgctctccagctcccccttctcccctcctccagatcttttttcaataatggaagaagacttactttcttttttcaaatccaggtgggaagtgtatcattttgcgtgaaaaatctgtttttctttgaacataacaaatggtctgattgaagctgctctatgaaaacggcagcatatctaaccagggaggtgggaactatagtttaatgggtggagcacctccatatttagctgcagatgagccacatttaactttaaaaaaaataaaaatttaaaaaataaaagaaggccaaaatgtaatgattgtcttgttactgcagtggccactagatggcaggtccaaaaatctgatgggagtctcacaggagggcaaatcttagggagcagaatgtttctggcactcaatccagtgttggttcatcaataagccttggcagtttgctaaaatatcaggtgggtaagacaatatccatgttatttcacagggctgaagggggcaggaagccctttggtatctaggtttgtagagtattgtcatcacatactcacacatccagatactgctacccctttggacttctgtccacagacattcttggagctggtttttatatatgttcagctgtattccattatctaatggtctgtgcaatactgagccataatctcaggagtgtaaaaggtagttgtctaatctgcctccatggaaacaaatgaaggaggctgtcaggctagggtaagggaacatacagctgtactgtatttaacaacatatatttaccagtaattgcaacttcatgttaaatatgtgtatttcctatactggaggctgaccatatattcatgttaattgttttgaaaaagagaatgttgatatataagagacttattatttaataggataaaataactaaggcctatgattaaaaatgaaatgagtaaatttagaacaaattatttgttgtacacagtagagttttcattttcttttactaggatgggagacttctagatgtgggtcttatgagactataaaaaagtcattcttggaccaattattctgaagatagattgtgtctttcccttcataatttttttttttttttggttactagattatcctgataaaagtgatttcactacatggacaatgcctacttttctttatcttttaattaaagaactgaccttatgatttttaaaagtagagaatcacaagctctgagataatttatcattctcactaaagaaaatgtgctctagagtcaaatttatctttgtacaagagctgtgacatgcattttgatatacatttaagcatctatgtcaattaaaatattataaaaataaaagcaacaaaaactcaattatagccatgcaactcagtcatcactcaccttttgttccctttttctttgaaaatttagatagaataatggtaaacatgttgatttcatctattcttgctctgtatatttggactgtgaaatgtctacatgagacacaggaagagggcacgggtcttcaggataaaaaacaaaaaaaaatttttcctaaagaagaaatatgggctatattgaattatgatagatgttttaaatcagtaccgttttcctttagtttggagtaaaatttaaaatgagatgactgaaataatttacgataaaatatcatggttatttctacatatttaaggtttaaaaatgctcaaacttatactttcctcatagaaagagcactggaatgggaaactgagaggtctgggttctattctggctttgacagtgactcactgtgtgacatccagagagcatgacctccccaggctcctcacttctgaaatgggagggttttgaggacaaagtctctctctgctttaacattcaatatccaagtaagtaaattgctacgtattgcagatttttttttcctcagaaatagactaatttcctccgatgaaagaataatactgttaagaagctgatgttgaaagctaacatgtccctaccaacactgtgggctctacccatgcaggtgaagctagagcttgttcttccttcaatcccccctttccctattctgcaccactcttccacacactcccccatcatctttaagtctaaattctacctgagaggtcctctgtgacccctaggtagttacttgctaattattactaattattcaataactgttttacttttcctcttgagcacatagctaagttccatttcccagccttctctgcagatagctatggccctgtgaccaaattctggtgagtgggatgttggtggaagtgacatacgctgtcccaggcctggtccattaaaagttcctgtgtaatcattgctctctcttcaccagatttctggctggatgtcacacccacagcaatcttggaagctatgtactgaagagcctctgtcaacctgggtccctgaccagtctttacatgagcaagagagaaactcatgttgaaatactgagatttgggagtgtgcgtattatagaagctaatgttaccttaactaagaacactcctaaagcagaaatttgttctctctccgagacattatgtctcttttaccacattttccacctttaataatttatttactgatatgtaagctccttgaggatagtacatttgtttcactagtgtacccacagaactctagttagttgaatgaattcagaatagaacatagctggtttggaaagtacagaagttacagaaggtagtaaaagcagtttgatttttaaaaattctagctttgtgttttatcctataatatttaggtagaaggtagggatgatgggttggggttttgttggtgtggaaatgtattgtgacaaccacagccttttaatatattttgtgtactgcatccccaataaacatgttttccaaataaagtgtaaagtctttttctaaatgctgtatggcttgccttttttatatatttgtgtaaagaaattcgtagtagtaattctctgacactgagttaaaggaagtcctattttttttcacaattatgtgaaaacacaattatgtgctgtataatgacattttagtctacaatggaccacatatctgactgtggtcctgcaagattataagataactgaaaaattcctaatgcctagtgatgtcatagtgatcataacatcacagcacaattactttttaaaacataaatttagtgtagcctaaatgtacagtgcttataaagtctacaggagtatacagtaatgtcctaggtgttcacattcactcatcactcactcattcactcacccagagtaacttctagttctgcaagatccattcattgtaagtgccctataaaggcatacacttttgatcttttatgctgtgtttgtactgtaccttttcaatgtttagatatgtttagatacatgaaaacttaccattctgttataattacttacagtatccagtacagtaacatgctgtgcaggtttgaagcctaaaagcaataggctatatcatatagcctaggtgtgtagtaagctctatcatctaggtttgtgtaagtacactctatattgttcacacaacgatgaaattgcctaatgatgcatttctcagaatgtattccctttgttgagcaatgtgtgactacattttgaaaagttaaaataatactaaagggagggacaagtgaagagctaacttgagaaatctaagaactaggtaatttaaaagaagtgcttttagttacatagggtttttaacatcattaccacctatgaaattacaggtattaactactgtctcaaaatgatcatcgcccttttgatactttactctcagtgtcatggctgacctcttttgagtcaagtttattggacattttcagttttattttttaattctcatcactgcccctccctgaaatacttcatccctggtttccttaataatactggcctaatttccctattctctatctctagttttctctcctcttttgtttggctcctctttctcatctattctttaagtattagaatttcctagtgttctgctctgagtttttctttctctcataatttttccttgagtcatcttatctagtcttatggctttacctactacttcctcacaaataactcccgactcttgatctttagcccagacctttcttcggagcttcaaaacctgtattgcctatagtatcctgggcattttaagaaaatctaaatattttgtgccaccttaaattcaagtcccaaaccaaaagcactccttgccctttcaagtcaaaccttcttcctcctgtgttccagctcttggtagatgacatcaatttagaaacattaaactctccttttctttctttcttgtcccttatctaaattatctaattaagttctaaatcctgtagtgcttttatagtccatttgagattttagcctaagtttgaggactagataagtgaagacagattaaaaataagacttcttttaactcagtgtcagagaattactactatgaatttctttacacaaatatacaaaaaaggcaagacatacagcatttagaaaaagactttcatacccttccatcataccagagttccattatcagcctgaagagaaccaggagagctgtcctgagagggagctttctcacaatcaggactggattgaaacaaaatagaatcaatggaaagaaagatttttggggaggggagagaagttttgcttgctgctggtcctttggtaacctctgcaaaagaaaagtttaaaaaatgaccctggctggcaagatggccgaataggaacagctcccgtctgcagctcccagcaagatcaatccagaaggcaggtgatttctgcatttccaacagaggtacctggctcatctcattgggactggttagacagtgggtgcagcccacagagggcaagccaaagcagggtggggcatcgcttcacccaggaagcacacagggttggggaattccctccgttagccgagaaagccgcgagggactgtgccatgaggttcggtgtattccagcccagatactatgcttttctcaccgtcttcacaacctgcagaccaggagattcccttgggtgcctacaccacgagggccctgggtttcaagacaaaactgggcggccgtttgggcagacactgagctagctgcaggaattatttttcataccccagtggcacctgcaatgccagtgagacagaaccactcactaccctggaatgggggctgaagccagggagccaagtggtctagctcagtggatcccacccccatggagccaagcaagctaagatccactggcttgaaatccttgctgccagcacggcagtctgaagttgacctgggaccctcaagcttggtggggggaggggtgtccaccattactgaggcttaagtaggtggttttcccctcacagtgaaaacaaagccaccaggaagttcaaactgggtggagcccaccacagttcggcaaagccactgtagaaagactgcctctctagatttctcctctctgagcagggcatctctgaaagaaagttagcagccccagtcaggtgcttatagataaaactcccatctccctgggacagagcacctgggggaaggggcagctgtgggcgcagtttcagcagacttaaacgttcccacctgccagctctgaagagagcagcagatctcccatcacagagctcgagctctcctaagggacagattgcctcctcaagtgggtccctgacccccatgcctcctcactgggagacacctcccagcaggggtcaatagacagctcatacaggagagctctgggtggcatctggtgggtgcccctctgggatgaagcttccagaggaaggaaccggtagcattgtttgctgttctgtagcctctgctggtggtacccaggcaaacagggtctggagtggatgtccagcaaactccagcagacctgcagcagagatgccagactgttagaaggaaaactaacaaacagaaaggaatagcatcaacattaacaaaaaagatgtccacacaaaaaccccatccgaagatcaccagcgtcaaagaccaaaggtagataaatccacaaagatgaggaaaaaccagcttaaaaaggctgaaattccaaaaacccgaatgtcgtttctcctccaaaaaatcacaactcctcaccagcaagggaacaaaactggatggagaatgagtttgaggaattgacagaagtaggcttcagaaggtgggtaataacgaactcctctgagctaaaggagcatgttctaacccaatgcaagggagctaagaagcttgaaaaaaggttagaagaattgctaactagaataaccagtttagagaagaacataaattacctgctggaactgaaaaacatagcacgagaagttcatgaagcatacgcaagtaccaatagctgaatcaatcaagcagaagaaaggatatcagagatgaagatcaacttaatgaaataaagcatgaagacaaggttagagaaaaaagaatgaaaaggaatgaacaaacctccaagaaatatgggactatgtgaaaagaccaaacctacgtttcattggtgtacctgaaagtgatagggagaatggaaccaagttggaaaattcttcaggatattatccaggagagcttccccagcctagcaagacaggccaacattcaaattcaggaaatacagagaacaccacaaagatgttcctcaagaagagcaaccccaagacacataatcgtcagattcaccaagattgaaatgaaggaaaaaatgttaagggcagccagagagaaaggtcaggttacccacaaagggaagtccatcagactaacaacagatctctctgcagaaaccctacaggccagaagagagtgggggccaatattcaacattcttaaagaaaagaattttcaacccagaatttcatatccagccaaactaagcttcaaaagcaaaggagaattaaaatccttgatggacaagaaaatgctgagagattttgtcaccactaggcctgccttacaacagctcctgaagaaagcactaaatatggaaaggaaaaaccggtaccagccactgcaaaaacacaccaaactgtaaagaccatcgacactatgaagaaactgcatcaactaatgggcaacattaccagctagcatcataatgacaggatcagattcacacataacagtgttaatcttaaatgtaaatgggctaaatgccccaattaaaagacacagactggaaaattggatagagtcaagacccatcagtgtgctgcatttaggagacccatctcacgtacaaagacacacataggctcaaaataaaggaatggaggaatatttaccaagcaaatggaaagcaaaaaaaaatgcaggggttgcaatcctagtctctgataaaacagattttaaaccaataaagatcaaaaaagacaatgaagggcattacgtaatggtaaagggatcaatgcaacaagaagagctaactgtcctaaatatacatgcacctaatacaggagcacccagattcataaagcgagttcttagagacctacaaagagactttgactcccacacaataatagtgggagactctaacagcccactgtcaatattagacagatcaatgagacagaaaattaacaaggatattcaggacttgaactcagccctgggaacaagtggaccaaatagacatctacagaactctccaccccaaattaacagaatatactttcttctcagcaccatatcacacttactctaaaactgaccgcataattggaagcaaatcactcctcagcaaatgtaaaagaatggaaatcataacaaacagtctctcagaccacagtgcaatcaaattagaactcaagattaagaaactcactcaaaaccacacaaccacatggaaactgaacaacctgctcctgaatgactactgggtaaacaacaaaattaaggcagaaataaataagttctttgaaaccaatgagaacaaagacataatgtaccagaatctctgggacacagctaaactaatatttagagggaaatttatagcactaaatgcccacaggagaaaacaggaaagatctaaaattgacactctaacatcacaattaaaagagctagagaagcaagagcacacaaattcaaaagctagcagaagagaagaaataactaagatcagagcagaactgaaggagatagagacatgaaaaacccttcaaaaaattgatgaatctaggagctgattttttgaaaagattaacaaagcagatagaccgctagccagactaatcaagaagaaaagagagaagaatcaaatagacacaataaaaaatgataaaggggatatcaccactgatcccacagaaatacaaactaccatcagagaatactataaacacctctatgcaaataaactagaaaatctagaagaaatggataaattcctggtcacataaaccctcccaagactaaaccaggaagaagtcaaatccctgaatagaccaataacaagttctgaaattgaggcagtagttaatagcctaccaaccaaaaaaagcccaggaccagacgaattcacagctgaattctatcagagatacaaagaggagctggtaccattccttctgaaactattccagatcatagaaaaagagggactcctccctaactctttttatgaggccagaatcatcctgataccaaaacctggcagagtcacaacaaaaaaaggagaatttaaggccaatatccctgatgaacattgatgtgaaaatcctcgataaaatactggcaaaccgaatccagcagcacagcaaaaagcttatccaccacgatcaagttggcttcatccctgggactcaatgatggttcaacatacacaaatcaataaatgtaatccattatataagcagtttagagccaatgacaaaagccacatgattatctcaatagatgcagaaaaggcctttgataaaattcaacaccgctttatgctaaaatctctcaataaactaggtattgatggaacgtatctcaaaataataagggctatttatgacaaatccacagccaataccatactgaatgggcaaatgctggacgcattccctctgaaaactagcacaagacaaggatgccttctctcaccactcctatttaacacagtattggaagttttggccagggcaatcagacaagagaaataaataaagggtattcaaataggaagagaggaagtcaaattgtctgtttgcagatgacatgattgtgtattcagaaaactccatcatctcagctcaaaatctccttaagctgataagcaacttcagcaaagtctcaggatacaaaatccatgtgcaaaaatcacaagtattcctatacaccaataacagagagccaaatcatgagtgaacttccattcataattgccataaagagaataaaatacctaggaatacaacttacaggggatgtgaaggacctcttcaaagagaactacaaaccactgctcaaggaaataagagaggacacaaacaaatggaaaaacattccatgctcatggataggaagaatcaatatcgtgaaaatggccatactgcccaaagtaatttatagattcaatgctatccccatcaagctaccattgattttcttcacagaattagaaaaaaacaattttaaatttcatatggaatcaaaaaagaacccatatagccaagacaatcctaagcctaaagaacaaagctggaggcatcacgctacctgacttcaaactatgctagaaggctactgttaccaaaacggcatggtactggtaccaaaacagatatatagaccaatggaacagaaagaggcctccaaaataacaccacacatctacaaccatctgatctttgacaaacctgacaaaaacaagaaaaggggaaaagattccctatttaataaatggtgttgggaaaactggctagccctatgcagaaaaccgaaactggaccccttccttacaccttatacaaaaattaactcaagatggattaaagacctaaatgtaagacctcaaaccataaaaaccctagaagaaaacgtaggcgataccattcaggacatagtcatgggcaaagacttcatgactaaaacaccaaaagcaatggcaaaaaacccaaaactgacaaatgggatctaattaaactaaagagcttctgcacagcaaaagaaactatcatcagagtgaacaggcaacctacagaatgggagaacatttttgcaatctattcatctaacaaagggctaatatccagaatcaacaaggaatttaaacaaatttacaagaaaaaaacaaaccccatcaaaaagtgggtgaaggataagagcagacacttctcaaaagaagacatttatgtggtcaacgaacatatgaaaaaaagctcatgatcactggtcattagagaaatgcaaatcaaaatcacaatgagataccatctcacgccagttagaatggcgatcattaaaaagttaggaaacaacagatgctggagaggatgtggagaaataggaacgcttttacactgttggtgggagtgtaaattagttcaaccattctggaagacagcgtggcaattcatcaaggatctagaaccaaaaataccatttgacccagcgatcccattactgagtacatacccaaagtattagaaatcattctactataaagacacatgcacatgtatgtttattgcagcactattcacagtggtaaagacttggaaccaagccaaatgcccatcaatgatagactggataaagaaaatgtggcatatacacaacatggaatactatgcagccattaaaaaaggatgagttcatttcctttgcaggacatgaaactggaaaccatcgttctcagtaaactaacacagaaacaggaaaccaaacactgcatgttctcactcataagtgagagttgaacaataagaacacatggacatagggaggggaatgtcacacactggggcctgttggtggctggggggctaggggagggatagcattaggagaaatacctaatgtagatgacaggttgatacgtgcagcaaaccaccatggcatgtgtatacctatgtaacaaacctgcatgttctgcacatatatcccagaacttaaaagtataataataataaaaaaaagatctaatggctaaacctatagaaactctagctagacctgtggtttctattccttcctgggtataataataaaggctcacatttattttaagtgttacatttttcattgacattgaaatgagactcccttttcgactaatcggctgctttgatttcttcaccctaaaaatcactcttcaatgttttccacaattcttcaacattagtaataacttcctatatagtatctgtggtcctttttctttccccagtgtgatatatttatcatctattacacaaacttcctcttttgcttcctcccttttcaccaccagctctaacatcttaaattttcatttgacatactgcttacctaaattatttcatgtgtgttcccatccatggaaattcatttttgtgtgacataaatccctaccctactctatttcacagtaataaaactttatactgaattgccaaagagataggtaaccaaccacgcagtttaaattaagtgcaagatacacatgtttgaatattctgctctctgtctaagatgtgtagagacaggtcctgtttgtgtctgagcattctgtcatcttattcaaactgttggagttaaatcacctaagaactgttttctcactttgattcaaaagtaacttctgctatgcaaaaaaagcacagttatgaaataatatgtgtattaaaaaatctcaaaaataatgattagagtcacattcagtctgtgaaaggagtagctccatgacttgagcacatgccaatgagattagaactcatcgggggttggcattctcattgattgttgtccctctgtaccttcaatggtttccagtccttgtccaagttaacctttgctagttgttgtagccatggtaaatatcctgtttattggattttattagcgttttaaattttgacatttggaaaagcacaatcctccttctttttcatcctgtcatctttagtgtataagtgtccaggctccttccaattttaagtttctctttcctagctttagaagattataattttggaaagtcacaattattctgctagttggtggccagaacatatcaattgcatgtaacaaaattttattcagatgcatcattcatacattttaagtctcacggtttacttctttcataattatttgacatttttggtgaaataagtttagttctgaatcacccattttgttatgttgattctccactatttttggcgatacaatagtaataatgttagacatttgtatagcagtgtaaagttttcaaagtgcttccacatacacagctcttatttgcttctctaccttaggacataagcaatgtggtgttatacccattttacagataaagaaacacaggaacagagtattactttggatcacacatggtaagcctcgaggacagaatgagctcctgtgctagtgttctttccattgcatcgtatcattagtaatgtttacttacacctacatacttactgcttttcaaatatccagacgtcatctcctctactgtaccactctattatcactcgtgtcatattctgtttttatctctttgctaaggctatacccacccttccagttccccactgccctcattagactctgagctgctcgagaaaaatgattcatccatctttgtatctctagacccaagtaagatcacaccacatttttgccaagtctctcttgtgctataaatgttcatcttctcttagttgtaaattgctttcaacccaccttttttttttttttctaacttttattttaagttcaggggtgtaagtgcaggtttgttatataggtaaacttgtgtcatgggggttgtacagattattttatcaatgaagtactaagcttagtacctattagtaatttttcctgattctctccctcctcccatactccatgctccgaaaggccccagtttgtattgttcccctctatgtgtccacgtattctcatcatttagctcccacttataagtgagaacatgcggtatttggttttctgtggttttctttggttgctgtgttagtttgcaaaggataatattaccactgaccccagagaaatacaaacaaccatcagagaatattatcaacacctctgtgcacataaactagaaaatcaacccataatttttaagtttatgttataaatattagtattatctgagaggaaggcattacatccataagcagaaaggtggaaaaatcaggagagtgagtgatttatttgagagtatctggtttgttagtgaaagagatatgaaacaaacccagggctcctcatacctaggctacatctgtaacaccaaagtccaatgtactggtaccaaacagactggcacttgtgggatgctgtgtaagcagcatggacagtattcccttatccccagtgcaggctacagttgcttaaaagaactatggaaaaccggacattttgttcccttctaatttatctgtgttcctgtagccatgtctccacttctaaacgctaatcacttctctaggtgagcttaagtacctaattattaagagccctccaaatttctagtgtcatcttcaatatagttagtgccctttctgtcccatttgccccctgtgcttggcactgaatcagtatagcaaatatccctaatgaagaatcatggtacagggttaaatttacaaattaagcaattcctttagtttttatgtcaattccttttatccttgtatccccaccctgcatttgcttaaaattcatcccactgagaagctaaaaaaacaatgctactatgacgatttaaagagaaatactgaaccctaggactttttcctgagattcttgttacctgtaaactcttgaatataggatcagattacctaggcttccagggaatagtaagaccatacattagcagatttaatattaatctctagaatcccagatttacttcttgtccaggttaaatgcccttttgattattttagcaaaaaataatacaaaaaattgattacaaccattaatggaggcttaaaatgttaactcccatagctttaacccagtatctatgattaaatgcaaaaaatctaagttaatgcaatgttaaggttgagcttctaattgcacaaaagtcatgaaatttaaaattaaggtttctagtgctactctctgtcatttctacaacattcctccaatggttttctacaatatatgtttcatttaaatgtgtgtgttgtagagttcccaggaaagaacataaagcacaacagatcaggattcaacttgtggatacctagttttacataatcaatatggctggaaaagtgtgattcttttttaaactacaatgccctatttgagtgataaccatattcctgtttacaaatttgcccatttcctctaaaaatccttgaatcttcacttctgattacacactagccatcccctagagaaggaaagagcatttatgtaataaacaaaccaaacaacctgtggactgtgatagtacctacagaccttttcttcaacatatgacaaagcatattcatgtgggattaatgttgaaagagtaactcagaatatttaggtttatgggtgcatctagcagaacaagcaaaggtgaatagggactggaatcctgttaatactattaataggactagctgaggaaactgtcatcaaattattaaacctctctgaatgttattatcagagtaagaatacctgcttgtaggattattaggaagaacgagtgaagtaatatatgtaacacatgctctttaaaactctcttggagtttatagtaatagatcaactattactattaaagaatgagtaatcataatttaatgatcatctggatgtctacaggtattttggaaatatgaaacaatgataatttaaaattcattttattgaaagatacctagaattatttttttcacaatagtttcattaagttaggtatttgtttatagcctactatggaatgcccagataacatttaatacatgatgcactgagctgcatcagctaactctgaaggcaggtgagttaaatgaattcttggatattgggctgccatgcccaatattttcttcaaattttatgaaacatttgtgtctaaatagaaaatgtgcttgagaaattctagcccaacatgcaatttagagagaaagttataaatcataaatataagagcttagagctaaagtgccacctcaaccataactataataaaaactcctaagtgcattctggcaggaataaataaaaaatggcaaagcctgttgtggacggtgcagagcccaggaaggtaaccaagtgagtaaacagctaaggcaggattatcctcatttgggaggactccattccagacaggaattaaagaggaggggctggggaagggagaatggaggttgtgggagaaagtgtttttgcatttgaaagcagctaagttaccttgtgtaatgaaaaggaaatttgtttttttcctttcaacagtaatctcatttgaggtctagcagactgctacacaaaagatacatgtgttctacctacttggtttttctcctctggcagtgaggtacacaggaagggttcaggtgaatcagaaccattcagaataacatagtcaaattcctttccaaaggtttaaatacctattctttaatagctttcttcaaaagactggtaacttactgcactgttcctggcacattcacaaccaaaatttgttcctgggagtactataatacgatgcaacaaatgggtttaaacgaaagctggaaagatctatactgaaactatgaatcacaattactgaaagcaaaaaaatctcatacacatataatatccagaaaaacatacaactgtcccttggtatcctcgagggactgattccaggaccccactgcagatactaagacttgcagatgctcaagtccctcatatgaagtggcacagtatttacatataacttatgcacatccttcccttatacttctcaccatctttaggttacctataatatctaatacaataaacactaggtaagtggttgttatagggtatttttaatttgtcttttttttggtatattgttattttttattgttttttttccaaatatttttgatgtgtggttgattaaatctacaaatgtagaacccataaatactgagggctaactgtataaccaataatttctgagtccttttgtctctccctatgttaaagcaatggtgtagatgagatttctctgaatagaggggagcagctggaccaataagctgcattatcacttagagttatcaggactatatcaactgattcaagccttagcccccatctccgacttgctgtgatatgcaccaagttgcctttcttcttggtactttcctttcttaacaacaactagtaaattgactataaaacccttggctactataaactctattagaaaactggctgtttccagcatgagccaaggactctagctttccatactcaaagatttatatttctcaagtttcttaacaacattggcatatatttattacaatacagtttatacttttaaaatcaagcaaacagttaagattttaatggtcataaaaatgaagaacgcattggctattttctgagtagtgaaaaagttctcttttataatagcttaactcaagaacttttgaagtctttttcttcaaagatttttcatacaaaaattacctttgagagtaagcatgaaaaaatctcaggaagtaggtaagtattgttaatttaaatgcctcccttttcactccaggaaacataaaaccaaatgacaaagtacagatgatttattccacaactattcattgagcacctactattctctggcactgtggtaggcagtgaacaactctgctttaacagtgagaacaacattcttatctcctgtgacccttaaggaaagactagctgtagttagacttactggatttggtcataaagataaattaaatataaagcagtgaccatttaagtttaattatgttaaagaaattttgaaacaatagcttatttaaatcatttaagtatttgtttacaaatttttaccttctttctaaaatgccaagaattgccaaccatgaaattatgaaaacaaatcaataaaaatacaatgatttgaagaacaaatctatttaagataaaaaggcacataacctaacaccaataaaattacctgtagcactcttaaaaactagatttcttctttctttctttctttctttctttctttctttctttctttctttctttctttctttctttctttctttctttttctttcactttctttcttttctttctttctttttttttttttgacagggtctcactctgttgcccaggctggagtgcagtggcatcatcttgggtcactgcagcctctgcctcctgggcccaagtgatccttccacatcagcctgtcgagtaactggaactacaggcacatgccatcactcctgcctaatttttgtatttttttgtagagatggggttttgccatgttggccagggtggtctcaaactcctgagctcaagcaatccacatgccttggcctcccaaagtgctggaattacaggtgtgcaccacaacaaatggccccaaaactaggttttcaaatatgtgagagtatctctcagctatgtcaaaaatcctatgagtcattcattcagtgtttatttaataccaaaacatggaagatagtatgtctaggaactaattttactccaacaataaatctagaagaatgagtacctatttcatgtggttatcatgaagaaactctgtcagaaaactaaaatgaaatggctcatgaagttgacatatgtatgaaaatataagaattctgctcacacctcttctttcttcctgggggcattatccatgagcatcatctctgtatatgaaggacggaaaacccgctttggatatgtatgcttctgggtagtctagtcaaaaaggaatatgaactcttttatctctgaatgcttccaaataccagagaagaatgatttatggagttctgtatatgactaaaagagctgctagtacttttagagtattcattctttctttattccttcttcagggtgatctggaaattgcccttcccaggactttctgtctctcatataaactaccatttgtataccactttttaggttgcaaaatgctttcacatgtattgtgcaatttagttaaaaggcatcagggtgcgaggatcaagaacactggctttggtaccagagacatcagtgtttaccaaagctacttactagtggtacaccattgtgtgagccacttgatcactttaagcaacaattttctcatttgtaaattagggataacaatatccaccttgcaatataaggtagagattagcaatagggcagttaaaatgttattatgattaataacccatagtagggacaccaaggacttctcaatagtctgtttctcttcatcaggctggaggagggggtcttcacagttacttatgagtacatattacaagcttctagttaaagtaatggcctcttcaaatcttagatctgaaccatcttcataaaacagttctttaattcatggccaaaaacatcgtttccatatactctcagagacagagtccttttggagcaagatataaagtttaattctaagtctttttttaaccccgaaactattttccctgaagcaatccatgtgctgccatcagattttattaggtgggctaaaatagagtcagaaggagatttctttacataatagctgtccctacagaaacttgagacagtcagcttaaaaattatttttaatgaagaatttttgagatccataagtacaggaaaaattttgatggtctttctcccttactgattcattgataattctcaaacattgggctggcacaactagagtaaatcggtacatcttacacagtggaaagcggtgggtgtagatgtttttggagccagtcagtctctggcagcggatagagtcacacttgtgctttgttgcccatttacatcttcagaaagcagcctgggtgggcatgcttatcaaatgtgctcatttaaggataaacccatttgaatattataacaacatttggcaaacttcctctaccgaatggtggacctggcccactacctctgaaaactattgcctggccaggcaacataggtcctttgactttctttacatggtagaacacatctgagaccttccaatcaaacacccaggaggagtcctgagtgctttacctgttcctcaagcattctgaaggttctagtctggactagtgggttatggatatatggatatgcagtgagtccttccttttgcaacatacaccttttttttttttttttaatccagactggagaattcaaatgccttgttaatatctagtggtcacctttggcatgaagaagtcagcaaacatttactgaaaaagttgcacgtggagaattctgtatcataattaaggagatgccctccactccctgaagatgtttataattcttgctgggaatgagggaaaaacaaaacctatacaggcaaaactgcacagcacttatagaccaacacaaaagtgtgtacacacagtgtacaaagacttaagcagagcaaatagggttaaaaaaagaatttggaagaaagtaatggatatacattttccaaggtgagagagaagaataccatagagtggagaaagcataaacaaaggcatggaaatgggaactggaaagcccaccaacttggctaacatagagaaagcagagcagtaaagagtagggggtaactacaggggcatggggatgcatgaggaaccagtttgtaaagattaccaatgctaagccaaagctcttgttcattccattccagggaaacagaagttgatggagaccttggagttgggaaagaaaaggaggccaagaaggataactggtagtagagtggccttacagctagatgaggaattcggattctagtcttcaggtagaaaagcagcagtataaaatccaaggccaagaaatgagacatagaaaattatgtgtgggagcaggtatcctagatgcttaaaaaaattgttttgtgaagatagtttgaaggaagggtggcctattcaagcggttcagaaaggagataaggggccacttggtctagtgtcagcccttgaaaataaataaaagaaagaggctgaatgaagagatattactgggtgagaactggcagaatttagtgactgactgaatggtaatgaagggcaaaagaagaaaagatttaaaaatgatcgtagtgctggggcctcaggaaagggtcctatggacagtaattgaaaaagaaaactggtggctagagcagaagatgctctggtcagtggtagagcatcccaatgattaaggggtgtatgcatgtgaatgcatgtgtgttactataggcacacagatttaggagtaatacctcctttgccctaatgttacataacagcttacaattttctttcaattgaaatctttatttcaagtatttattaagtgcatactaggtgtaaagtttacaataagacttgtgcaaggtttacaataagaaaacataaaaaagttctattactgaacagaaactagtttaaactttactgcaacattttttaaagagtgtattttcatttttatattaattttctattatttgtaattcttaggccactgacataacagtgctttcattagtgctagatatgccaccttgacacaatttaaaaatcaataatttttcttagtgtacttggatatcttccttttcctaaatagtggttatgcatttggatgaagccagtgaataagatggcttttggtttaaatttgcacccagatcagtcctgatagaaggccatgtgtttctctgtaagagacacatgtgcatgtgcatattctctgcctcactcagattagccttatggccatggtatcagaactgcaaatagttatattgtggattctttcttgtttgtgggtgacaggagaaaggaaaactcacactttttttgaacaaagcaccatgtagatatccaactgaagtgggctctgttcatcctcaattcaggtgtgatgaaaacctacagggagttgaccttcagtactgaccttttacattatctcatttctctcatgcaacttctgtctaaggatgggaagagacctaagagatctattagtctcagaattacattcatctacaggtgtgccaaaaggatatcaagttttaaaaacacaactgcactatttcttttgtttttctttttattttctttttttttttttctttttgagacagagtctcactgtgttgctcaggctggaatgcagtcgcatgatctcagctcactgcaacctctgcctcttgggttcaagtgattcttctgcctcagcctcccaagtagctgtgattacaggtgtgcatcaccatgcccaggtaatttttgtatttttagtagagacggggtttcgccatattggccaggctggtctcaaatgcctggcctcaagtgatccacctgcctcagcctcctaaagtgctgggattacatgcgtgagccaccacacttggcctatgactggactgtttcttaacattaatataaagcaaaggttgcataaacaatggatgtaggaagctcattccttcataattattaagaactgaaaaggtacattgaagaaaactagccatgaataagaaaataacttcttcacagtggttaaagagaaaaggtactgaaaaaagtaaacaaacatatgaaagcctcttaatatactaaggtattactatatatatttctgacctttggctactgagaaaatgtgaaagatgacaattctatagctattctatataacggcagatgctcctcttattccaggaaacaaaatccttttatgacatttcactaaatatctaatcaaagagtattttatgtgctcatttcagatagtctcattcacttgcccttataactttaaatgagttcttttcttaagcaggccagcttgtatattatttatgataaaatactttctttaagatggattcagtgttaattttgtactatatgacttagtacagtgggacaattacatataacacttcttctatcagccctatgtttctatgttctttattaagatattatcaaagtaatagcaaaattctgttaaatgttcaatgtatatctttactgctaattttttttcaacatggtaatattactggtaccacagtgactcctcatatcttgaatatatgcagtacaattcattctctactagcatcaatttctttttgtaaacagaaatttggctttaacacagcaatttccaccaaactatataagtgctaatgatgaccaatttaggacataaacagtttactactgtcctttgagcctctctcttttttcatttctctaatcatcacactaaggattttttttctagaaagctatgggcagagttgatttcacagagttacaagttgacctttttcttttttttttttttttgactgatgctgttaatagagttttggtgactctatcagttaagaggtataccttgtacctgacattttacttgcttgagcaactggccccaactaactgatttttaatattttgcttttctgtttcctcaattttccttccataaaatattttttctacttctatataacttcttttttatttttttgagatggagccttgctctgtggcccaggttggagtgcagtggcgcgatctcagctcactgcaagctccacctcctgggttcatgccattctcctgcctcagcctcctgagcagctgggactacaggtgcccgccaccatgcctagctaatttttttgtatttttagtagagatggggtttcaccgtgttagccaggatggtctcaatctcctgatcttgcgatccgcctgccttggcctcccaaagtgctggaattacaggcatgagccactgtgcccaccctataacttctttatttattttttcttcccttatcaaattccatctcatttttcttacgcaattaaaatatttcctcactacagtttgggtcagcggtcagtcatatttacatcactttttccatagtttggttgatgatgtgcatagagtatatgcactagccaaactgatccacattcactgtggataggctgaagtccaaattgtaagctgatttgtcaacagctttgagtaagcctgatgccagacaatattttaattcttcagtgatatttcctcttcacttatgaaggaagccttgaagatggcaagttaataagtgcattgttttaactctgtaaataatgctttttggggggttgtctttaaagattctcatttactttttataaagaaagttataatttcttattttctggttccattcttgatctctttattttccttcagtttgtggatttgctctacttttaaaaactcataacttatgagtaattttacagatcccaagatatagtttgtttgttttttgagacagggtctcactctgtcacccacgctggagtgcagtggcgtgatctctgctcactgcaacctctgcctcctgggttcaagcgattctcgtgcctcagcgtcccgagtagctgtgattacaggtatgtgccaccatgtccatctaatttttgtatttttagcagagacggggttttgccatgttggccaggcttgtgttgaactcctggccacaaaggatcggcccagctcagcctcccaaagtgctggaattatacacataagccaccacaactggccaaaataaatttttttaaagaggatactgagcatctgaaacaaggggggtttgtagactcacaaggattaaaaattatttcgattgtctttaaatcgattgttttttaatcgattaaaaatatattcgattgaatatagtgatgcatttatcagtctatcattctgtaaatagtatggaaaattctggaaaaaaattcctgttcacaataaaagagattcaatttgcgtaacgatatttactgtgtgcctactgtgtcctgtcctaagacacagtattaaagttctttcacttaaagagttcatacctagcagagggattagacaaatttatagacaattatgcaaattaagtaataagctttacaaaagaagtgcacaaaaatttattgtgggcgggtggtatatacaagtcaatgactttcgttgcatgggagagctaaagagaagtaagcaataagggcctcagaaagttagaggcatttgggatgagcctttgaggataggtaatatttgatatatggaaatgaagatagagatatacataagcaacaaagtgaagaatgatagattggaagtgggctattcaggaaaaaatgcttttctttggaaaccatggataatatttcagcttctattcttataaattagtctcagcaaagttgccacttatcatatgttcaatatgaagtattttccttgcctataagaaacactacaaggatgtgagtagaggtgaaacatagagtagacgtgtcccaattgtaccccagatgtgtttgtaaacttctaggtatggtttccaaagaaataaagctcacagaacttttattaagaacacttttatttctataaataaatggaaactcatcttcagctaaaaatatagtggcggctcacatctataatcccagcactctgggaagcccatgtggggggatcacttgaggccaggagtgtgagaccagcctggacagcatagtaagactccttctctacaaaatattattttaaaacattatttgggcatggttgctcatgtctataatctcagctactcagggggtgaggtgggaggatcatttagcccagaaggtggaggctgcagtgagtcatgatttgtcattgcactccagcctgggtgacggagcgagaccttgtctctaaacaaaacaaaacaaaacttggaaattctagatatccaggtatttattcactaccacatagcttaactgtatttccttattattttgtctctagctgaagttctctggaatggtcatgaagagagaaaacatcaaagattaggaaatctatcccaaaaagatcacaaaatcaaggacagtgacacctttttgagctttttacttgactcttcctgtttttttttttttccacttcccttagtcattcactaatcagttctgctttagaaccattaaaataatagaaaagttacagaaacttggtaaaatgtttctctggcctatttccaaaccgcccaaaattaatgggaaatggttaaagtcaaaaaagctttttctctgacatggatttctaaacaatataattatggttcactccatggttatgagctttgggagctcccacaaaaaagtctttgctgcagatgtggccactggctgctataccaggcaatttgattcatgtttgttgttgttaaaaaaatatataaaactctcttatgttggattaagaggcttttaagaggaagctagacagaaaggccaggtctctctctatttgctcattcatgacaaaggtggaagcttcaaatttgtgatacatgtgaagaaggtgtctgttacttcgtgttacatttttgccttcagaattattgttttcaatcattctattttatataaatgcacaaaaaataagtccaagctaaactagtgatgctgggtcactccaagaagtgtcctcaatatagcttcacaaatttacccttttctctccaaatccacgtttatttcttgagacagttatatgatgttttgccaagaaagcaactgggagcaatgccttatgtttaactgggcttttagatttgagaagcaatccaatccaagacttcatgataagacttccacagcaattggatattagtgacatataaggaccttaagaactccaccattttatactctatataaatgtatgatgtggtacacaaagtattaatcaatacttcatgagcatagtagctctgtttataccaatttctagcaatgtacattaggcaattttgtagaaaaaatataataattgaaagtataatttaacttccactccatgaacacttagcctcttcataccatcctcttccaagcatttctttggtccttggaaaatcagtgaaaaatctgaaaaattgggattttgtgtttgattatatgtacatttactacaagtatactgggctttccttttctgatgctatagagatgaactatagctttcctaactcagtcttattattagccaggtccagtttatattagttaaaatgaacatcataaatttacagtataacttatctggtacattccttctattgtagtttgaaaatgtgccattcaggactgaaatgacttaaacataatcagattttatttctagagaagtaaagtctatacttctataattctgtgaacccatcagcaattaactttgtcccagtagaattaatatagtgttcaagttcaggattgagtagatgagaagaggaaggaacaataaaactcattcactcccatgctaggttctgcaaaatagcttccatattcccataatgtgatatttatcttccttataatagcacatttaaagtcagtaaccctaaaaatctcctacataaaggtttgcatctttccccttaaaaatgtacagatgagcttgtgataaagagatgatgtctcctgccaaattgtaatatcatatagaccagttccaggcaaagtattgaagaagcagtcaaaacttcatatacctatctatccttgtcagcctcacgtattcatggatggggtcacagcttatccctttattctttttggttagaaagtctttccagatgaggtcatcattttcattactctgtttcttcctctctcactagagtgtctttctaaaggaaaccaaggaccacttcagtgaaatattgaaggcaggggaggccctaaatgattaaaagaaacaaagctttcccatagcacgtgtccttttctttgtaaggagatgaggtaatatataatcttcccacgttactaccacaagggcattttgtggcagggagagatggatttctgggagtgaaatccaactgcaaagcaagggctattttcagaagggcttatcttcaatatcctcatttcagaattggtctctttgctcagagcaataccttgggcaacactgagaactcccatctctaaggtaagaataaaagttatttcctcattgatggaatatctgatgaagaaaaaggaagacaaaaaacaataaattattctcataaaaggtgatgcatatgaataaatgtcaaatccttctagtatttctcatgtggcttgtacacaagacttctatttgatctttggctctgcagtttctaccactagatgacccacatgtgtaatctggataggcagctagtttgcttacatataaattaaatagcctcaagtgtcagcagatctctgtatctttttaatatcccccaaactgcttcaagtaggaacagctacaaagaaccttaccaaaggacatggaattcacacttgccaaagaaatcactgcacgtgtaaattagaaactaatcatcacttcctctctggttacagtggcagctttgcctcatagtttatgttgaaatatacatttttatgaaatatttctcactgtagtcagcatcaatttaggagtatcaaacactaattcccagctccagcataccagaaaactagagacagagaagtgcagacaaagggaattgacaaaggcctggacttttcttatacttgaagaagctaattgtatttgtaaatttctggttaaaaacctgacaattatcagatctgccactgcaaggctattcctcaatttcttcatcatatatttttccctaaagtctctcagagaagtaaagggcttctagagatgaaaatgaacttgacaatcacgttgcaactcaaactgatcttgattcttttcgtcactttttaatttattgcagatggtgtaaatgggatgtttactggttggcaggtaatgagtcttgttgtagataatagtgatggacagaatctcacgcctgtcgacatcccagcatctcagcagctatatatggttatcatccattgctttgaagcacatataatattgtgacaggatgcacaatatttcccccatagaaacgatgattggtacacctgaatctcactagttcacatgtcatttgtcctgattccatcctcactgtccacatgagtagacattctaagatgtgatctaatggaaaatgtaatctgtttaaacatccaaacactcctcttccaaggtatcaccatttatcacaactgtcagtgcccctgtggaagagtaatgaccctcaggcatgggataatgctccatagaggccttatgaatgccactgtgaaacacagaaattgaccagttttcagttgggctggtatgtgcatcatgaaagatctgcacttactcactaaattacaagtggctgtttaccctttatacaataaagtctaggttgggaagccacagaccctgctgacttcaattgtcccaaacatgtgagtactagatttggacctgcctttgaaatggacttaagcagcttgaaactggaagttggatcacagtcattcaaaaatacattgggagataacataggtgtcattgccttccacttttttgcctttttaaaaaatcctctctatcaatggaggataacaacatctcactatccactattagcaattaaaaactaaacagggtaagcatgccagtgaaaagttaactatttgtttccttcttgtaagcttcccttcatccagaagaaaatctggatctggatctgttcatatattgtttctacaaagcagaacaaaggtgaacagttatgtggtatgaactcatgattttcaggtccctcccaatgggtccatttcctcattgacgatttccttgaagtcccctgtaccttcccaatcttatctacattttctatgaagtcaccttagataataggatcacttgcactctaagactgtttacatctcagtaaatgctctatcactatgaaagtttcatctaaaacatatctattcctcagtgctcagacaccctgaagatacccttcaggatgtagcatccatatgaagtcacaaaataccagttgatcttcccgtggaaattgttttccaatctgtatgaattgaatggctcaactaaataaatgaagaaaatgaaatattttactcacagtgattcattccatattaagaaaatacactaagtaatgaatggcccctatgaaatcattacagttatgagcatcttttctacttgacagatctctgttcccctcgcagatgagttatgccaacctaactatacttttggtattcacaatattctgattattagtatctccaaagatgggacttaagacactttcctgagaagagaaatttacaattagatacatcttaacaattaataaaattaatgagataatgaaataagaagctctcagtatactgctgaggatgcagaaatctttttgagaattaggaatgttctagaagacaataaaaaagatcagattgtgaactgagcaaaacaacctttgatgtgaagtgtcagccagaaatgtcaatccaattcaagactgcatacaaaggggcactgtgtctttgagctgagaggtattatgttacctgattatcttctctggaagaatgcattatggtttagacacttttattacctgaaagatgtagacaaattagggaagattaacaaccagttttattaggaagtagcagatgagctggtgtgaatggtactggttgttatgagttctgtattctcttttcagctttgatatgctctcatgtgggaatagtcatccttgaaatttagataggataatttatattcttttccccagagaaaagacagtttgggaatgaaagggaggggaagtgtttaaaacagcacaagaacctgggataacagaagggtcagaaattctattatagaatttttcaactcccatttacaaaaatacaaccaacaataaccagttcttaagcctttatttgaataagctcagtacatttagtatttgcagtatgtttttcatatatagtacctaattgtttttggtccacagaataaggctattctatgatactatgttattatgttcatgttttcctggaaatataatttgcaaggtcattctaggaactctgattatgaaattcaacatcactttaagtcagttaccctgaactctaatgcagtttcttgtctcttcatacttaccctggagctataacctatagtcttatagaagtgcccttttcaaaaaggctcccactccttgccttctgaatgactgtctagatatattttcacctgtaattgcatactacaccaaatttgcattatatatgaatgtgattgagaaatgattaagataattgtttagtttattagtgaaaataagtggtatataagctaaaataaattattatttttacacatggcattattcctagttgtatttattatgatttaccatttactaaagtatttcagttggttgacaaggaataatagcactaaacttccttcaagcaatactggtgactcactacagccctaatgttaatacattccctcagacttaatcttttaattctattgggaaacacctataaacacaacagaattttttccttttctgatgttcattcaaattacattacctatttccaccattcagtgtagtaatttctgggaactaccttgaggggtggatggtggtaaagaatcaggacatttaaacttctattaaaaagggacagaagaagactttaggtcacctgtgatcttaggcagctttcaggaaacagaggaagcacacttgtgatgaaccttcataaaattggcccatattcccaataattcccttacctattgagattcctggttgctaaggactttatcagttacttcaacaatcctccctccccgctaataacagtacctcatttgcgaacaatactggactgtactcacaattccttttccccttcctttcagaaagaacacttttacgcccctaaatagtcctataaatggccaaagacataggacatgctacatgattcatctcatgaatcagtttctgttctcttggctgttcaacaaaagacatttcaaattctccacgaggcaatgtattacactgccatgagattaatttctgtcttcaactttggacatttcttaactattaactgggattacttcctttttgctcctctacaacccattctctacacagaaactgtagtgatttctttcaatgtgacattagattctactacaaaaatcaccaatggctgcttactgtaactagaataaaattcaaacttctcactctacagcctatatagtctggttcctgattccttctctgaacacatcaccagtatacttttccttattcactgacctgtcataattcacatgcctagctcacttgagcctcaaggcctttgaagttgctattccaatttgcctgaaatgattttccttcacatcttcatatggctagtttctaacatcattcaggtctcaaccaaatgccatctccttacatgccatccgtgtgagattttactcttactttcttcatttcattcttcattgtgtgttagtgagtttacatgtttattaactatctcccttaactagaatgttccagaaggaaggaggactttgtgagttctgatcactattgtatttccagtgtctggaatagtaggtgctcaacaaatacttgctgagtgaatgaataaattaatgaccaaacagtaaataaatagtaaacaaggccaatatcaatgctctttattacagtagttatttaaatgtacctcaaaatgctctaaaaataaatatgtgctttccctgcacattaggattaaaagtactcattttactaattaaaagccaggacctcaatttacattaatgactggtccaagatcatatggtaaatacgtattgcacaattctggtctgaaatcttgttagcccagtcagtcctacagtgatttacttagaacacaattgtgaaccaggtataattaatctgaggtccaccaataggcttgagggggtttgtgaatcctttgaaaaggtattgcaccctcttttgggaagagggtccatagctttcatcatattatcaatggaagccataaactaaaagaggctgggaatctctttaagcaataccattctgaaacaaattattcttaacctccctaggtagattggaaggctgctggcttcaacattttctgtagagaaggaacacctatgaaaatcctatcactggctgagtagacatattttcctttccagcaccaactctggggaatggtgggcctcacaggctggctaacccttcttggagttcacgggaaaaagatgtctagttcaaagacgatgagaagggaggtatcattctaatcatgtggaaagcccactgtgcttttagtttgtgtttgtagcattcttagcttaatttcagggatgttattgtagctgtgaagattagataataataagaaaaactaattcttaggcaccagacagacaatatgaaaaaaatatataattctaaatgtaggtcaaattttatatttatcagcattgatgcagtgttgttttggtctgttcttaaatttttgttttatgaaaaacaatgaatgcaataatcttctaatacagtgattaagaaacagtgtatatttttccacatactatcaaagcagagtaaagagtgaattttgccatgggaaatagtgtattgctacagtaagtaagaatattaagtttaccaagtttttctagactgaagacttaacaataaataaggcacatcttccctgtaaggtttctcttgagtctgttacttttcagtagatgatgatgatgacagcaacagcagctaacatttgttgcttattatgtaccaggtcctgctctaagtgctttacatttattacttcacttaatcctcccagcaactatgtccatgaattaggtattattattatctattcttagagatcaggaaagtcagatgaggggttatttaacttggtaatgaggggtaaaaccaagattcatatcccacctgtctgatgccatgtccaagcctttcaccactacactttcctgtctccctctgtggtagtgcagggatactttggagatgtaacacatcttaattaaaaatactttattgctgaaaagtgctcaccaccctctgagctttcaagattaccatctgagtggtaatctttttgctggtggagggtcttgctttgatgttgatggttgctgactgatcagggtggtggtttctgaagcttggggtggctgtggtaatttcttaaaataagacaacaatgaagtttgccacatgattgactcttcttttcacaaaggatttctctgcagcaggtgatgctgtttgatagcattttacccacagtagaacttctttcaaaattggagccaatcctctcaaactctgccatcgcattatcaaatgagtttataaaacattctaaatattttggttgtcatttcaaaaaatgttcacagaatctttaccaggagtagattccatctcaagaaactcactgctttgctcacccataagaaactactctttacctgttcaagtttgataatgaaagtatgaaagtacaacaattcagttacatcttcaggcttcacttctaattctagttctcttgttattttcatcacattatgtacagttacttcttctactaaagtcttaagtgcctgaaagtcatccatgagggttggaatcaacttcttccaaatgcctgttaatatttatattttgaccttgtcccatgaatcacaaatgttctttatgacatcgagaatggtggatactttccagaaggttttcaatttactttgcctatgtcgatgatagaaatcactatctacggtagctatagccttatgaaatttattttttaaatataagacttgtaaatcaaaattaccccttgatccatgggctgctaatagatgtcgtgttagcaggcatgaaaacaacattagcctctttgtacatctccatcagagtttttcggtgaccaggtattgtcaatgagcagtagtatgttgaaagaaatctcttttttctgagtggtaggtctcaagagtgggcttaaaatattcagtaaatcatgctataaacagatatgctcttgtcctggctttattattccatttatagagctcaggcagggtagatttaacataattcctaagagccctaggattttctaaatggtaaataaacattggctcccagttaaagttacctgctgcaccagctcctaacaagacagtaagcctatcctttgatgctttgaaaccaggcattgacttctcctcaatagctataaaaaccctaaatggcatttccttccaagtagaagactatttcatctatattgagaatctgttgtttaggtcagccaccctcatcaattatcttagctagatcatccagataacttgcttctctatcagcacttgatacttcactttgcacttttatattatagagatggcttctttaattcatcttcatgaatcaatctccactggcttcaaacttttcttctaaagcttcctcacctctcttggtcttcatagaattgaggagtcagtgccttgctctggattaggctttgtcttaagggaatgttgtggctggtttgattttttttttttttttgagacggtgtcactaggctggagtgcagtggtgccatctcggctcactgcaacctccgcctcccaggttcaagcgattctcctgcctcagcctcctgagtagctggaactacagacacgtgccaccacactcagctaatttttgtatttttagtagagacggggtttcaccatgttggccaggatggtctcgatctcttgacctcatgatccacctgccttggcctccaaaagtgctgggattacaggagtgagccaccgctcctgtttgatcttttatctgcaccactaaaactttctccatatcaacaataaggttgctttgccttcttttcattagtgttttcactagagtagcacttttaatttccttaaagaacattttctttgcatttacaacttcattactgtttagtgcaaggggcttagctttcagcctttctgggccttcctcactaagcttaatcatttttagctttttatttaaagtgagagataacgtgactgttcctttcacttgaacacttagaggtcattgccgggttattaactggccttatttcaaaattatgtctcagggaacagggaagtcccaggagagggagagagatgaaggaacagctagttggtaaggcagtcagaacatataaaacatttattgattaaatttgtcatcttatatgggtgtggtttgtggcacctcaaaacaatcagaatagaaacatcaaagatcactaatcacaaatcactcaaacaaatataataatgattaaaaagtttaaaatattgccaagaaccaccaaaatgtgacacagagacatgaagtgagcacatgctgttggaaaaaatggtgccaacagactcaatacagggttgccacaaactttcaatttgcaaaaaatgtaatgtctggaaagtgcaataaagtaaagtgcaatagaaagaggtatgcttctatatcctattttcaatacaaagatgctgggtagccaatttctaccactgtctttgtctatttgacaaaactttcccatgacttttatactgttaacttttttgaatagcagatgagacacatacttgcatcctcaaatctgcaaagacaccttgggccagtttgaaccgaatcccatttttaactgaaaatgatgaaaataaggtacattattagcctgaactttgcataactctaaaatgtattaatcttcggtaaaaattttaatcttagttttagaatcctcatgaagtacttagaatgtttaaatgagataacactgggtatattaaacattatgaaattgccatttctgtagcttaaaaatggtcaattgttgccacagtcaagtgattaaacctaaggtaagtaatcaacttaccttattaagttaactgctattgttgtaagataaattattctcactctacaatcctccctccctgaaaacttttctagtctggaatgtactgctgataactagtgctagggacatagggttgaacttgcccatgattttaatttgtaatacataggcttttaaaattcatatcatagcaggtatacctccaaatgatgccacaaagacagcctagaaaatgggccttagaagattaagttaataaaggcttattatttttcctatagctggatgtactcttaactagataactttcaatagaaatcaagttcatgaagcaggttcatgggaactgtattagtttcctatcgctgctgtaacaaattagcacaaacttatagttctggaggtcagaaagtcctaaaatcatggtatcagcagagttatgtttttttctggagtctttaagagaaaatccctttccttgagttttccagttattagaggccacctgtattcattggctcatgatctattcctccctcttcaaaaccagcaacgcagcatctttcaatctctctctctctctgacctctgcttccatcaccacatctcctctgtgatcctcctgcctgcctctttcctttaaacggcccttataatcatattaggcctaaccagataatctggcataatcttcccatctcaaaaatccttaatttagtcacatctgtaaagtctctttgccatctaaggcaacatactcacaggttctgaggattaggatgtgaacatcttcggtggggtggggaggggggcattaatctgtctgtcacagagaccgaaatattctaggtacccaaatttcaaatagcaagcaagatggtatcttatttctttaaacctcatagcatggtaagctgcacagacatttttacatataccctcataatttttaaggagattgtgatgtacaactctccagtttctcttctggcacaagtgtgtggaaatcatggtcttagctttggtttgtagaaccagattttactcctttacccagttttagtcaatcccatttatatttaaatttgtcctttttgagcattcatactgctatccttagccaaagaattattagtacagtaagtgctttctgcacttccttctcctaactctaggaataaaaggcacacgtgtttagctgagaaccaaccaggacagaattctagcacttctcattacatctttcttgtgctcttccttcaggcactacattgacatctcaataagcaaataacaccagcgttgcaggtgttaacaccaatgactataccatgagaaattcccttatgtcacgccttgcatgggtaaagttaactcaaatgtcttccttctcttacctaaaatatctgcttgcctgacctacatctcccttgtccattgtttccaatgaacactaacccttaaacatttaagcctcatcagcacatgcccatcataacagcataacatccttgtcctgctggaaactattcagcatccagaggaccatctttatgctgataacactaaaatataaaataatgccaacagctggtgctacaaatggcttttaaaaacgatgttcattcactaaaattcctcttgctacttttgacatgaaacacgcagtctctaattattctgatcaagacggtgaaatacaaaaacaaactttaattgtgtttaacagatatttaatcaggactcactgaactacagattaaagctgaaattcataaaccataattacccgattgtcgcaatcttttggtccacattctccttccgtctgggcgtctggcaccttgccccgaatttcttttactgtcttctcagcttcattactgttcatgttttccagcagagatttagcacagattacaaaatatctgttcttggcaactttcttcattagctttttctccccccttgcaaaaagtttattttcttttttctaccagagtagctggaacaggcatacgtttagggtgctttgatgacacaaactaattatatagttatcaggagataatacggtagcgataactaaagttactacagttatcatgtaggtatcatgcaatttctccagtataccatgcggtgtgtcccagtcaccacgtaattacctaatgtcactactgcattgtttcatggaaaatgcttatctcaccccaacaaaaccttttctgccacatttagagaaaaaaaaagaagtgaaattcttagttctcatatccagtactgctcattcccagtaagatgttgtcatgcaaatgtaagggaaacacctgccctctcctgaaaatttgctcttacagggagcaaatggagcaattattattattattttttcctgcttcactctttccaggtaaaagaagtaattaccaacaatacatacattttttctttttttttctttttttaaaagaaaccaatccccctaccgacccccgaaagaaacaccctatttacttaggattcgtttagtctggcacttcccccctatactctttcctttcaaatttcagtcactcacatttgtttttcctagaattatggtgtaaatcattcttaacaagctaacttgaaacttctctcactcagtagaaacacaaaatgccactgtaattgaaacacggaagcttgaaactctttctaaccagttcttttgggccactcttcagaagggcatgccgagtttccctcacagtgcggtaacccctgggtcacacagcgaggataacatcacagaccaaggcaagaggataaagagaaggcactggctaaagaagaggtgggtggttcctttattccccccagttgggcagtcaaccctatgaagcaaggactgtagttgctacttatttatctcaagttgatggcttgaagtctgacctcactaagacctttagatgtgacataccacctgagagttccagtttaaaacaggatgtagcagcttcctttgcagcacaagttgaaagctatttccaattctgcttttattagtcacctcccaatctaagagctgcccattcaattgtacacttaactcatgtcggggtaaaaagcacctccagatttagaagggccagaaaaattgctatcctatcctagcacattgttcttcaatcacacagttcctctaaatacagttgacagcctttgagatgcaaaatgtatcactttaatgtagtagaggtccccttcactgcattgccaaatctatttagcagaatcttcttggaataatctgtccctagacctgaggatgcacagtgatttcaagcattttaagctaatgataatggttagtgctgagaacagatgtacctggctgtgatgtgatctattccagtaggcttttatgagctgttcattcctattgacttagcattttatgtctgtgcttttgcctggtgtgatggttgcataggggtgtcatgtgtgtattttcctgatgtgtgatggctgcacagggggctgtgtgtattttctcagtgcaatggccacacagggtgttatgtgtgtgtttgcctggagttatagctgcacatgttattgtgtgacttttctctctatttgatgcttgctcgcagggtcctatgtgtatctttttcttagtgtgatggttgcactcaatgctgtgctaatgatggacatttctagcaattatctatctacagggtcctcgggaaaaaaattgcagtgaaatcaataaacagtgctagacaggcccttgtaaatatgaaatgacaccatgcataaatgccgtttcctactatagcatgttaaaatccaaattctgttatgttattggcattgggataaaatttctatggtccctccatctccttcatatattgcaatcttttgggggaagttgagattactgctggttggagggcttttacacatgcatctatgtaatactactttttgctacattgtcctacacatcatctcttatactccattctgacttatcctggcataatagctgatattctaaaagtgaatatgcctttcatttattccttcagtctcaccaagccctcccccatataacccctacatcacacatacaaaaccccctcgcttgcctccctctctctagtttctccgtatccctcctgtgttcaccaaacggaactgacaaaggaaacaaccaatgaggttaaaatcttttgaaacccctggaatacagatgagctgggaggcatctggaaacaaaaccagacacttgaaatcaaagagacaagtaaattactatcctaatctaggaagaataactaaaggtgtcagtggggttccattgatagcacttggctctgggccagaatgccaagggttcaaactccacaccagctttgggctcaggcccaagacttgctactgcagggtgcagcagcatgtgcagcagtgttaaaggtgtcagccttctgcagagaggttaagtccaagtccttctgcctgtttgtcattacaccccagagagacggagagataaccctagctttctcttcgctgcctttctcaatagaacaggctgaggaggaactagtgctcagcagcagtacttgctagtatgagtactatacaactaattagtaaaattcccctctactgataaggctgcttgaagtatgcgcaagaaaatccactgtccctctccccccacgaaaaacctgatgtttgtcctaaagattcttccatcaatgcaaagagctaagtttggaaacctaaaaccatgtgtctaaaagaaagaaaatgttttcattggaacagcttacatgtctggtacacttgcataaaaactatcgcatagcattttagagctaaaattgctataaaatgcttaatacagtaagagtaattatgagattttgcatgcacagctggtatacaactagagtctcagccacatattcaatggagcatgggaaaaccatttataaaaattcctggtatgccagtttaactcaccatcaacagcctatcaacacttcattctttaagtggatagggaagatatttacctaccaaatgctttatttcttctctcatggatgttatcaatacttgattcaaggaatttgagttattacttagagagtataaatataagctgttaacaggacatgaatgacctgaatgcaagccttctccactgagtgaagaagttacaatgatagtagtaagtaatgaaccagaagaccaaatcattaaatctacttgtatcttccctttttaacctccgctttttgctatatcttcacatattcttatctctcttcatttctctaagattcaaatcctcgggtgagttcctgggtactctggactcccctgccatagcccacctggccttgccttcccctgagtaacaccctgaagacagagctcttcgtttacattttcccccaatcaagttataacaggtatttgttctccattccctttagttccagctacatcacttgaaaagaaactgatttgggtgagttgttaatggttaataataatttaataaagtttatttcttgatgaaaacattgattttaagagtcaaatgaagaacctctttattgtggtcttttaggctctatggaaaatgccataataggtgagatgattctaatcagaagcattgatggatgctccattgcacattttttagccataggagccagtggatagatgggaattcccaggtggacaggaagtttggggtcacaaaggcagcatgacacaatacaaaatgaatttgaacagaatcaggaaactcaagttttaggaccaacaaactttgccacgaagtgtttggcagacattcagtttcttaacctgagaaatgaggcaggccctgggatcagaaactctccatgatcctctctggctcttacattctatgactctctgaccgcagatcagtcaggtctcctggattagctaccacctccagttaagaactaatagttctgaataaagatggcggtcattccacactgagccaacctaactaaagaggtgttgatgtccataggtgagttttacctgtctgcctacaacctgcatacactacttttgagttggctcctttatgctatacagatatttcttagcattttgttttccctcatttacttaattcagcaaacatttaatgagcactttctatacatgaaacacagagtcgatcactaaggacaggactgaacagggcaccatctctgttgcacagatgattttattattcttgtccattctctctctctctccccaccttcacttttatgcataaacacatacttctagaactataaaagtagtatagaaaaaataagaggaattagacttatctgagccagtctgaaatactgtttattttaaacaaaagaatatgataataatttgtgttggcaaaatatatgcattcaattacgcacttcaatagtataaagggtatttctcaacatgtattttgaggtcagtaatttgcaataaggataacaatttgggggaaagaagattataaaggtaaaacattcccttctgtagaatcctgataaagtcctaggataaaatctgtgacttgtgtaaataacctctgggaaagtgagatcatagaattttttttttaagtttttgtttttcctctaaggattttgggttcatatccctccaaattttatttcctgacttaaaaataataactgccacttattgagtaaatattaaattccatgcacttcaaatacattatttttataaatacagtatgaaatacaatatattaatatattgtataatacaatatgatatattataatacattgtaaatattaaattcaatatattattaaagcaactctgctagatagatattattactctaacagacatgaaaactgtgggtcagagagctgaagtaacttgtcaaagataattcagacagtgtgcagagttagaatttaaactcaggtctgtatttgtctatgcaatatggctccataaccatttcttggttctgctgaatctaactttattttaaaaatgaataatcttgcttgaatgctttgttagcaaataaggaaagcaccctttttactcttccttcacattcattcattgcattacatatagtacaatgaaaacaggagatggttaagattttttcaatgcagatctggttgccttttcatattgatttggactgagataattaaatttgggctctcaatcaaagtgaaagaataagctatttgctatctgaataagtatttcttattaattgatcagacatggataaggtgtgttattacaactatatttgtaaggtatgatttatgttgttctactgcatattactctgtgctgtttttcattttcttgcactttggactttttgttttgtttttatgaatttagtcacagttggttgtgtgttgaactttgtaaaaatgtaatactaaggaaattaaaaaaagaaagaaaatattttcaaaatgatgtcaaaatcaaatctacccctcactaatttgatttgtaggaaatggagaacaaagtattagaagcagaatgcttttaaataatcctaattacttcaatgtgcaaatgcattgactaaatcgaagcatgcgtttaacactttgcacttcaattgtgcttattcatctaagttctatagatagcaattctataaaaaacaagagatatagccagccattccatagttattgggggaaaactattgttctaaaattcaagcttacctctcaagtcagcccacttttggactaacgcagatcattaggtcaaagaactcaaaataacataatttactgtaactactcaggttttcccaattgactctgccttccctattctttttttctgccttcagcggggtggggtgaggacgtggaggaaggaaagcttctgttaacaaagccacagagtggaagcagcaaggcttttggtagtcaagccacacagcattaagcagggccaatcttaaggaataatgccatggggttagagtggtttgtgatcaaggctgagatggagtcatgatggcagggtaacttagtacctggtctaggaccagctgcatcagaaccacctgctgagcatgttaaaaagacacatttcagggtctcactccagagcaaaccaacagaattagtatctcttgaggtggaactcagatctccattttaaacaggctccccaagtaattcttatgctacttaagcctgaaagcactggcatatgcacttaagctctctaattctatatccagcgacagccctgctgctacacctgtatactctgtcccagtcttcaagacatatgtgcaagtccaactacttgtcctgggaggcattaatgctaataataatggcccaagggcttagctaggcatgatgttatttgacatgcagtatctcatccaatccccacagcaaactacgagacaaagatgattactattctcatctttcagatgagaaaactgaaattcagagagacttagtaacttgttctgggtgccacaataataactgaaagagctctgaagaactatactactgtactttaactcagccctgcagaaaaatatcttgaaagatgtttacttctaaaggtgttcataacttggtgatatcattattccaaagaaacttgcctagatgctagtaagatagattatggaataacacacaaagtgtaagcatttctacccaaggaacttttccttagattatttcatagagacttaaactctcaaaaactaggctaagaatccttcattagttcgttcaacaattatgcactttgccagaacctgaggtatacaaagataaacaggacatagtctctgccttcactagacttacagttctgaaaaagagacaagcttgtgtacaaatggttctgggttaacttatacagtcagtggaggcctgagggagagagagtagttcattctcctggcagaaggaaaagagggtgaggtctgtaaagttttagttactccagcactatgccattggctaatgtaaggaacttagattttaaagattatatttttacttgtacagttttgttactaaaggggcagactaagttacttgtatatttcgagccaataaaactttatctggttcattctctctggcatcaaactggttttcttttttgggtaaatttctgggtacagagccaagtaagttgttatgtttattcattcttacacagagcaaccgagattctattcttgaaatgagtgcctaataaattttatcagtagtactttattccacccaataaaagtggttcttccttgacatactgtgtcctttattttcacttgtttcaattactcagaatgctattattagatttgcatattttcataagagaaatttagaaattacaaatgattgaaaacaaagaacaatctagattctttcctttgtgataagagaggatgatcccatatacatgtaaatgtgctttgagtatgttaatcttagaaatgactgaagaaaatgacattctaaagaaaatgagggccaggcatagtggctcacgcctgtaattccagcactttgggaggttgaggcaggtggatcccctgagctcaggagttcgagaccaccctaggcaacatggtgaaaccctgtctctactaaaatacaaaaaagtagctgggcttggtggcacgcccctgtagtcccagctactcgggaggctgtggcacaagaattgcttgagcctgggaggtgtaggttgcagtgagccaagatctgacacttcattccagcttgggctacagagtgagactccaacaaaaaagaaaaaaaaaaaaagaaagaaagacagaaagaaagatgaaagaaagaaaagaaagaaacagagagagagaaagagagaaagggaaaagaaagaggaaaaaaagaaaaaagagaaaaaggaaaaagaaaaaagaaaagaaaagaaaagaaaaaaatgaggttctggaacatcgaagttcaggctaatcacttaaggcaaaggtacaaggatccaaaaaagaaaaagaaattatgaaatatgatatgattcagtttggggaaactgaaaatctatgtatcccatattttagtaactgaataaattggaatcatacatgtattcttttctaagttgaattattaccaaatttgagattcagtgtttagattatttactgcttgcttaaaacttttatttttcaaattatcagagtatttttcaagcattaagaaagttcaataaaaaggcaatagaaatatcaagtaattccaccatacagagataactcctctttacatttgaatgtattctcttacatcattatcgaatactttcatttttatatttgggattgttttaggtatatatatttatttgtatcttttggaccaggaatttttagttgtgttattttataaacttttcctaataaaatattgtttaaaataactttaagaactatctaatttgcatatatgatatgtggtgatacatatggatattcaataatttaataatttctcgaattttgtaatttaagattttaaaatcttttttctcttttataaatgacattgtgataaacacctctgtacctaaatctttgtctgagattctatttcctctagacagatgcctagaagtaaaattaatgggtcagaggacatatttttaaagcaaggttctggataacataatgctacattactttgcagaattttgtgtcaatatatagatatccactatcactatgagtgtctatttcactgtaccattaccagcactgaaaattactatttttcataaatcatgactttgaatcctagtgaattatactttttcatgtttattagatatttgtatttcctttcataatttttctctttatattctttttagccattctatttgactgaacatatatctcaatatcttcatatctgttgcttcaacttcatttctgattgtaacaccatagtctgagctctccttaccttgctctgaatgatggcatcatgtctgcctggtctgtattccaggtttctttgattctgatttattctgcacactgatgccgaacagttattttgaaaatatgctttcatcatgtcagtcctgatcaagaacctatgacagctcctggttatttatctatcagctacattcaactgcctcattcaggggaaaattcatcccattcttggatattcccttatgagttctgttgaataatttaggttattgctatatggaccctatatgcacttacgtttttataagtgggtatttctatataaagacagggagacacaatgtggagtactagaatacaagaactggaaagggctttaaagtacatcaaaaccaactgtctacatttataaataaaaaaaagtggcctacagagtttaatgaactacccatggtcatggagccaattaaatgacagaactaggactagaaactaagttgcattattctcttttagtgacttttagatagagaataataaaagtcatttttacaatttaaaaaatagaaacagctaggaaggcagtttaatttcaatctgttgttatgtataaaagattgttaaaatcatgccacatagaaggcttgagtgttcttttaacatgaataatatgtacttcttataaatcaatcaaatgtatcattagaatttccataaaatttgcacatctgcaaatgacctagtttatttatactttgctttttcccttgctaatctatattgttttatttaatctgctttgccacaataaaagcacagtattttttatcctagcatattgcagattttcactaagtttcttaatcatatcaataaaaaatccaattttcccagcaaattcatataaaagatttcttttgactatagttagggatttgaagaactacctttaaaaaataaaaaaaaaaaaaataggaactacttcaaaatgcctctatttaaatagtaaacaacacgaactattgtggaagaatgtgggctgtcatccatttaatatgatatgatgattgctatatatattcaagaatcccactgtatttgccaaatgaaaacttaacggtagtcactggtttagaaacgagagttaccaaatatatttattatttgtggaagaggggtagggcataagaggtaaatgtggaaatagccatgaatggacctaactttgatagaagctcactgatttcaaagggctgattaacaaagcatgtgtttgcctaacaaaataattgacagaaaaggtatttattaaatcataaggtgattcaactgtttataaaatacaaggtttaaacaaaatggtagttcatcagcagcaatgagagctcagctatgttttctttctccgtgtgtgcatgtgtgtaaccaaacaggtccaccattcacttaacactcaaccaatatttattaagcacctactttgtgctagaaaccctctactatccaaaataagtaaccctgttattttgttacagaatactcgactactctggactgctgtaaaataaaaattaataataatttagccgggcgtggtggctcacgcctgtaatcccagcactttgggaggccaaggcgggcagatcatgaggtcaggagatcgagaccatcctggctaacacagtgaaaccccgtctctactaaaaatacaaaaagaaattagccaggcgtggtggcgggcgcctgtagtcccagctactcgggaggctgaggcaggagaacggcgtgaacccgggaggcggagcttgcagtgagtcgagatcgcgccgctgcactccagcctgggtgacagagcaagactccgtctcaaaaaaaaaaaaaaaaaaaaaaaaaaaaaaaaaaaaaaaaaaaaaaatgtatacctgatataaggtgttataacaaaaataataaattgagtgataagaggagacagatgaaacagcatcctaaatttctcatttcatgtaggatactacttcattaatgacaataattaaacaggcttgaatgtttttcagaaaaacaacagtgattattaccgaaagaataaactgtactttaaaacttcaaattgctagattgataaaagctaaaaaggtaatcacacatcaaaaaagacagagagtgagagtgagaaagtgagtgagaatagaccaagcaagcataaaaacatagaaaatataaaaaagatttatgagatagtactagatatattttttataaaacgaatattagttaatttaattaacattaaaaataataaccataataatgttaaaagataacaaaacataatttaaccataggatagcagtttaaggacactagctttggtagcaaaaacaggattcaaatattatttctgctatttacttgttataatctctttcctactggtgtatttatttagactatttacctcaactttctgctctaaaaaatggaaataagaataactgaacgtagaaaggattgggaaaaaataatatgtaatgcttagtgaccagcacaactaaacattcaataactgtaatttgtaatattatgtgttttaaatgatgtatctaactatgtacccatataaatttaaaaaaaaagaaaaaaatagaaaaatggtgctgatagattttctcaatgcagagttgccacaagccttcagtttgtgaaaaactcaatatctgcgaagtgcaataaagcaaagcacaataaaaataatataaaaaacataataaagagagataagaatcaaaggagtattgtccaagatgtattgttaccttaaaaattccgtgaaatataaaatgtgaaaatcacagaaacacagtcagacttaaaaagaagatgattagttacagaaagctactaaaagcagcccatggtgctgaagccataggcctgctgaaatctggatctagaatcacatcgagatacctagaattccagctctttagagtaatgaggtcaaagaggctccatttgaaatggtggacctgaacctggcttactactttatcacgaggctacaaaaatttggccaactactgcctggggaaacagcttatatagggctgcaggacctgagagctggaagaataaagatacagcattatgataaaatattcatataagaatgaagctgaaagctaccattgtaagatctggattgggactgagaagatccagataaaggcaactgtaaaacccctagttagggacatgtgaacaaaacgaaacaaacaaaacaaaacctgtaaaacaaaattctaaagcataaccaagtaatggtaagaaaatcaataattgtaacattcactccagataaatttgattttatgaaattatctgacaatgacctcagcatgaatatgcttgagatgcttagtgataaagtactcatacctaaaaaagaacaagaaatgattaaagatagaaataaaataagaataggtgaataagagtaaaacttaatcagaaatcttaaaaaattaaaaatgttcattaatataaaagtacaataaatgaaataaaggaatttcaaggaaagaattgagtgtattggaaggtaatgttaaggaattcactcagaaaaaaattgtagcaagaagaattaattttttgaaaatgaaatagcaattgagatactaatcagtaagctgattagaaaataccaatgtttatcttataagaattccagaaaaagaaaatggaagtaatgacaaaggaacaataaagaaaaggataatagctgagaattttccaaaactggagtcctgagattaataagtatatcctgagttcatgactaataattcaaaataaatccacgtccagacacatttcagagaaactacaagatatttaggatatagaataacttttaaaagctaccaggagaaaaagcagattatttataaagagataaaaacagattgatagatttctcttaattaagaatagttgacagaacaatagtctaagatataattgagtaatgtctttaaaatactcaacaaaaaatacccagataaattgctatttaagataaaaaacaaaataagtacatttttagttatatgaaatatatgtattacccaaggtcctcattaaataattactaaaaaaaagtaacaagaaaagtgcacccagaaaggaagccacaggatctaagaataatggtaggcatagtaatatctaaaaatattagtaaatataattaagcattgattatagacaacagtgatcaccacttttgaatatggttaaaaacaaataggtaaaactaaaacttcatacacaattatagtaacaagattgatacttaataggtaattaaaagatgctatgttaaccaccttttttatactaagaagaaggtcagaaatactaaaaggtcgattttatattttcttagaaaaatacacagttcagtatacacaaaagaattttagaattagtgctaaagaaacagataaaccacctacagatttcaagccagaagtaaaatccatgtaccagataaaatcacaaaataagctaaaaaaagtttttcaattaaaaccacataaaacacatcattttattttaatgcgtttaaattcagaaataaataataaaaatagagcaaatatgtttacaaagtaaaagcatacccttctaaatacctcaagggctaaaaataaaacagatattatgaaatatttaaaattgaacaaaactacgtatcaaaacatggtatgcacctaatgagaaaccaggagaaaaatttagagtctgaaattcatttttaaagataataaaaattattgaaagtaaaagggtaataattcaattcaagaatctagaaaaagaaaaatggcctaaaaatataaaaaaaaagaaggaatgaaataacgctaatgctgataaaagcagaaagtaatgatttagactacaaataaataataaagtagataagcagaatcaaaagccagtttttgtaaagaagtaaatgaaacagaaaaatgtctagtgtctaataaaaaaaagcagaagggtcaaataaatattaggaataagaggggaacataaggacaaaaaattaaaaatcataagaatatataaataactttgtacaaataaattgaagtataaactgtgaactgtatttaaaaaaaataacttcccaaaattgactagagaagaatcagaaatttcctctgtggttattggtttattctgatattcaagtctgcctacctacaacctactgatgaaaattaccaagttcagatgacaaatactcagaataaaaaatcccaataatgtgaaaactgtttaagatatagaaaaaaatgaaatgttactcagcttattttgtgaggccagtattgtcacagcaaaactctatagtaacagttaagaaaataaaatttaaagattgatctccccatgtaaacatactacatgtcagtaaattaaactcaatagtagattaaaaaatacaccaagagcaagaatattttttccaagaatataagaactgtttaatatcaggaaatgtattaatatcttataaaatattaacatagtagtggaaaattttatcatattattgatgcagaaaatgcattagataaaatttaactagtatttctgattaaaaacacttagtaaactataaatagtttaggaacatattaagaacttccttaatacaataatttcgatttctcaaaatcccaagcaaatgttatgtttctaaaacatttccattaaaataagaaacagaatagatattcttaatgtgactatcctattcacactatactgaggtttagtaatgcaatatgacaggaaaaaattgaacatttaagaattagaatttaagagaatgactgtcattatttactgctgacatacatgttgctgtagaaaacttaagagaatttaccagtttagttattcaaagtagtaagagagctcagcaaagttgctgaatatataacaataataaccaataaacaatgaaatggaaaacagatatgaatataataatgtaagaatctaagttatatgaggaacaattttacaaaataggttcaagaaatttatgatggaaattttaaaacatgattataggatatgaagatgatcacaaatagagggatatagtatgtcactgggcagcaagacacattataaaaatgtcaattctccccagattattttctaatgttaatgtaattacaaataaaattcagcaagacttttgccaaacttgaccaactagccctaaaactcatattgaatagcaaaagaccaagggagctaaaagaatcttaaaaaggaacaaggtagagagacttatcttaccaagtaaaaagaatattataaagctatggtaattaagggttatggtgttagtacaaggatagaaaaacagtccatcggatcaaataaagatcatataaacagatttgatataggcaaaagatggcattataaattagttaataaagaatgactaattttttaaataatgctgggataactgggttatccatatggaaaaagaataaaatagggtgcatgtagggtaccagaaccaaaaataattccagaaggattagagatctaaatgtaaatgggaaatctttaaaactgttagaagaaaatacagaaaggtaaatgaccttggcatgtgaaaggatttcttaaatgacataaaagcacaaattatgaaggaaaatatcaataagcctagttgagttaatattaaaagctttataaaaacaaatactactaaagccacagttaaaagggcacctacaaattgggaaaaaatctttgtaatctctatggcccaaaatatgaaaatccagaatattacaacaacagcaacaactaataccaaaaaccaaatcaagccaaacaaaactcttccaaaataacaacagcacaacaaataacccaacagaaagatggacaaaagatgcaaattaggcaacacagaagagaaaatcccaatggcttacaactaaaaaaaaaaaaaaagttaatgagatattattcaattccgatcagactgacaaaaattttaaaaagtctgaccatcacaaatgttgtgaagcatgtggagaagctctcatagattgttactgagaatataaattggtacaaatacattggagggaggttttacaatacctagtaaagttcaaaatgcatatttcttaaagtttagcatttctacttctatgtatatatgtctataaaaatgttaactgtggtcttgtttgtgattgggaaacaattaaaataatgtccaacaatgagagaattgataaataaattttagtaatacatacagaagaatacatttcatataaaccaaaatatatagcttatgtaaaactaattcatgatgatagaggttacagtggttttgcttgttctttaccttttgttaaaactttggaaaatttcaccttcaaggggcacatacaaaggattcttcttaggtattataaatattctgcaccttgggttgggtgttgtcacatgtatactcatcaaggtatacacttaatttgtctaattcactgtatgtaacctataataaaataataaaaaataggttcagaaacaaatgttccaaattattaaacttcgtttaacctgggttctggattcttgtatttcatattatcctttatacttccatgtgttttaatttttttttttttttaaagacagagtctcactctgtccaccaggctggagtgcaatggtgccatctcagcccactacaacctccgcctcctgggtacaagcaattctcctgcctcagcctcccgagtagcttacaggcacgtgccatcatgcctggctaatttttgtatttttagtagagacagggttctgccatgttggccaggctggtctcgaactcctaacctcaagtgatctgcccactttggcctcctaaagtgccgggattataggcgtgagccaccatgcccagcctgtgttttaaatattttacattagaaaatgtataaggcaaacaccatagattttcctaactagaattaatcgaggtaaaggaaagcactagtgtcatcttctcttcactatctctgataatagagcccaatattagtaagcacttcacagccaaacatgcctacaaagtgattattttgttgaatcaaaagcaaaagttttcattcacttcttgactgactatagaatctcaggcttccttaagtgagtgaccagagggatatattgttgatatagacagatgctgccaatgcacaaagatcatccatttaggtttttcagttgatgaagtgaggcatgcattgccagactttacttacatgaattaacagaatcaacaggtgatttggtatcagtactgctattggctggcgggtttcacctctggtttcagaaaagaaagagatgataccttttcaatgctgcatttcaagtcaaccatatgaaaagcaaagttttattccagtcacttttctttctctcacattgtggaagaaaagtgccagccactgctactctaaccactaaccatggtacagatgtttgaaaaatgtgaaacagagaaatgaaacaaaaaggaaaccctcaaaaattaagtttcgcataagtgaaaaatacagtatttatgtatcataactgcaaaaagatcaatggacttttttctcatgtattaaacaaaaataaacacaaacattgattttttgacttagtgttttgttgaaaccaacaattacaaggaccaactcaaacatggctaaaagtgggaataaaaataagatttcttttatcctgataaaagattttttatcaccaagaacgttacagtatgacctacttaagtgaatacttattaaagaaacagattcatttaaaaaacatgtttttaggtaaataggaacggtgcaagtgtttctttgaaatcttacaaaagataaaaattaattgaactaactaaggttccttaccctatgcaaataagaaacggcttagaaagaaatgtcttcaaactgttgaaatgtatattccttagttggtgtaaccaatgtgaggtctcagttactataatagcaaatgttctattagatttaagcacatcagtgcaaattattaaaatgagactgtctttgtttaaaataaagctttaaaaaatgtaatgtaatctctgagggagtattgcctgaaatgaaagttttaggccgagctctgccacaatcctattgcgcatcttggttcatctgattaaacatctttgggtctcaaaattcacatacattcacatttctaaagtgagtgtgatataaagtcatagcttgatcatcaaactcctttctagccctaaaattctacgtatctaatgagattaatttatcatgaggtgtttttcttctttcctttgttaatttccttacaataaatagacaaataaatgatcaaataagcaaataaataaatattaaaaagacatacacacactgatagctatccatctgaataggaagaaagacttttttttgtttgccattatctatcccctaatgtgtatttaaaaagagagctcccacagaaaagatttttatttttttctaaatcaaaaatagtgtatcatttatttgccatttaagttctactaagaaggaaaacacaaaatcattatggaaatcctattaggaactttagaaagaaaaagctgatgaaattccatttacaattcaaattgttcattcacgtatttccttttgcagaaactttaaatgctgcctcaaactatcttcacctctttttccagggacaatatccctaactctgttaaaaaaaaaaaaaggctctcttctcacacccttcccacctgtcctctgaggtagttgttccacaaagctaaggtatagattacatcaagagatatttgggatgggagtaaaacatttcaccctggagacagtaatgtgtgcaatttgccaagtctaaaagaaagttaagcctcatcaccactttggcaagaaatgtggttctcatggatggacaatgattatcatttttacacagaacttttgaaaatgaaagtacctggggcaccagccagaaaataagtacgagaatgcaagttttttgcgtcaatatttaaatcagacaaaacactatcagtgtacccttaacagacctgaagcgtctagaaagaatacaaggcagctgacaccttggtgaataagagcagctcagttttatgaaaaggccaaagtcttagggcaaactctctgttgttccaagtgctgatatacctatggcatcaacaaaggcaaaacaccatagggggcaataggcaaggcttctcttacaggcaaggctcctgttaaaggctgggaccctctggactacacactcgaggaaccccaagtgtgggtccctgaggggaggaagtttcctcaaacagaacggcgagaggctgaagttacacagtgtaggagtactccctgctggcagctgaggttggaaatgaactggtgatgtcctagagagggctgcttaaattttctatgaggaggctaatggagataacagtgctcttgaggggacaagagcatgggtctgattaggtttagataactccagatattatgctgagtgaggaggaggttaagggaagctactgatgacaggaactccaacaattgacaaaaactatgtgtagagctggtatatacaattttcatttaagtttcccatctcatatcattctataaagcatacacagccgtatgtgcacatgtgtgtggggttcagaggatgcaggaagaaatctatttctgtgcagttcattttacccctgcaagaacaatctttgaaaccgtctaatgtattcacatttatgttttacaaggaatcccttccatacttctaatggacctgcctggtatgccccctgtaccactatacctaatccctaggcaggtggtctttgtatgggcctggggcaaccacactggtttctccccagtgctctgctctgttagggttcttctgcataataaaatgaaggtcaaaatggcagcctgctaaaagcagcagtatttcagttgcaggaataacttgcttgtcatcaacttgttaatgcaatagtcaaacatttctctgacatgtacagtatcagctaacttcagcagataaagggtctagaacaggaagatgctgcagatgctttagctcggaggaaggcttagcagagccaaaacgtcagcagggcctgtttgttccatactttccatcgggctctgtgaaagaaatgttagattactgcaatgacaagtttgtgacaagcaagtcatttgtgcaactggtgcgctcctgtttttatctgtttaccattcagacttgtgaatgccatttcaagcacttagaggatttctggctcccattaaggggaaatggttcctccatgtttagaattttctacctcaaagagaattactaagcaattatttgttcctgtggtcagtgtcacacaaaagcactcttgagttgtttagctggactctgaatcatgaaatgaagtcctgaagactggatagcttggagcatcaaaaatttcccatctagtttattggaatgactacaaagcaagcctgtgagagacaataaaattatggccagcttgaaataccttgcccttttgctctgggatcatatatcaaggccatatgcttcaagccacataaactcacttgtaacaagtagatcctgagaagctaaggcctggcgatgtcacactgacatgtgatttagcatatgactgttttggtgacaaggaccactttagctgttgagaagagaatttccactgacttctctctataccttgtgggtaactatagggtcaatactaatccagagaacattttaactgtggtaaaataaagtaatataatatcaaattaataactagggccatcctcactaggctgactttttaatagtgaatggagaccctggcagatttgagatcaagaattcaagatcctctcattaggtccttcacctgaagttgctgagtttcttcaagtcattttaacctcctgggacgaaggtagaaaataacagcacatgttcctttccatctgacataaatggtctcagggtcaatattacaaaagatgaagagtgccttcagactcaagaacaagaatgatactctctaaacatcatttattctttctacaattttacatttttgcccattgttggtactgaatttatacataactctaggtataactcccttttttttttttttttttttttttgagatgaagtctcactcttgtcacccaggctggagtgcaatggtgtgatcttggctcacggcaacctccatctcccgggttcaagcgattctcctgcctcagcctcctgagcagctgggactacaggcacccaccaccacacccggctaatttttgtatttttagtagagacggggtttcaccatgttggacaggctggtctcgaactcctgactacaggtgatctgcccacctcggcctctcaaagtgctgggattacaggtgtgagccaccgtgcctggcccaattctaggtataactcttaaagaacataacagaatgaggctttgaagcagacacagatgtacactatctggggaagcaagtcaaagccggaacaggtggaatgtcaaggactagacaaaagtaatgatgtaaagtgaagcagagcttagaaagggctactagagaatgttacagaaagcgataatagtactcattgaataaaaattttattgtgaatgatcctgtgccagacactatgtgtattatacaatttacatgtgtaatttaatcattacaataattctatggcatatgcatgctcaatattttttcagatgtgagaactaaaatgtagggagttaagtacttcacaccataaatatgtaagctgcagagatttgaaaccagttttccattgttccaaagcccatgtactcttaaccatagaagaacgaaagtcatttccactgcctccagaagccttttctctcttgcttactggaaaacatttcagtctggaaatacaggaattcactaatttgatacaaaagggccagtgagaagattctagctctatctgtattgccatccttgttaggcctctgagaaagctgagtttcatcaagatgtcattcctttctccaggcctgacctattcctactttaatgcactggggaagaggtaagtgattctaacctaatcacatatctccgtgctatgaatggagggtgtttggcggcatctccttgtgtccatgacaattcctttctctctcttcatgtgtatagcctttagttcatcctactctttgctcccatattacttccagggggccttcttttgtcacttgtctgctattctgttttaggtgggggaaggggcggacagctttcttaccatgacaaggatcactgaaacagtctcaacttcaaactttgcacagaatgtatcctttgttcggtcttctgctttgtttctctttaatgatagctttgccatgagtcccattcgtatgtaactcagagctatgcaaatcaagctggtaagcaagcatttgcagttactcagtcttaaaatgaatatgtgtccaaccagtggaaacctgagtgaggaatgtctcctgaacattatgtgtggaatggctcctttccttgatgggtggcaaataataaactcagtgagatctgcattatattccctggtctcttttagtgtatgctcagagtgggtcacaagagtggttttagcttatgtaaaattttttcttatagtatttccaattttttttaacttcttgatgtctcccaaacacagaattcttaatagctactgaaaaatccccatgcctgaagaatcctaagatcccagggcaaaaatatggtaaagaacattaaacaacccatggtctgggtcttaatctggtgctcacagtgatcattcagtctctgctgcataccaccagggcacggaactctccactgtaggatacttctttctgttctgttcttccttatgctgaatcttaatccatattagtctgttctcatgctgctatgaagaaatacccaagactgggtaatttataaagaaaagaagtttatatgactcagtttcgcatggctggggaagcctcaggaaacttacaatcatagcagaaggcacctcttcaccgggcaacaggagagagaatgagtgctgagcaaagggggaaaagccccttataaaaccatcagatctcatgagaactcactcaccatcacgagaaaatcatgggagtaactgcttccatgattcaattacttctcaccaggtccctcccacgacacatgaagattatgggaactacaattcaagatgagatttgggtgaggacacagccaaaccatatcataatctatctttctaaaatccccccagtgcgtctagttctttctcaccctaaatttcagttcagagcttcagaaaattattagtttaatgactcatttaatgacaacccttgtgtgtattacataccaacaactgggtttagattgtcctgccttgtccctttctcctcacccaacatgatttaaattcccactctatccctctgacaagccggggagaaataaaagccagtcacacccatttctcatttccatttggatgcaggtagtactggtggcaaagcattcttaatctctttgattttctgtcctattctgtggaaaatctttcctgacaacctcaggcatctttgattgatatggctatttatagattgaccatttaatttattgtccaagcagggacacttttgacagtgaaagggccttataaataattataccaagactacagacttaaacaagaactttcccaggcaaacttacataacaccttgcatatacttttacttcaatacccatctttttgcataaaaactttcatgtctatttttcccaccaacctgtgaacactctttagcaacagaaacatatttttacctatgcagcttcagttcctagaaaagtgcttgtaagtataaagacctgggggtaaatatgtactgacgcacatgcatatgcctatatgcatgtgtatgtgtttgaattgatggtatatttttccataattacattctgtggacctctccccttatttcatagcaaataccaccaacacatgttaacttcatatttttggagatgaatcaaaaatatttcacttaatgccataggaaggaaatggtctgagtatattggtaatgggtttgcttttaatattgacagcaacaaacagaaagtgaaatgtgataaattttccactaaaagtctactgcatatttttttaacaaagcactgaacaataagctttaatcgctttcttcacaagtattataaattgtttcaggccgtgtgcgaaggctcacgcttgtaatcccagcattttgggagggcgaggcgggcggatcacctgaggtcaggagtttgagaccaagaacggccaacatggtgaaaccccgtctctactaaaaatacaaaaattagccagtcatgatggtgggcacctgttatcccagcaggaggctgaggcaagtgaatcgcttgaacttgggaggcggaggttgcagtgaagctgagatggtgccactgcactccagcctgcagcctgggcgaaagactgagactccgtctcaaaaaataaaaataaataaataaatttatttattaatttatttaataaaaaataaaaataaataaaaaataaacaaaaataaaaataaataaataaataaaaatttcagcagctgtatccacaatttcaagtttgtagtaaatgagttattataggaaatgatggtaatttaagagtgatcctttaatctccattaaaatgttggtggcatttctattgctttcaccctcgtcaagcacatttggaagtcctggtaacttttggcagtttttttgcttctgagtaactgtggctttaagaaaaagaaaggtaaggagaaagtgcctggaaaatgtgaaccacttagagaagtcatttcttcccttctcgctgacacatgcagaccattccagaaagatatgactctatactggttaaagagcttcatagaggataatctcacaacttccctttcagtgtttagcactcactattaataacctatctcattatcaaaccttaagattttctgttgcagcatattttgtcattatcagacctcagtgaagaaaagagagaaagccttgtttcccacttctcatcacttgcttaacagctactattagcgctctaccttaacattcctttttccaagataaaaaaagtcaatgtttttgactcttccttgagaatttttttccaaaatgttaaatttaaatttgtttggaggggtttgataattctgtctctctaagatgtttgtattcagtattatctgaaatcagaacaagcatgaataagtatgtaatctatgctcataagaaatcagagaaatatctatatttggcatgcttcttatacattccactattatagctattttaaaatttcagtttgacatttcacactcttgataaactttctataatctacttctagatgctatttttcccacagaggaagtcattctttattttcagtccatcaatgacatttaccaaaccatcacggataatgaaaaatataagacttataagattcaaaagaaacaaagttacatgtctattatttcagagtcttaaatatgtggaaaaaagaagacaatcccacacaaaagaagaaacatggataagcatgctcaggtgtttggtgctagctcaccagctattagtataggtgaactaatacagctatatggaattctctatacaagtgatgaagaagtagtggatgaaatgccacttttgaggtctgctttctctcctgaagaaaactaacaataacttttatttaacaacgttttgtttattcccagttttactgagtgttcatttcagtcctccctctgaagtggttagttatacttatctctcaaattgttgttatttggacactgtacgtaaaagcattgcactttgaaagcatgcatttcttgtcctcaacatctaaaataatgatttgcaaccatttagaagttctggtatcctgttgttaatgtgatttttgcatcactcttccttgcctattccttaaaatataattttaaatgaaaattaatttcattttgaggttttgaaatgcctctaacaataatttagaatacactgaatttgccaatattggaaaacatgtatgtagtctagattatcaagccagaatccaggaccgacctcaatagcatgtcacttctatatctctcaatactgagtctcatctcctactaatcatttcctgagaattctgaagtgctggccacaaaataaataggttagaattttttattttttggtcatttgagacagaattaaaggctctgctggttacgtggagttatatcataatactagctttgccttagttcagcaaaacttacattgggctaagaaagaagataatatattatcaaggcgttgtgtcctggtatcatcaaacgatgggcaaatcgatttcattaggtctctcctaggatatttcgtggaataaaagttagagttctatgtctataacttgcaggatagaattattaaaaatggttgtatttaagtgcattttcccaaatagtgagtttccttttggcagaaaagagacaatgaaggtaaatgtgaaagtatcatcaaccacaaactagtaagctgaactcaagtataatggcaatcttcctgggtgatcagccatagagcaccatttgtgcaagagtctgaatttctatactaacttacttttaaatttcgttgaatacaaacataacaatgtttttaataagtggcttatctattaagtttatagagaaccttccactaaagagattacttattctaatctattcttttgtccaatcttttccccatttttgcccagtgttttgtttatataatattttattctataaaaatctatattatacattttctacctgccttgtctattcttatacattcacaatctattctactcttagtatataatttgaacagattcacatacataaatcaacattcattacttctgggcatataaatggttgctgggtccatgacggctgtttaaataggtagcttccaggccactatgacatagggaaaaactgaaaagtgtatgttttataattattgagtaaaagaggattttcattatggagacatgtacagctatctcaaaggcttatttttccaaaaggaacaacgacactgtcccctgggatatgtgaattgaaaattcagtgtcaacctcttctaaaaaagtagatattttgaggtattaaaaagcgttcttttattagtgataacacctcttacttggggtcgttttgagatgaaagttggcaagtagatttttcaataaggcggggtgggaatcactataaattcataaactaaaaagaagaatgacaatttattggcccaaaaataggggagagggagagatttttttgttcttttttcttttctttttttttttttttttgagacggagtgtcgctcttgtggcccaggctggagtgcaatggcgtgatctcggctcaccgcaatctctgcctctggggtttaagcgattctcttgcctcagcctcctgagtagctgggattacaggcatgcgccaccacacatggctaattttgtatttttagtagagacagggtttgtccacgttggtcaggctggtctcgatctctcgacctctggtgatccacccaccttggcctcccaaagtgctgggattacaggtgtgagccactgcgcctggcctaggagattttggaataaaggtgtctctgtgactaaaaacatataactggtcatagatagtctgtttacctctagtgtcttttggagcaagggtgtgggtctctctgttgagtggtgcctatcattaggcatcacagcaacatcaacaaaactcatctccgtaatatagtagattttacattgtgttaaggtagaccttttaaacaactccttcaagttttctgttgatttcctgccagacagtcagacagctacttcttttttagtaggagtagtcaaggctaaagtcaatacatgtgccttccttgctgagttagaatcaggcatattccatcaacacatatgtcccactgttctcatttctctcactttactatgtgattagtagacaaagtatatactaaagaaagctgaggaagttgctaggatttctaaagaagaagaatccaaatcttgcctactttaggcaaaaaacattttagtattaattgaaaagagatggttaaattgcaacccataaattaaaatgtagttccaaagtgtgtctatagtgatctacaagcaaacataatttctcatattctttttttttttttttttttgagatagagtcttgctctgtcaccaggctggagtgcagtggtgcgatctcagctcactgcaacctccgccgcccgggttcaagtgattcccctgcctcagcctcccatgtagctgggattacaggcacatgtcactacaccgggctaattttttgtattttagtagagacggggtttcactatgttggccaagatggtctcgatctcctgaccttgtgatccgcccacctcggcctcccaatatattattaaaatatattctgcaggctaattctatgttcttatctcattcctgtttcttcctctgctccagaaaggattagtgtctagcataaaacaaacagtatataataaagaacagataatgtatagtcataaaattctgaatccacagcaaaaagagggtaaggtcttagtctagcaggtaagtcttattgacaataataaaggcatgtttctaagccacccatggaaaataccaaaaatgttctctattatatcttgaggtgaagttttggccgtgtaaaaaattatggttaatgctgtgtatgttatgttttatttgccttcattctgggaccacaaaaacggatctaactatagataggggcaggagagcatttgtgtttcttcattagaagctgtgcatgttagtctaatgtataagaattaggaaaacaatactaaatctcttgatgcaggccatgtcataaatccatttatacttatataatattttcctttttcttattctttcaaccttcatgcttcttttttcatttaaaaaactttggggtcagcccttatattaccagatgatttctagtagttgaagcccttgggaaattcatttgtccatccatgctgcctagtttagtacaacactccaaagggaacttccttctaccaaaggcaatgactgattggacttaaaaaataacttctataaatatgacataatatctggaggccacatttatagctggtcaaatgcactgttagccctacaaaaggctggctcataattatgaggcaataacatgtaaatttccctttctgatgagaaactaaaggtcacataggtcctgagttgtattaagactgcattaatactgttcgttagacatttcttttctcagtctcaacaagtcaccttaaaatctatggtatatagcagatcctgagcacctacatgaaaagcaagtactcaaatgttagagacctgaattgaaatcaagattgagatccatccaacttaggagttactgctggttcaatgagtccagggaagaggccatttaatgattcctccaaggaccattaagagttccagggtattcccttggatatctggaaacctgggttacttgatctgagcatgactaaaaactgggcaaagtcttgcatgcttatcctaggttggacacagatctctaagataagactggtatttggtaagctctcatctttcccattccttcctttagagttcatattcctgatgtattcttgtcacaagatacggtcaaggttacacatgggttaagagctcacagcagtccaataacaaacatgttgctgtaatactggtctcccttgtagaccttgaaagtccaatatgctatcatctagggcagttcatgggaaagttgacataataatgcttcaattattcaatttataaatgggacatttaactgatagagtagggaggacaactgagaaacgtttgaagatgtaaatagtttttgtttcagagaacaaccttatctctccaacacagtaatattttttctttgtgtagccaaatttctctaacacgaggctcacacagaagctatagagacttcacctagaaggtctcaatggccttagagccatatatatatttctactataaaacagcaacaacaattttggcccaaatatcataacctaagcaaaaatacaaacaaaatcaaacaaacgaaaactacctagaatataatcttaaaaagtactgcctatatgccatcaccatgtatactataaaacccaccaaacttagaatgcacaatgatgtcatttacttcaatttttataatactgctttttgaagattcctatttttatacgtaatgggaaacatgacatcatataaatgaggcaggcaaacagaaaggtgtagaaggcaaatgcaagatgcctatatattgtctaccaagtgttgccagttgtgaaaggatttgacatgctaatatccattcattcactaagagcatgatggctggcaggctctgcatttaagtgcggttatcgaggcccccaaatattgacagagtgccagattctaagaaactattgatgtacacagccggccacagctccagacacctctcagacagagtctttaaatgtcacagataaatgaattttcatgaaactgagagagaggaagagcaagaggagagaaagaacacagaatgagaggcaggaaagaaacaagaaagaagaaaatcacttccataacactgacatgaaagcatgtggcatctcatctctaaagctcaatcataactccttacacaggatgtgagatcaagccttctgaatgcattgcattaccaaagcactcaaacacttttaatcatttcattgcatggtattttaaaagttaagggagatacatgttacagaatagcttcaacaaactatttctgagcaaaatacagttcaaatataaatacttcccgactcaatcctaaagcaaattaaaaaaatatatatatatataaaggcccacaggcacagataagcattggagccttctaagcagttctccatatgcataaaaggtgaaaagtcaaggtgtcatgaaatctattttatgccaagacacaaatgtgtcctctgacattttcttctccacagtcctactgaaagtagtgacccctagtgggtttattgcacgatattaagggatgccttcttccttcacctctcttttcctgcctttccacagaaaacatctgccaggaaaatatacgagtcagttacttgacacatgataacaaaagtgagccatggttataactagaacgaccaagtattccttagaaatcatgtgtaactcaatatattttaaacgtaaaggaagcttttttactttgaaagttttccatctgctgagggcagcttctcttgaccttgatacactgtgccattgaaagcagtcacactttcaaggttagaatatggcttgtttgtgcatttactgttctatactagagttgtacaatctccacgttttacataaagcgatcatgccaaggcacacaaacaaaattcttcttccaattcaaaagcacatgggtaagttttctgttttggtttttaacctgcagcaacatggtttcacaaagccctagctgcctttttactagcatcacaaaaagccttggtgtaagttatttttctacatctggctctctctgttttggatacatgggactttagcaggtatatacttggagaataaagttccatagctcaaatattcaatagaggttttgtttttgcatcaacttttcagtaatttcttagtacttttcttttttatgttaggagataaaatgaaaggatttagatttcctgccatgggaaaaataattattttccctgtctttaaaggcttttattttgaagacaaaatcagttttaactcaaatggaaattgcagtaaaatctcagacactgtaatcagtgactgcattaaaactctcaagaaggaagccaacttccatgtgaggccacaattcagccaggatcacaaagagacattatccactttgcctgtggccattctgtcattttagactgtaaaatttttatactgtaaaattaaggttcaaggaaatcttctctaactttcacatacatacacataaatatactgatttttgcctgtaaccatataataagcagagaggttttggcttactttagacataggtatagaagacacttaataaagattattaaaatttccttcattatataagtaatagtgttcaccaaatattcagtgattggttaacacaaactgtgttatacaccctacagaaaatactgtaaagttgctaaaaaaaaaaatagacttaaatgtgctatatgacaggatatgacattatatatgctcaatccctcttgtataaagaaaattagtatacatatatacacatatttatgatagataggcatatacacaaacattttcttctggaagtatatgtaagatacttttgatgtatttggggaaaataagatggagaattttacttctaattacatatttttctattctgtttgaattcttcaaacatgtttaaaatataatgccaatagggatatccgagtggtaaggttatgaggaatttttttctcttcatttttttatatactggaaaatttaatatatcatatttcaaaacggaagcatcttcaaaataattatgtaatagtaattcatgttagttacaagaaacttgaaaacactaaaaaagcatgaagtatatcaacaaacagccttgtaattctctgacccaacaataaccactgtcgaatttttgctgcgttgtgtccagtttgcaaagtctcttctgctttgtacagtgtaagtaagaaagatcctttacattcccttaacggggggggacccaaaacagctttatgtgtcatttgttctgctatataccttcttagacaccttcaccaccacaccgtttttagttgccaggacattgttgaaatagcatgctatatgtgacacctccctaaattacacaggttctttattcatctgctattgccccctgaaaaacatgatctctgtgctatttcataatagtacatggcatttcatgatggaagccatggagttgaaggcaacagtggcctcatgctccacaattattatagtatacatactgaaatagtttcgtgaggactcagaaatgttcttctcttctgaatgcacagagatgcttccctgtaaggagctctgtcttagaacttcttcaaagcctaataaagttgaaggaaaaacacagaaaggtgatatacttggtgtgatattttaagcaactgacctattaattataataccttttgatattttctttgctgaggatcattttctgaagaagggtatgaaccttctctttcatgcaaaataccttggtataactgttcatcttttaagtatcttatttgccttttggcaaattaaagaattttcctacctttgttgttgctgttattgaaaagaagataataatgacaataataatttttatagctaactcttattggttgctttctataggttgggcagtttacttacattatttgcatttaattccaaaaatacctctattattattgttgctgttattcccattttatagatgagaaaacccaggcatagaaatgttgaaaaacttgcccaatgtcacaaatctactaagaagtagacgaagaaatctacatcagactcattccaaatcttccttaagattattatctagattagggttacatgactgtactaagaggtccaaaccatgtccagagctttcttatttttctaatactatggggggtgaaggggagtgggaagagaaagagagcgagcgagcacataagattccaaataaaatgttataaaatttatctaagacttcattttcctcacctctaaaatggacagcacccatcacagaggtttatcttgaggaccagttgagataatataagtgaaagcatctagtacaactaaaataaaacaccattattgctctacaagtttccttcctttgcataatggatatgttctggataaggtgattatgaaaaggtataggcttaacttctgttgtcaaatcaaagagcaattacactataaaatctcagagaaggattcccaacagattgagatgaagacctgatgtaaggcaggggttcaggtggaggctgggtctacagatttactgggagcactctgtgggttggtaacacattctagatcctcttacctctctctcctcaggctccttggtctgaaaattcctgagtgtactacagcagtttccagagatgattgctttctttttcttttatctggttacaaagtctagtggaatttatttgcaatgatgatacttcacttgaaggccttatcccacacattatgatataaaatagttagaaattcctttaatgtgagattctcaatcagataaattcactgtgctctatttactctggatgtttggttacaggtttccatcatattattaataatacttgcattaacttcctcatattcattacattgaaaggctctgagttagaaaatatgtattctactttcttggaaaccctacactcactagtgaggcctataaataaaatgaaactttaaatagtacgaacttcaccttcaactcataactaaacccaactctgggcttaaagtgctattttctccctccagtctcatcagatataagtatatcatgttactaactgaggccaagctatatatttacacaattcacttcatactaacaacctgctgcattttgttgcttgccttttcttgaggtactgggacttactcttaaattaatgccttagtttttttttttttctctagggacatccttttacttatggaaaatattcagaaagaatggaatttttaaaataagccatctgctgcgcagacctcaagaaaaacagttatgtttgaaaataccagattcaactaatgaggggcacaaaagccttattaactgtgttagctttcttatctttagagctcaggtaggaagtaagagccgacctcagcatgccaacaggtatcaagtgagagaggtcagcacagtctacacccttatgatatagcttgaacacatcagctcagaagtactcttcataaattctaaaaagagaccttcttccagattatctcgcacatggcagcagcctgggagtccttaagacaaaactctctagttctagaacaattcaaacaaggtgcatttacattatatttaatattttgctgtaagcagacgatagaatctactcaaaactatctctatttcactgtttgcccatattcccatatccgtcctttatttctcagcttatatctttcttgaatttctaaagataagaaatctaatttattcatgtattcattatacaataaatattaagtatctcagaaaagggcaaataaatagatgatagatgattaatagatagctaaatatatagacagataatagataaatagctagataaaacagagatgagttatggcctaaagaaatggctaaggaagaagattgcatattgaggatgttttaaactaggtattgaaggatacttgggatttcaaagtatagagagcaaggagaaatcatttcgagcagaataaactgcatgaacaaaaaggtcatcacacgttgggaaaagcagattatttggtttgtgaaagagagtagtaaaaataaaactgagaaggtaaattagggttagatcacatgagagttcgagtgccaaccaaggaatattactctgtcaataatctaggtttgaggaaagcacagtcaacaactctctagctttcataatttaagtaatgagtattataatccaccaaacctctggtctttaggctccacaggggatacgttagatcagtggtagagaaaaggtcctcatatttaatgagtcctcctccagctgagattatcatgctgcatctattgaagttaatcatctcacatgatttgaacaagaatctcactagttcctaatcacactagcattggcccttcattctcaataacaagttctatagagttacctaaaggctgacactgaggctggctgagatgagagcggtgagtatcccaagcacatgtgagatgtctgtagaaagtttgacataagctgtcatttgattttgaataaagccaaattgttcataagtgattggttacttatatatgtctagttcaggttctccctatgatacagaaagtcattatagtatacgtggaactctgagatctccttacacatcttttaaggctcactcctaactgtttaggattctttgatagaaggtgtttcccagcaccttctgttatgctccctctttattgttctctagtggacttactgacttctgatatgctttgtttttatgtatgtatttgtttactttctgcctctcctctccaaatgttaggtctttgaaaacaaggattatttgaatgtgcctgttttgctcactgttgtatctccagcatgtagaagagatacctattgaaagactgcttttgaaactgaagacaaaatatagaggaaggtaagcacatattaactggtatatgggggaaaaaaggcttctgtataaaactccccccaaaaactcatatgctatataatttgaaaatatcatcagctaattatgtcacggacgaattttctataaaactcaaagcacttttaaattaaaagtatgtattttttcttcctgttactgaagtaacaatctcattctctctattttatacaaagggaaatcatggcagagagagagatactctggagtacagcagatgaattcagagcttctgactctaagggccatctatattctatgcactatttaatgttagtttatattttactaccagtgagatttaagtgctgaattgaatagagtcctagaatttgtaccaataaataatgttattaacttatgctctttctgctagcacatggccttctcacagatataagcaaacaaataaataaagagcaacacagaaagaggaaaggtgaataacttaaaggggtgaacatggttgttcttatttttaaaatccagattgttcattttcgttgtaattgtattgtattctactggcagaaagagatgagatttagtgtactatgcaaattatagtaggtccaccacagcttatcaagttctgagaacagtatggtttctttttcctcagatcctcttttacccttaaaatatcttctggattaaaattctcattcaatgaaccacatctttcaatataaaaaatgaaattataaaagtactaaaagaaaacattagtaaatttctttataatcttggcataagaaaggactttttacctataactcattatctagaagctacatagaaaagattagtaaatctgattatatttacaaacaaacttcagtatggccaaaaaatccataagtaatttttaaaagtgggaaaaacttatgcagctcacatagataaaaggattatcatcttaatgtataaatagcaagaaatacataagagaaagactaacaacccaatagaaagaaaaggctaaggagatgaacagacaccttatggaaaaataaacgctaatgacattaaacatattaaaaaagatggttgacatcacttataattttaaaaatgcaaactaaaactataccgagataccgtcttttaccaatacaattggcaaaaatccaaaagcttaaccaagcactattttatagttgaggcttgggtaaaaaggtacttttatatatgccaatggagctgctaattgatccaactcctgtcgagatcaatttggcaaaacttttcaaaattcaagatgcatataaccctttgatcaataattttatttctgagaatttatcctgcagataaacttgcacatctatgaaatgatttatatataaggttgttcactgtaatattgtttgaaatgaaaaaaattgtttatcaatcgggactgaataaaccatgatgcatttatataatggaatactgcaaaactataaaagagattaaggcagttctctatgtatcaatagcaaaagacctctaagagatactggagaatacaagattgagaacagtgtataaagtggtttaacttttgtgtaagaaggtggaaggagggaatatatattcactttttttgcataaaaagaccactggaaagttacacaaaaaaaataatgaataaaagtggttactaatgggaatagaaagagaaaaaggtggatggggagaagtgaagacgtttttacatagttttgatttttgaaccctggaaatatatagcctgcctcttcaaatatatttaaaatatatgtaaaatatatttaaacaaatatatttaaaaactaaatgaaagataatctcatattaaagtaaaaatgagaacagcatagcaatgataaaaatggttcctgagctccataaatttctcccaacttttagctaccggtgcagccaatatctgggtaaacgtggtaaaaaaaacttggcagtttggtccaaatggcgtctttggagcaaaaaatgattcaggttcttccctttgactttgtagcattcttcagatgttattaaacagttattcctttctaagctcaatcgagttaccagtaaaatataaaatgacattagtgttgcagctgtgaactagttgggatgaatccctttaaaagcctaggatgatttccatgtgttgagtggagaagacctggatgtttgcttgttgctacgtaataagaacaaaacacatttcttgaggaattttaatgtgtaaaattgtttttaaaaataagtaaaatctatttattaattatataatatttatcaatcttctataatacttaggcgatgtactcagtatgcataacattcttaacaggaggcagaatacatcattaggcagatgatgtatgttgagtacttagaagttcctaaaggagaagcctataaagacagtgcattataattaataataaatgtaatagtataatttttttgtaaaataagcaacacatttatccactagtcagaaattatagcttcaattcaataagctgctttctcatgtttgtattgagaatgccatctagaacaatctagaagccacagacaagagcaggggtgaaagctcctaaatttcctatttccgttgtcccatgactttttggtaaaaagataatcagtgaattacccattttgtgtaagaatttcttcctctgggttctgttcttattttaggcaatgattttaaaacatggaggtaggtaagtagggagtattcattcaatcattcatttgtattaattaaacaccaagtatgttctgtgtatttcgctaacattagaaatgcagagacaaaagacataatttttgcccccaaatatttcaatctagtggggagaaaggaaagtaaataaccaactaattataacacagggtgaataacctgctgtaattgacttaagcataaatagctgtgagagaacagaggcgtgggactctgacttttaatgaggaggctcaataacaagttttgaggagtgggtgccttagctgaaacttaaaggatggaagaagttaacaaggcaaagatttgagaggatagaaagggattctaggtataggtaacagaaaaaaaaaagtacagagcaagacagaatatgatccattcatgaactgcaggtggttccagacagaggatagagtgatggttgggaatgccaagaaatgagttttcaggcccatccagattgtgatggaagcactactttagataaggtgataagggaaggcggagatctgaatgaacagaaagagacagccatgaagagcttggtgagaacaacgttcccagcagagaactgtacttattgcacatatatgcctattttaaggaatggttaaagagctaggggaactgattcctggttgtcagagatgagcagcactattccaaatactcttcccctgacaattatctaatctcttttgttgtctctggaagcatggttctttcccatcaatgaattcattcagtccctgtaatcaactctgattagtgttgtttaacatcaatcttttctactttttttcaaagaaagataccaatcagttgctgcacacccctgcttgttaaaagcagcacctctcctgctgacttaccgttcttttaatcaaaagggcaggaggaagcagttgggattcacttttctttttttttctttcaaagtacacaaatgtcaacttccttaaggatgtctggcatagctgagttcagtcatgtaacatacaaagtcagcttgatcaaaaggttgcaggctgcccactgctaaaatggaagagaaaaggaaaccatgggcttccctgaagtgtgaatgagtgcataggccactgccacgtgtgtatttatactgaagacatgctgggctgacaagggagattaggaaacataaatccccaccactacactgctctatcttcacctttgaacctctggagcagcactttctctctttcctatttcttctgttgtgcccagtgaaggagttactatatagctttatagcaactgcaagccatggctatttttgaatatttaaaaaaaacatttttgcggccaggcactgtgcctcactcttgtaatcccagcattttaggaggttgaggcgggtggatcacttgaggtcaggagttcgaggccagccttgctaacatggtgaaactccgtctttactaaaaaaatacaaaaattaactgggcgtggtggtgggcacctgtagtcccagctacttgggaggctgaggcaggagaatagcttgaacccaggaggcacaggttgcagtgagccgagatcacgccactgcactccagcctcagtgacacagtgagactcaatctcaaataaataaataaataaataaatgaataaattcttttgccccaacatttagttgaagtttataattctcaatttgcaatatgaggttataattcacaatatgcaatatgaggttataataatctcaatatgcaatatgaggttataatcatttctatggatttaaaagtgttaataactagaaaaagcataaaactgttcattcattttttttttttttttgagacagagttttgctcttgttgcccaggttggagtgcaatggcatgatctcggctcactgcaacctccgcctcctgggttcaagcgattctcctgcctcaggctcccaaatagctgggattacaggcatgcacccccaacgccgggctaattttgtatttttagtagagacagcgtttctccatgtttgtcaggctggtctcgaactcccgacctcaggtgatccacccgcctcggcctcccaaagtgctgggattacaggtgtgagccatcacgcccagcctcattctcttactcttttaataaatcagtatgtatcatgtgacaaacctgtatctgccaatatgacaaacccttgtcaataattctcctggaagatgcttctggcaacccagaaccagaaaataatttttccaaagagttgattatcttagactaaactaatgactcaagttggttttacaaatagggaacactctgtaaatactcatggacatatctaaacctgaacatacattctcatgaagcacaaaaatcatcatatatggttacagtccccaaacaaggctgcagaagaatttaacattcgtaacaatgtacagctagtataattacattttgtgcaacctcgtaattctttaacagtacaactgaagtgatgagaaggtacatactgatataaggtaacatagctctgtgttctagccaaaactagaactcaggatccattatttttaatctaggaacttttatgtgatgaccatttactaggaagggttgggagtaaaaagcataaggcaattgatatagagaaacaaggatgctttaaaaaaacaaaaacaccagtctaaaagaagactattctttactcacttgaaatggctctgaattcctgggaagagcataggaagaaatgtaactataggatcacttttatatgagtaaattaataaatcatttcccctatgttctctaagaaatcttttagaacaatatttcccaaacttccctaatcataccaattgactagtttcttgtttcagatccaaatgccaaggccccttcgtgaaaatttcttattctctaggtttatggtagactcaggaatgtgcatatttcaagggtgaccctgatgattcttagttcagggatgtttgggaaacactgttctggagaaaactttgtacaatagctaaacatttcttcattcctaatgaatcatcccattttaatgtttctgtggtgtgtcttaagcaggtgcagactctcatagcaaaccataaactcctatgttcctttaaaatagcttaagatacatttactcagttttcaggattagcaaaaagtcaaatagggctgttaactagcccattcccacagaagcaccaacctgtaattcccaagtatcaattctaatgtgttcaaaaataaaagcatatgcttagtcatgtaacagagggtttctttttttacttttatttcattgtctgtcaatctggttgatcagattactaatttctactctactggaagtgatctttagaaaaacaggtctgccatgtttgcattacagagatattaacaataataatgatttttaaaaagtaaaccaaacataaataaacaggaaaagaaaccaccatatttgagtccagtctttgtcctgcctagtgaaacatctgtcttatacctttttgacaggcagaaataagacctttcacatcgcctcatctctctgataaatcagtctatttccttacaaatttggtctgagacaaaactcttctgctcttccacttaccatttagaaaggcacagtcagaaacaccatctaagatgagctcacttctgggtgtctttcagttagacttctattaaatggataacaagaaaactaaccaagaaacaaaaatattcctgtcacttcttttgcaacaattccacaatcttgaggaaaattgaattttgaagaaaagaatggtctatgccatcttacaagcatgagatggaggagcaatgactataaagaatattcgttaattttggttgtactgtagttatattacaaattgcacaattaattcccactatcaaattacactggtaaacaggcctagattaaaaacacaagcctgctctgcttgttttgctctgttatacacaaagtaatcttaaattcagtttattatcattagtatggtttcactttgggggaaaaaaactctttttcctcataaggcatattgcatattgagatgatgaagaccaaagtcaatgctgtagagagttgtagggatataactgctgctaaaataagcacttggtttagtagactatttcccttagacgcttggagcacaataattttttcctgctgggagacaatgtatatcctgaatggggtagggcctgaaagacagtgaaatacagccggaaatacacctgatggcagaatccaccaggatcagacagcatcaggacagcattaaacacagtgtttgaagatagcagaggtatgtggactctcaaggaacactgaaagattacagattgtaggtgagcatggttttgagagtctatctctgctagccacaagaaaattagcagtcaacatttgcaaggtctgtttaattatgtcagtgaccagagctagcctcccaggttaagtgagaacgagaactaacaagctgcccctagcctccttcaggacttaaatgataaagccatggcaatcacagcagcagcagcagcagcaaaagcagcaacagcagcagctgaagcagcaacagcagcagcaagaacatggttttgacccgcagttcttgcccatcaaagagctgtgccctgtctgctcccactgacaggcagataaatacagagatctgttggcaagtacatatttatgtgtatctacagttccctcacacagacttacagagaatgcataacagcttctagtggtataacaaatgcacccactaatggggtgagacccattactcacaaatgggtgaaaagaagcatcaatatgcaggtcttaaccccagtttgtgggcagaaacctgtcattccattgcaggccgataggtctcctattcacacagtccttgtttaattttccaaacaccctttctctaaatggtgctactctgagctgtgtagtgcagacagacaggtttgacaagcagagctgtcaatttcacatttttcatcccaactgcagggcaaaattaggccttgtacgtaactggggttgactggttaggaaggcaggagaggttggcatttaagaggtattttccacattagaaactcagaactcaagatagaaaactcaaaaagggttgtccctattcaacatccatgaaatcaggagagtccaaagatgtgtactggtggtctactgtggggcatatacattttgctgaaacgagaagatgaagggaaaagtaaagcttggtcctatctagaaggagctatgggtaagtaagtagtgaaagacactcactcaaataccataatataaaaatggggcacttgccgtaagagaggaacatagcaacgtgtacacacaattcttggttaaccaagaagttgaatatataagtaatatattagtcaaatttttatccttcaaaaaattttggaattgtccaaagaaaggccaacaggatacatgctaggcaatgatgggtggattaggcatacaacgaaagcaagttaaccagcgctgtttctaacaaccaagtcccagaatatccttgggatctctgggactatctcaagcatataacatgagtctgggatggttttgaaatctctgctagcatatgctctgccctgaggtttctttttggtgctgatttggttgaactgaagaaggaagggagaacacatagaagaagagttctctctattttcaggcggcagtcctatctataccggtggtacagttaagaacctagaatgaatgctcctccagaatcccctgtgcagatcgacactctatggtatatgagatctcacagagtcttgcatatcagaaactcacaaacgggaacacagaagagtctgtgtgtccctgagtttatgctcaagctgtcaaacatcaagagtaatttatgttgttcaggaacatactataacaaagctctcacaggttggaggcttcagtgagcctgagggctcacttcccaacctggacttaccccataaggagcaacggactttgctaacatgaaatcaaaaggcaaaggaaatcaggcatttaggaggtattttacagttacaattacccaatcctaggttggactaggattggggttggtggggaaggagacatggaaagtgctgttaaatgttgtttgaaatgtccctttttgatccccacagtcatgagtgtatttgagtcttgattgctctttacttaaattattgtcattgcccctcagttggcatctctgactaatcccaaccctctcaatctactctgcacactatagccaggttaacttctaaaacatgcctttcattatttttgcttgtctctgtaagtgtttcagttattcagcaaatccttattgcattctaactgtctgatagctattgttctcatcacccacaaaaaataaatctggactctgcctgccttttggaattcacatcctagtcttcaataacatggctctcatttctagtttcactacttcctgtatacaccaactttatttccattggttgatatttttcttcatcctccctacttctctgttttcccatattaaaccattggctaccatctttgcttctttccaaaagaccttttattccattatctttcaacgtccagcttttacatctacagctaaagttctccgtctactattaatcaagccttctatactcctttctaggccaccataatgcagattcttgtagtactcactacctttcgttattgctcatgttggtgcataatggcagattggtaatttccagttagttttaggatctaattactagtctctgcaataagagtataaaaaccataagctctctgtgagcaggtattgtgtttctgatagtaacattattaactgttgtgataactgtgaattaagtttagcatcatacttatttctaaatttaaattgtaccacttctaacaaaattttctccatcgttttattaaaaaaaagtccaaaagaggatgacaataacaggaacacaataaatatatatccacatgtaatggtcagtggtcttttccagtgacaataatgctgcattttgctattagctcctttcttttttacgtgatattcactattagacatactactacactaatgccaacattttccagtaaaaattgacattaattaagctttggatgttgtcagcactagcctagggatagggtaggtttagggccactgagaccaagttcagggtataagatctctgatattcatcaagcagctaagataagaagcataatgaaaggcaaaacaaatggtacaccatatagtatgccgaatatttttaatgctgatttttgtagatagaacttgatatcagcttttactcatttgttattgatatatgtgtattttcttaaaatataataaatatagaaaagggtttgtgaataacataatatgaagatcagaatcaagattagagccaagggcatcagattaaaatgcagatgaataatgaatcacctgtaagattaaagctctaattccaaatggaaagaaagcattggcaaaggcatacaaacatggttctagtgtggtgttcacagttccatgaaggaaaagatgaagcagataggagggtgggcctactgtatggactaggtactggtattaagggttttgtattaggcaagaagacaaaaataattaaaagagtttggactggaagactgggaatgataactggggatagtgaataggatggcctaggtgtacaatgaggtcagcatttagcacatcaggtggccaggactaggacctaaccaagaagctggaaatagaaggaaactccttcattcattatttgaccttacatttttttattgaataatagtagtagactgatctatagacctaaaccagtggatcaacagacctagactagaccatgcttaacagaatttacagtttggagggaaaatagacatgaaagacttaagtaataagatgagagcagccagagacaatgagtaggtaataggagtgaggcccaccaaagaagtgatcatatatcagctacttgaaaccagtggtaaaagtaaactcagtaccaagctcacttcatccaaagcatggattccttatatgttctctgcttgggataatattaagatcaatctgtatgtaaagcttacacagctaggacaagcaaggattcctaggtcgggggagtgtgttcacatatgatggtgtctgtgcatgtaggtttttttcctaacaagtattaaccatgatcctatagcataagagtgagtgatgatgaggaggatgataatggtaatgatgataacagcagctgtttattgagtgcttattatatactaggtattggtttaaatattttacatttattagattacttactccccacagtaattttataataaaaacaaatttatggtcccccacctccttctcctcatccttaatttacagataaagaaactgagtcatgagaattagttttcttaaggttacagtgttgtagaatctacgtagtcttcactcttaaccacactgctctactgcctaaattcaggtaaccaacaaaagagttgccctgcctcatcttggagcttatagatgtctacagaatatattgagaaatatatatgagaaatgatttaaggatattcttaccagagcagtagccattctaaaaattatcacaatggtatattatattgtttagacataaaatgagagtattggggtaacatatatcagagatttggctcttacagattttaatttttaattgtactatttaagggaaaaattgagtattgtgaggagcactggaacaatggaaaaggtaatatggaaagtaaaaagtttagtctcagcctggtaagtgtggctgtctatctcttcaagcttcctttcctcaacggggtgacataagggttaataggatgactgtaaaatgcagttaccttatgaagaatgaaaaatcccattattactgagatttttcaaaccctgataattctgctgggattttctgaaccatgataattctgctgggatctggtattaaacagcatgtagacagattaatcccaagcccagaaaagagcaaacaaataaaacataagtagcataatgactgaagaaagttagattgtagtgtccaatctcatagtggccactttttttgtttgtttgtttgtttgtttgtttgttttgagacggagtcttgctcggtcgcccaggctggagtgtgcagtggtgtgatctcagctcactgcaacctccacctccctcccagtttcaagcgattctcctgccttagcctcccgagtagctgggattataggtgtgtgccaccacatccagctaatttttgtatttttagtagagacgaggtttcatcatgttggctaggctggtcttgaactcctgacctcaggtgatctgcctgcctcgcctcccaaagtgcccaaagtgcttgggattacaggcatgagccaccgcgcccagcctgtagtgcccacttttgacaaagttgattgttcatgtgggagcatgaacatgaaaatttaattacaaactaaggagaaacatacttaactttgaatctttcctattggtttcctggagtcaattttaaagtatcacttaataaatactatttgacaatttgcaaatttatataaatgtattttccttagagtataagcattcaactccaatatgatggtttcctattttcagtttgagtaaatatcaaaatagaatgtccctgttagatatctagggaatcacttttaggggacactatataatgccttactaaataccaagactacagtactattattttcacaagtgagcatgggtcaaggcaaagaagggcaagttggggtaaggatgtataggctgttaaccttgctgcacaggtaaatgtaaaagttccttttttctagcctcaacatgctggaagatcctgactttaaactgagtagagaatgtcttaaagcaaagaaacaagaactcctgtactctgaactttgttggggagttctggccccttttatcatttgatcgtcaatgaataatataactgcgtttagcccttaagcctgtatcagctgcaaacgtgacagatacctgtcatattttagaacagcttatcgcctcagcctctggagtgattgagtatttatagacacaaagatagaaacataaagcacatatgtataggcaggagtcccctggaggtggcgattaggactaggcagtaattttagcttgaagttcctatgacttaaatagccacttgagctctgctcttgcagtttacgatgtcaatagaacccctaaatgaaattacagccttctgatacgcagcaggatatcctttctttgccatgcaatgtacacggccaggagaaattgctctgtatatggagtttcactaaagcagaatttatcataaggctgctctgctaaaatatcattatgctgttattcactggataacacatctaatgactcgaggtgcacttgatagccatgtttcagtgaacacagacgcatgccctgatgtgaactgggcactccagtacttcaaagcactatcgatttcaattctaccataatttacacctggcttgttttgccaatagcttgaacccatgctaacactggaacatacacatacaagctttagaaagatcagaaatgaggtgtatagcaaaaatgaatgcagcaaactctccaggattttgcctttataatcatctcccttgatgccgattaaatattttgcacgattttcctagttaagtttgggcattccctctgttagcattatcctttggttggtgatgatggtaataagaacctcttatatttggacaagctatggacacttctgcagcaggatctgggtgccagtcatcttggttctcccactatctagcacaatgactggcacataatagttgctcatgataatctctgcaggctcctcttcctctctccattccagaaatgcactgtatataaaggaccttctcccttttgtcatctttcaatatatttttcctgagaaatgtccactccataattttaactattaccatgatttggatgattcagatgactgccaaagtctgtccctgacatctccagcattcctgactaaatccaactgccagtctggatgctcccctaacacccccaaattaaacaccttcaaaagtaaatttgtaatcttcccccatcctccaaaatctactcttcctcctcatagcttttcttgcttagttgtataaggcagaaacctgggagcaatccaaaattccttctctccatgcccagcccaaaggttattaaattgtgtcaattttgcctatctcttgaacatatctcctcctctctgtctattcccacagttattgtcctagttcagggcttcattgtttcctgtctgaacaatttcagttgcctcctaactcattttcttgcctctattctcccactcctataatctatcctctaccctgctgacagggtgatcttgtatcacacaatttcatcattaaccttctctacttaaaacctttcaatagctccctgaatgccacaagatgaagttaaaacttctttgcatggcaatcagggtccaacatgattgttccctgcctgcatctacagcatcgtttctctgtactcccctactacacataagtgatagtgttccccagctctgccatgctatttctagttaactgcctttgcccctgctggctcccttactgaatgttcttcctccctctgaccatctgggaaaatccttccattcccagcacggatttatcagctcttctgtgaaacttcctctgatcccccactccaagatatgttcagctgaacactcactgtgcctccatggttccttgaacatccttcagttacggcacttagcataatggtattaccccaacttgtttccctatctgcctctcctctagtgagcaacttgagaccatgttgtattcatctttgtattgtaaatgacaaagccaatgccttcacaacagcatattagggcccatgtgatcagacacccttgtctcccttacttcatctcctactagtctcatgcttacccactcagattctgccacacagacttccttgttgtcactcaaactttccagatacattcatgtccaaggcctttgcacttgatggttccactgttgaaaatgcttttgcttagatatccacaaaacttgcttcttcactttcattgaggtcttttctcaaatgctgtcccccaatgaagacttccctctctacctctccaccctatttaaaattgcaaacttatccctgacacaaacacacatgtatacactctttctcctctttaaattttctccatagcacttatcataaaatgccacatattttacatatatatatatattttatcttctgtctctcctatctagaaagtaactacaaggagaacaaagatttctgtttttttttttctaaatctactgcagtatccccaacccctggaatagtgttgggtacataatatgaattcctcaataaatatttattaataaatgaatcaatctttagcttcttgaataataactgacacagagtagggattcaaaaatgtttctttcctttttttttttttttttggtttgttttttgagacacagtcttgctctgttgcccaggttggagtatagtggtgcaatcatagctcaatgcaagctcaaactcctgggctcaagggataagggatcctcccatctcagcctcctcggtagctgggactacaggcatgtgccatcatgcctggctactttttaaaaattttagtagagatgagatcttgctatgttacccagactggtctcaaactcctgggctcaagggatcctcctgccttggcctttcaaactgctgggattataggtgtgagccactgcatctggcccaaaaatatttcttaaactaaaaaatacatgggtgaatgaatgaattaatgttaaatccatctttaatgaatataatgaagaaacagtctgtgtacagtacagtctgtgtacagtaagttgaatgggttactattatcctcattagacaaatgaaatagatgagtcccagaaaggttaggagccaaaattaaagctactatacatagcttaaacaggtttgctactctttttcaattcactattgaaaggaacagacaattctttgcactttgttcatgatgtacctctgacatttgttatacaattttgcttcctcttgactaggaatgcaattagcaggaggtgcaaggtgctaacactttttattacaatttatgtctttccatattaggtgtttttcataaaaaagatcccctttctttaattttcacaagtggattaggcactcatataattttgcccttcggagtggtttgtacatgactacccaggaggacattgtgttacaaatcctgccagaatgaactggaaggtgagtgcagcattcatagcttaaggatgaacaggttgtttggtgccaggtttgtactaatggagatgttctccattagtgttaactcccaaaggagaataaattcaataacaaaacatttcagtttttggcatttctatggagagttaactttccattgttcaagggttaattatccattatgtgaatcacttttctttctgtggctgcttacatctaggaattcagtttactagagagtgagcagggaaaataaagagacgaaaaggaatattctatatatataaactccaggaaaaaaattggtttaggggacagaatgagatatagtttggggattgctaagttgattgacaattgaaaatgggtaagattaaagcatgttttattatacacaatattttgggttttttttttaaattgtttattagggtcagtttgtagtacatgcagttactctctggatgtgattcttgtcagcacaataccatctagggtgctagaatgggcatttagcaaatggtactttagaggctagctcgacttggtgcccctctcctctgaagaaggcttagtgtgctgcagcttaatgaatgaaacagcactaagtgattccacctatttctctactcattgatgagaaacaactgcagtaggctattttcagctattatttacctcaaacagggcatttaattagtgcttgttaagacagtgcaaatgatttggctgccagtcttcttgcccctgctctttattgtgctgtatgtctgccccgcctctctcctgtctagttcacagggcatccatagccagtcttcatgcctttccataactgacatcagcctgacctccacggatgtggaagtttgaggaaaggaagaacaagtattgacaagctggagggactgttggttaatatgatgcattataggtaagtctggtactttctgactacatgagctgaccaagctggatattcggtcaccctcataagtccaggaaaatgaatggaactactgcaaactgaagatcccatgttccatcagaaattacccaagcattgtggggaaccttagcaatcttagtaaatggttggaaatgctgtcagatagttggaagatctaatgtgggagttaaggaggctcagatatagaagactctgccaatttgtgttctagacatggacatgtttttttcttttcttttctttttttttgagatggagttttgctcttgttgcacaggctggagtgcaatggcacgactttggctcactgcaatctccacctcctaggttctagcgattctcctgcctcagcctcccgagcagctaggattacacgcatgcgccaccatgcccggctaatgttgtatttttagtagagagggggtttcttcatgtttatcaggctggtctcgaactcctgacctcaggtgatccgcccgcctcggcctcccaaagtgctgggattacaggcatgagccactgtgtccggctgtttctttcactatgataagcaagatgtattcactgtcaatgcactgacatgtagatatccattcattcatcacctattcattgatcctccactcagactgagccaatctgacactggttgggagagaaattaacaaacctaaaacacaaaacctgccctctaaccacttgcagtttcatatatagaaaaaacttcaacttaaaagcatatataaatgctaaatgaaggtagatttgtaaaatgctaccagtgtcagatcacttttaatttgggttttatggaaaacttcagagaaaaagtgtgacttgtcaaggatatgatttggctgatcttgaaaagttatcagaaaaattatggttgctgatgctaatatgtaaatacagcatcaaaatatttaacatatagtaaaatagctgagaaactaaaatgggatcatctgtatatgtactcagccttataaaataaaatgaattcattaaacatatgctcaattttaagatatcaattaatttctttctacttaattttaaacttttatatatatagcaattaatattttgaagctgtacataatagaatttaggttgataagctaatatgtatatttgctgaaggataattaccaaacttatcagctaactacatctttctttttgcaaatactgttcataaatatttgtgtaaactttcggtgttgtcagtgtgataaaaagtcagctacatttcatttatggtcattatgaccaaaacatttgactgaaatcaaaggcaagtaagcctggctagaatttggtcatatttttaatagctgaatatagatatatggttgtgcgtatatgtaggcatttataagctaacatacatatacaatcatatgatacaagcaatcaactcctttttaagtttttaaaatatatgtctttcttaggggaatcacataaatactaaaaaccacttctatataaataagaaagaacaatttcttattggggtaacaacaattctgttatttagcaatttgatttgtgtatatctgcgactgcctaattaaatgaatatagcatataggaagtacttacagctaaaatatgcacgcaagaaaatacacatttcacaacatgcatcctcattaatttaatgaaattagaatttccaggtgagcactaggaaattgagttattgacagtgcattgtgaaggcttatgatcaaggtattgaaaaaataagtaatattaatatagccattgaagcacaaaaaatacatcgtcttgcctttgtatcagaggtacactaatcaaattctgacttcttatatatttcaatttagtcatgaaattcttccacgaccacttggaactccaagccttagcaactataagaaaaatctctctggcagattatatttttttaaatgtcatgtcttgggaatactcttaaatatttgttttcacctattctcttcttaaagttgcttatataatttcatatgtagtcattaataacatgttttcaaagtgttagagatctagcttgccttcaacgcagttctaatagacatccctaccagaaactatgagacagttttcctgggagtctgggcagtttgaatattaactgaggaatgttaacctcctatgtaggtcttggtggtaatggcctaagagctagttacattttttataacgtattgtaaacaccatttccctttcaactttttttctttagaaaacaagataactaatgaaaattacccaagaaatattatacatataaatagtatagtcctaacacgagctaactacaataggcaaactttactattaatataacattaaacttttaccatactagccctaataaaactctgagactattttctatcacaatgacagctgatgaatttaatgtgcctcacaaactataggaattgtgataggaagctgactctgtcctagaggccactgacaaacctgataaggctgtagcaggggtcagtctctataggaaacttgggctatatgagcatgtatgagttctgtggttaagaatctgaagcactcagtatagcaaacaaaattccaaagctgagtaccaatgtaatacgctggatcgctgtacctacttggacaagagtacatgcaacaggcacatacaatatacatctggttaaatgtaaaatcatccattgctaaagcattttaaacttctaggagaaatctactggcaatgtgttaacagcaaggacaaccaaaacaataaaataacatctctttcctaaaatttaagaacatcaagtaagtgccccttaggctgggttgtgattcctggaagtttcagcctatgagaaccatattggcgacatcaaagactccccctctttccaaaaagcaattcacttcagatgctgccacacaatcgaatgcttttatggccaccatgtttttttggtttttgtttcgtcttttgttttttccatgcttaatgaacatgccagattcttgaaatagaaagaagatgagaaaacccagtaagatggaatacctctagaaaagaaactaggcagggacctgatggtaaaggataaaaacacattccaacaggaattctacttttagggagagtatgagttattaagaaggatgtggaaggcacattttggctatgaaagctggtccgtggactcctctgccagtctcacatcagacaggatgcaaccatccccactccattccttcgacaacttcccagagcacattcaatcagtgtcccttaaattgaggacaatactatatttgggtttaatactgtgaggacagtcatttagttttcctgtggcaggatgataaatttcctgggaaccaaataaggattctcattgcattcttctgcttgatactatgaatgcagaagaataaagaagagggtgtgacaaatcatattttccaaaggtcgggtgtggggaggttccctaacgtttaaaagcaaccagttgttagcaaagtgatctttagaacagtattagcaagaatgtttgctctacatccactatagatattctctcctgcttagctaggcatgtaagtactgtgagcataatgtaaatactcagaacagaaatgcatggaaagctggtggagtgaaactccaaatgaacaattaattccactttcacttcccccatctacctccctgaatactacctccctgcccccactcacctatcttcctccccccaacaagcatgtttgctaggcatgtcaaggctgacatccatcggtggcagtatgaaacctatgcctacaggctgctcctgagcatagcctcaaggctctgccattgtccgtagagtgctctaagttgtgcccgctaaaaatcttcatcattccatttgactgtttggtagtatttctttaattgtattttttgtttgtttgttttaaaaacaccctttatttcctgcttgccttagagacaccaagaataaaatccttgacacatcaaattctggaacctcaccactcaccaggactatggttcctgatccaaggagtgacgactgagaatcagcacacagtctcttgagggtgtccaggcctggctgttaagctccctgctctgattagtttgtcgagttcacagtgttccagagtgctgaagcacagaaattagggaggggaggtggaaggaaaatcactggagcctcttacgatctaacttccactaactgggaggaaatgtcttataaataaacaacagtaagagaaacaaaaaaaaaaaaaacccatcccgtcctgccagaggaatgtacattattgtctcccgacggaaaactttacaccacaccagaatgcagccatgtctcctgaaactacctccctcaaaacagaaagaaaaagagaatcaaaaaggaaaggagaacaaaacagaacaaaaaagatttcatccccttgaattctgttgggaagttcatgtgagttcccagtagacaaactaaactaagcaatttcaacagtgtcactgttccagaattttgtgcagaggctgcttattagccaaatttcatttctgcccagatcactgctgtaccatccagacattttcagaagggaagttcagggaaggggggaagggtacgactgtggagaagaggaagaagagaggacaaaggaaaactcctgatgaaccagaatgccctagccacggccatgatagagcgagcccccacccaccacccgactactgcttgttgaggacttggtgatgcggtgtgttttatctacttactctttctgctcgggaggctgaggttcctacatttccagctcatgctggactgtaccgtaagcaacaagtgaaatgagttcagtgatctcattctagtccttcgactcctgtccacatcactaagcgactgcacagcttggcacaggccaggatgagtcagcagtctctggtcatgagaggccaggcctggaatagcaggggggtttaggtcaggagcaaaatgaagcagaaaggcagtctagatggcagggctctgttctgcaatacacagaaatactgcaggtcaaaatgaaagcgcctcatcagctctggggtgaagattgtaggactgtaaaaaaagaagcatcaagagaaaaaaaaaagctgcctaccaaacatagcaaggacaaaacagagtaccacagtcagaaaaagagggcactggtagagccctggaggataaaagatgctcattaaggtttctgaaatgtcttttcttccacatgctcccaaacttgaattaagaaatggtgacttcctatatactatcctagtattttggtactgttttcccaattcagtaagtagcaaaacaaataaaatgcaaggcactgcagttaaatagcaagaaaagcctcatatttcataaaataatatgagtctgatatctcaaaggtgtacatttgggttaatagtgtctgtatatagcctgtatgaaatggttaaagaggagtactctttaagttgagcttgggtgggggtagagaagagcttagagaaaagagagttaccagttaatgataaaacataggggaactatgacactgtgaccatatttctactcaatggggccaacatagacctccattagacctccatcaagaagtgatgctcccactaacaggacttcaaacacttctccctctgcagtagtactgtaatatagcaaggggagagggaaaataaaatagatagaaaaacaaggttcaacataaaaaaaattagtgatagacattttgtttcagaggaggcaaattgctctataagtcaactgataaaaaaaagtcttggtatctgaacagacttagagaaaccatatctagatgaagatgccaggtggagactgataactatcaggaaatggtagtaatggccataaagaaggaagaaagcaatctcaagtcacatgatgtagaataaaacagcatggaaaacagaaggagagcaacagacttcgggaacacgagtaaaatatttctttaaagtccttttaagaggagtaatgaggacccaccacatattcctaaatgttgtccctcagagatgcacagatgtatatgggtaaggaaatgtaaaataaactttcagctttcatttcagagggtattaagtcatctgaacacatatttactaactgtttaatcttgggcaaatgagctttctagcctcagtttctctctctttgaaatggaaataatattatcatcctcatggaatcattgtaagcactgaatcaatgttcattaacccttatctcagcagtacctgtcacatggtgaacattcagtaaattgcttattattcatattatttgattatcatatcatatcatctttataagtatccagtgaaagaatccccctccagtgttgttccactggattgagaggaatcaatatgaagactctagtaaaatcagttgagtaacactgcttacactgctgctttaaaaagattatttctgtctgggtatgttaaacattatacttgaagacacaggatgttgaaaatctattatgtgaaatccttgaatttgggtatctatgttgtcaaagcaacttggagcctaacagttgtccagtaactagaggcccaaaaaagaaaagaggaatttttagaagcttctccaaaagcaacaggataaaagtgttattggccttaaccgcatgatgagggctttttaccaaaggggaaaacgtagtccagttgatcatcgcagcctaattgattaattgtgggtctgaccatctggctgatgaatgctgacacccagcagtgattactgtgtaacacaattccggatgtgctctccctgatgcctcccacaataatggcaactctgaacttaaggttagtttattcaggcctcttggctcaatctcttcatggaatagtggttgtggcagggaatattttactagacctggtcaagcattatcttctcttatttcagttacccactcttttccaactctactcctacccactcctaagccctctcttgtatataatcacttttcatgcaaagcattccatctgtagttttcatcatattatctgattctctcatttctggttgctctgttctgaaaaatatttgactaaactaggagatctatactgctagaatgccatttcacaggggatcctattgggacatgtttattgtatcttatttgctactggtttacttcaaattactctgcgcttccaaataaagaaaattattttacctaattcattagcctgattaaaagtcccacatatggcccaagttttccatgagattatcagaatacaagggttaatagacgataattcttacatcttaagcctacttctgaccctcagttaggagtatcccatgaagaagattcccctggagcatactttactgttagagaaggaaagtcagacccatgtaaatgacaaggttcaatagcaatgccatccacaaaccaatctacacctggagatgacttgtacatggagaattcaccaagcaaataaaacctgtacatataaatataaaccctggggaattataacaaaataattccattgtattttgtaggaatgcacaggggagtaactgacacaaaatatcttatacaaccttgaccaacaagtcacaatgacaaatcatccgtttcctcttttcttttcccagattgatttccagctctaaattcatcttttctttcactccccacagatgctgaattcttctatgttccaggctgagttagtgttaattttcagtagaggacggcagtagcatgctgaactgtagagttccgggctgggagttgggaaatgtttttggcctgactgtcagtaaacaactatgtgtcttgggcaagtcaagtcccttaactccccatgtctcagtctcttcattgaaaaatgatagggtaggactgcataaactccatagtctctgccaacactaagattctatggttctatagctcatttccttttttttctccctttggcatcaactgctcaacaactccgctcatagtaatctctatgctctcagttactaatggaaaaatatgtccttcatttactagttggtattttgtatttgtaatctctctctttttttatttgatgctagatattttgagtcataaacaccaacatatccaaatagatgctttaaatttgaaggcgtttaaggaaaatagctttcccatgtagaatatttagtgtagcagggcatggaggaagccagccatccaaaagtggagcaaaggggccaattcacaaatgagagaaagcctttcataataagagtctccacactctttaacttagataaagctaaaatgctaccaacttctaactacttttccaatcaatcccagacaccatcacagacacttaggactacaaatctgaggaccagcactggcagcaatgcagttcttatttcacctccaccacccattgccaagcaggatttaggatggcatactaataagagccaagaggacgatctgtcatttattttcctccaaactttttgaaatttcccatttgggctctgtttcccagttttaatttggtaactgccatttttcagcatttcttttaacaggttactaataatttctgatacaggatctcatatttcattttatgctgctagagctgctgttaatatttcatctgccttcaattcagctctgaataaaggctgctaggttttgatagactgttaacactttggttctggggatttgatcactatgttcatccagtttgtccatattttgttaaaaaaaaagtaataggttagctatctcagaaatatctcagggtgtgctatacattctagggatacttcagagtttctttttctggatctttgatgaaaaccaacaaaaacaagtatcctgggtttgttttcacaaatgacttgccatttgcttcagtgtcagtattctggaagcagtgggcagtggttaagattcagggctcataggcagatctagattcaaattttggctctgaaatttattatatatatcacctcaggccagttccttaaccttgccaagtctttcttttcccatttgtaaaatagggatgataataatatccacttctattaattaatatgaggatccaataaattaatataaagtgctgaggattttctcagttctcaataaatgatggctatcattatcctagcattaataatctacaaattcacattatagaattattattttgcaacatcttttcagggtcaacaaattattttttagtacagcctttgttgtttgcttcactatagcttacatttttaaaaagtctcagtaaaatcatgtaaaatatttaaaaatttgatatttaaactgtatgtacagttagactaatatatagcaccatattattattattgtagcacttttcagtgcagcagcaaattctcaaaagtttttgtccatctaatagccagccctagataaggcacattgtaccaatactaatctgttctataaaaagatgacttatcatatttatcttctcctactcccaaagaatatagattattttaatattctttgggtatgtgtcagtcaggccctgtttggatacagagaccatatagcaatttgaatagaaagttagtttaaattattaataataacgggattaaagtaataagagtagctagtaagaagtaaagaatactttaaagaatataagaataacatgggccaggcgcaggggctcatgcctgtaatcccagcacttagggccgaggtgggtcttcagcctaggagctgaagactagtttgggcaaaatggtgaaatgccgtttctacaaaatattagtcgagcatgatggtgtgtgcctgcagtcccagctacttgtggggctgaggtgagaggatcgcttgattccaggaggttgaggctgcagtgagctgtgttcatgccactgcattcaaccctgggtgacaaagcgagaccttgtcttaaaaaataaaaaagaatagaagaataacaaatgtaaggaacagccattatttgcagggctaagatagcatatccaaggaagagtctcctccatccctggactgagatctagacattgtaggactcaagacaaaaatctcctggacccctggaccaggatccagaccttgttggacaacacacagccataactcattggatggcagagaagttgctggggagctgcatcagtagcacctgcactctagggtgctaatgaaagctatttacagggatgtatctcatctgaggcactctgctataaattgcccaatgtgtgtgtacacatgtgtgtgtacgtgtgtgtgtatggtgggtgctaggggtagctgctacctgccacgtactggagaagctacctgtgcttcagctgctgggtaccaggttagctgcatttgctgcaggagctacatgctgtaaaggttgcttatgttgtagaagccaggctctggagaaaccgtgcacattgcaggaggctgccaaagtagtgcatgacaaccaggaaggaaaatttcttctttctgcaacgtctccctaccttctctactgacaaagcaccctcaaaccagctagcaaagaaaaaatatttaaagaatccagatacatttttgcagagcaggcaaggagaactacatttggaaggaggcaatgggaggtaatacattggtaactggcacagatattattatttgctcacacacttcatgaaataactcacattagagattataatccagtattttcaactgattgcactactgttcacatttactaataaaccaactccctttgcatagttaagcaaatactgtcagaattaagaaaaataagaggccagtagataaatacctataatagaatattttaaagtgacagtactagtatatgtacataaccttttcccccaagtgctgcccacatacattttaattacatgtttataatttacttaagaaaaaaatatacagaagtactaagctattgacctaaatgtatgcatcagtgatctcacaccagaatctcaactaagtgggtattcagaagagtcattacaaacaaccaaaagctttgagagaggtaaaaattgcctcgattatcatttttcctttctctttccttttctttttaattaactctagaactcatatttgcttcttctatgacatttttgtggaggggtggggtggctcttaaataggttattcttttttttttttttttttttttttttttgagatggcgtcttgctctgttgcccaggctggagtgcagtggtgcaatcttggctcactgcaacctctgccttccgggttcaagcaattctcctgcctcagcctcttgagtagctgggattacagacatgtgccaccacacccagctaatttttgtatttttagtagagacagggtttcaccatattggtcaggctggtcttgaactcctgacctcgtgatccgcctgcctcggcctcccaaagtgctgggattacaggcatgagccacgtgcccagcaaaatataggttactgtttttcagaaaaatacatatttagaaattttttcttatgattctggtcctatattgttctactcttaatattaaatagagaagcatcaataaatgaccaatttggtaaactatgatactgtgatcattgttagaactagttttacatatggggagagagtatattccaaaatacctcccctacttttgcctaattcccttaagaagggaacaggtgcttttgctgtataattacaggtagagtttaaaaccacaaacacctgacattagcaaggagcgtggttgtgagaggctgagagcagaaaagctaattgggtgaggagagtcctgtagagagtagactatactgaggtcaggaccacagaacatctttctcaccattcatccgtttttacctatgtctggccatcagcactatctgttctcactattatggaaggggtctacttgttacctcacagttgtgttttcttaaagccagtggtatccagcaaagcaagccatgttgggttgtctcacaatcacactgtaggcatctctgccagctgcaggtggttatccttatgatttccttttgtttgtgctatgcgtgagtactgaggataaatttaatgaccctatgtttagttctctcctccaacacacatgcacacccccctctcccctgcaattcctgagttcaaaaagagatgaagacaaaggaatgtcataagtccgtgtgattcaggcaggcaagtccattttattttagtttgcccttctgttctgctggcttttctgctatgacccactatacttaacctgtcggctgttcttagtagcaacatgcctttttaatcagccttcctggggtctgcatttgattacagcatttgtgttctattttgattcttttgtactgtgccctgtggtgttcgcttgaaaggtgttatttataaaatgaaattctattgtattgccacttggattcaaagaggacatataatattaatgcagaatgtatttaataatatcttcaatctattaaatcaatttcttcatgagaatacagaatggaagggaggcacatgggctgataatcaggtaataagacttaagaatcacctgaacttttccttcacaagctttcctgaaagctggcacaagaatcattctcttaatgtcagggtttccaagtggaggagactacctttcttcagccagaccagtgcagtgcgcacctgtttaaacattcaactgtgcaggccaaacattttcctaggcttttagatgcaaattttttgactaaggaaactatgagaccaaacatgaatatgacttttttactacatagaaagaattaggttatgaaggaaatgtaatcacctatttctaaggatctactttcaagatttgtaaaaagaagtatatttgttctcacactgactcttctcaaaagcaggataggaaaattctagtgataccaagaactgatgcaaagtttccaaggtggcatgttcagaatgatgttctcacctagcaaaagggcaggtttcattgtgggctgctgggcctacagtcaaatgtttctagattagattgatggaggagtccccaagttttttcaacttctaattttaattccagctaaagactgaaacattgtacactgtatcacagcttgcacagcacatttcttgctgcatacattctattctttcactacaatttttttttcctgttgatctatctgaaatcatcaatggctatgctgctgtttggatagggaataagaaagaatttggtttgaaagatgatttaggaatcaggctctgcagaacttactaaaagaaactgtaacatacaaaggaacctggctgggcagtcttgaaatgagagttcctggatttttacctgttctcattcagtggcatattatataactccagaaaaatcagggtccagttttctaatcactaaaaggggaataactgtccttttctacttgcactgggctactttagggatggataagaaaatgattccagaatcttgtaaatgctttgcaatgaagaggaaatacaaatgcacaatattattaaaatgatagtttaggccacatttttgtttctccaaatctagagatgaaaaatagtaacaaaggaataaatttcttccacttcaaaaataaataatatacccttatttataaatgacatgtcaaacataaggaactaggatgtgttggggaatacacatctcagttttgaaggcatcaaattataagctatttgcatgaaggaatcacattcatctctgtatccacccaagttctacctcattgatttacattatgtaagtattccattcgttaacatatgttgaattgaaatgacaaatgagatcgcacaattttagagctcgaattaactagagaccatgttaaatcctgttgcctcattttgcagatgatacaactgaggcccagataagtaacttaactaagtccaatactaaaaatattacaagttttagaagagttattttaaagatctgccactgaaaatatatcactgaattaaaacaaaatagacattcttctgtcaaaataagaagcactattcagctcaaataatccgatgtatcctaacctaatcaagaaggctgaagcctaaagtaacaagtaaacataattaaatagctatagacccataggcatgttagaaatgccaagttactgaggggtgcatatcttaatactttgtctatcagccagtccaaatggcatatttttttcaagtaaaattaatgtcttaacaaataataggggtgaagtcagcaagatggcagagtggaaaactctacctctcattcttccacagaaatactgataaaacaatgttggaaccaaaataccttgcaaatatattcagattgtagctaagaaatagaggcaccctagaggatcccaaactaaaagcagttgcatttgcatgggtaaaaagtgcaatttcatgttagaatgtcatatcagtacttcccccagactggcttagctcaacactgagaggactgcttcagctcatgatttctcctgtgccacagaaagtgagattggagtgtgtatctggcttcctggcctctggcctctcagagaaccctctgttgggtcagttcctatattgcctcatactgtgtactgacgcacctgtagaacttcgttcccagggatgcgtaggagcaaagaaatgaggagggcaactccttacagttagagctgccttgcaagattaggaatggggcagaactgaggttattcttagatgagggaggaaagggaatgaagggggccttattctcagcatttcagagttccctctgtgaagccagtttccatttcaccttgtactgagccttgtgcgaccattagaacttggttctgagggatagttagcaaaaactaaaaggagcaggcatccctttgcagctggcactgctctgtataataagaaaaaaacatagaaccgagccttttccttgagaaggcaaggaaagaagtgtaaagggccttgcccccagtcttagattgtgctccccaaggtgtatgtctctatcttgtctcatattaagcaccatgaactggtaaaggtctctactcatcaaaactcatctgtagagactgggaaaggtagctgctacttcaaatatacagatcacaaagaaaatctacaaggaacacaaagagtcatctccaataaccatcctgaaagaaacagagatccctgaattaactgacaaagaatgcaaaataaatgtcttaaagaagcccagtgagttacaagagaacactgagagatagctaaataaaattaggaaaaagatacaagaacaaaatgagaagttaaataaagagatagagactattaaaaagaacccaatagaattactgaagctggagaatacaaaaattgaactgaaagattcactagaggagttcaaaagcagacctaatcaagcagaagaaagaaacagtgaacataaagacagatcatttgaaattatgtagtcaggagcacaaagaaaaaacaaggatgaaaagtgaggaaagcctaagtgacttatgggactcaaacaagtgaatcaataaacacattagggaattctggggagaagagagggaaaggggtagaaagcctatttaaagaaataatggtaaggaacttcccaaatcaggggagagaaatcaacatccagattcatgaagtccaaagagctccaaagatctacaccaagacccattataatccaattgtcaaaagtcaaagacagaattttgagagaaacaagagcgaagcaactcatcacattcaaaggagtccccataagactgtcagcaaatttctcagcagaatcctcacaggcaaagagagagtaagatgacatattcaaagtactgaagatcaaaaaacaacaacaacctgtcaaccaagaacgctatactcagaaaagccatccttcaataataaagaagaggtaaagactttcctagacaaacatgcagaggggtgttcaccatcactgtacctgctttgcatgaaatgctacagaaagttctttaagctgaaatgaaaggatgttgattagcagcatgaaaagatgaaagtataaaacttgccaataaagtcaagtatatagtcaaatactagagacctctagtactctaatgatagtgtgtaaatcactttcaactctggtataaacattaaaagacaaaactataaaagtaatgacatgatttgttaatggatacacagtataaaaagacgtaaattgtgacaccaataacatgaagtgtgtatataggagaagtaaaagagtagagattttgtatgtgatcaaatttaagttgctatcagcttaaaatagatgattataagttgttttatggaagcctcatggtaaatacaagaaaaacacctgtagtagatatataaaacataaagagaaaggaatcaaagcatattgctacaaaagataatcaaatcacaaaaaaagacagcaacagagggacaaaggaactacaaaacaaccagacaataatttaaaaatggcagtaataagttctcacctattaataattaagtgtaaatggattagcttccccaatcaaaagatacaaactggctgaagagattaagaggaagactatccatatgctgttaaaacagcaacaacaacaacaacaaaaaacaacaacaacacactttagctttagggacaaacatagactcaaagtaaaaggtgggaaaaatatattccaagcaaacgataaccaaaagctagtaagagtggctattcttatatcatacaaaatagactttcagccaaaaattgtcacaagagacagagagaaggtcattatataacaagaaagtgattaattcattaaaatgatataataatccccttgattaggatccttttgattggaatcctcttgactggagtagaacaaaaactgaataattgtaaactattattatgaagtagagatctccaatacactactttttatttttccaaagctttcctggagatcacagagaactgaacatggagaaaaagtgagcaagagacagcagtaggctttatgccttaaatggctgtatagcttgttaaagattattgtttgtgtattaaaaaaacatgattctagaaacataattggggtttcacagatcaaattcaaattattaacttagtatttcagcctccattacttgctctatcttgcttaggcatcctaggttccagtacttcccaacaagtgttctgtggtgtatgcagactatgttagtgtttccctttattttggtatttccacaggagacctaattttaaattttctgttctatcatctccatgatttcttaaattatgtctagacttctggattagaatattattcatgtacttactatgattcaataaacatcttctatgtgtgagacagtaggaataagatacaaataagacttatttcctatcttcaaagaataaaggaattcacaatacagtggccacttaaatatataacatgtgttcctgcttttaagcttttattctttctataattagagtatcctatcattattttattgattgaattcctttaattatcttatagtccagcttatgttctgcttcttccataaattaatttttactttttatagcccacactgtttccttttccccccactattacagtggaagtggacactattccctaaccaaacttcattccctcattcttcctagccgcagacctctattttgtgcagagtgtcaatgtgctcagtgctggatgatgagttttgaaatttataagccaattatgacaagtgtattctctaatttgcttgcttctctagcaaagaagggtggcctagggattcagttatagccaataagatctatgtggcaatccacttgagaggcaagtttctgagaaagctttttttttccgttacaaagaggaaggtaaaaggcaatccttctgtttcctcctccttccctctttgaacatagacatgatgcttggagttgtggcagctattttgtgatcataaagtgacaagcatgaaagaaagacaaaaagaatcccagagatatcagcacagactttatcatataccaggaatttcctacctctcaacttctggacttcctgttaggtgagaaaactgaatctctatttgtttaagccacttaagtcaggatttgctacctgctgctgaacacatttctaaccaaagtaataatagtaacattcataatttgaattcaccaaactgttcttcctaactagataacagacattggtcacattcttggcacttcataaacattcatttgcttcacatcttgattaaatatgctagacttttatatgtaatgaaattctcacacagaaaggaaggggggaatttggattagtatcagaaaagaggatgaaaccaggtcaaaaaaggaaaatttgattctataataaaaaattatatgacaaaaatttgttacaatgtagctcaattattatatacaataaaagcaaatttttaaatattttccaaaattaatagcaacatattttaagaaataagacagtagaataagcccccaaatgataaatgttttaaaggagagatgatataaacaagtcttctattaaatgtgaagacaataccatgcagttctactgaaacctaagtgaggaaccagcgtttgtcaaataccaccagcaataagactttttctctgtcctttaggttgtatgactgtgattcaccccaatgctacaggctccttagcatgctcattatttctaaaatctttcacctgaggtttgaacccatgacttaggaaactattatcgcatttgcttttggagaaaagactacataagttgggacagaagctattttcaaggcttccaaatattacaagtaagtagtggggaactgttgagaagagaaatgagtagctttgggtcattttaggttagtgaccttaaacataaggtgtgatttaatcagaagccagagtaattatggcaggaggtggggaaaaagactcagagctgtctggagttagggaggactttggtggcagctttcagcttgagctaaaactgcaggattctgtcagaggctccacaaacaaagggctgcattatgtaaggaatcttgtatttctttgtgaactagtccacaacaaaatttcattagtttttttttttttctctcctagagatttttttttaccacttccagcccgtaacttgttgctcagaagggaaactttctaccttaaataaaagtttaaattgtaagcaaactgacatttttttaggaacaaatcaaattaatttgaactttataataactgggaaaatgctttttaagttaggtggatgataagtaatcttatatgaagaatttccaaataatttagcaatagttggcaataatttagcaatagttagcaatacgagttcatatctctctccctctctgtctctatcattttctgatagtctgtttacacatgtaacacttttgggtcacctttcaatggagcatttcataggcagaattggaagatagcaagacacatggatggcacatagcaataggttctcataaatattatctgttttcaaaagaatatttatttttttgcccattataaagatattctaagattaattacagtcctaatactgtcaaatttagctttgatatacaaaaatctattttttagtagtttaatttttttttatcaattactaacttgaggctttcattttacaacattattttggtcagttataaaaataatttaactgccaaatgggttttcccatttgacatttcaaatgttggtttaatacttatcacttagacctctatgaaggttgactcaggtttactgggggatattgcatagatcatgtcttttggtccaacagtttgggctgtgaatagtctaaatttgcatggaagctcccaactaccaagctatccaaaaactacagggacagggcggggtgaatgattctcagcaggtggcactcttccttctaattaggtcttgaatgaatgcaccagcattctgctatctcttgggtggagtgtgagactgaatcattcaataatgcttatagcgcttaagaaccaaattcaagggaactgtggaatgaaggcaagttataggtaacatacaaggattttcattctgctggactttttcattcaaaacagcatcattctcagactcagaattatggataaccatgcctctcagtctactcaggagagtttccagtttcagttccaatggcccagtcacaattattagtagtgttcattttcactttcaaaagtgtcctagtttggatgataaaatatggggttaccctgtatataagctttaaaaaagttagtcataacaccatttacagtgataatcattctatttaggacaaattaaagtagactctattggccaacttctataaagagaaagagataaactaaaacattattaatttaatctcagagctttaatcagaaaaagtttattttaagatgacaacaaaatttctatgaattatttaggatttctaattttaggtcatttttttttagccttattttatacaagcaagcacgtatgcccttaagatttgtggtggagaaagaagtacaatatctgaaataaagttctttgaagcttaggtttgaattctaattctactatttactcggtgtgcaaatttaaataatttctgtgaacattattattaaccctttctaaaatatgtttaaaaacattttaaaaaccagaagggaaagaactacatatgctgtgaaaagctgtaagttattaacagttactattatttctctttataaataatgatagtttttccctttcaacttctatgacacttttacagactgtagaaaaatttggccaagcatgttgtagcaagggtccttaactgtaatcacctttgacacagatccatgatatttctgggtgacatctctacatggacattgatggcctgcaaagatctagaaaagaaagactatagatcttgtacaccaaggccaaagactaaaaggctgaaatttaaagtacaaaagtattgtgaacagttttgttagtagtataatatataccacttatatagataatttttcttatatagatataagaataatttttcttatatagatataaaatagggtttcttatatagataatttttccatggaaggaaggggaaacgaggcgaaaagtggctggagtagaaagactagtttgtaaggcagaaagattttctaattactaggtagattttattttattttacttgtttttactagctaaattttaaaaaagagattcctagatctctatagacatgttcctctttctttttgctgatattttcctatttcttttctgaaatcttaatttgactagaaaaaaaatgatgttctgatttaattctcttagtctacctgacatcaaaaagtatatggagggtgtctttagttttttatttatatgaatgtaatcaaataattttattttttaaaaaaagactctcactgtttttcattgtttaacagacatttctttaaaactttgaagtaattatagaaaatgttctcataaattttccctccaaattaaccaggtagaaagggctaatcctgttatgcatgccatttttgtttgtttaaattgactattctgagaattaagtctgtagtacctagtttgaggcctcaagattttcaggtatgcacaaggttctatcaactaattctttgtctcactgatgatcctttattttaaatatactctacttgcaaaggtggtagggtaaaaagaggagtggctgacaagagactaaagaggggaaaggattcccaacatccttaatatctcagggctgaaaaagagcattagaaatcttctccaatctcttggagaaaaaatatctttcacacactctgtctattagaacttcatttgtgtttaacaagcccctcttttaaaatgcaaatttgccttgtgaacctgtaaacctcattcacaccttattgttaattactttgatgttctagaatatgatcaacacttaactgatattggcaatctaggaatgaacaaattgctcagggtgaaaaaaggaaaattttgttggagtggggctgtaggtggtagtgtgagaatttcatttgtgagaaatagagcatactgatattctgaagttttgtctaggagaatggcagtagttacggtaccacaaaacgagcacttttcccgactgccgatgtctagttgagatcagaaaaagcctggaagcctgcaaacctaagttttaaatatttagccatagcaagctaatcaagcttgcaattttctgaaaacgttttaagttaattcataatagctctacaactcggtgaccttgggttctaagactcatttggttcaaccttccaggtttaaaattcaaccaataaatgaattccaaggaaaaaaagtgaatatggcccagtccttttttactgtctccctagtcattcacttcagagattttggaatgcaatcctagaacatactgtaagcaatttcagaagaatacacaggatgcagtatttctctatgtgtcttagtaaatgtcacttgacccgatatatcaaaaaggttgcaaaatttgaattagactttagttgacttaagctacacatcttagcttggcagaaattcaaggaaaaaaatattttatggcctcttgtaacattattaatcacccctccttttatataaaaaataaatatgctaaactcttcactgttcagaaaaggggtcatttttcctgccaaaatggctaattttagtttttatgtagttggatacatttgtaaactattacatgaaaacatatggttggaacatgcttactccttcatgagtgttccccttttgaggctgcaaaattttccttagttgctccatgtgctactttgttgtgctgatgacttcttgttctaaataattttcttcattttccattgttaatgaaatgagttctaataaggaacaaagaaaccctctgatgaaaatccctttcttgtagaatggactgggaactgatataggacacaggggaacagcaaatgctgtgttgcacattcttcaattaaatgatccctttgtagtttattcacctgaatgcattttggcaaagagtgaagcaatagtgggaaaaggattgtttgtgtggctaatctttggttactcagaaagtactagacatgttttcctgcatgtttgattgatttcctgcacagtttgattggtgaatcaacactttaaggtatctaacccataaggaagagtgaaaaacttccccagaggtattgaaatttcactaaacctcttcttggagttttggtgtatgattctcagttgatctttgagtgtaacagtcaactattaaattggcatgactgaagtacagttttttcaaatagaagagtattttagaacaaatgagaattctaactctttaactgaatttctaactttacattttgcccgtacctctccttgtaacattcttccctttttccctatatatttttaccagtaatcctttcaactgctccttaacagtgagattctactgttctggcacattataggttctctttaactattttttgagtgcacaaatgaccatttggacaaatattataaaatgaacaataaaaaaccttaattatgcaaattaataagtctatacctttgggaaaaaagccatgatagtaacaaaatgaataacaattccaaggatatttaggaaggataaagcctagaagattaaaaatgagaaattttagaatcataaaaaacaaaacgaaataaaatagctcaataccattgaaagcacatgtatgcagaaagaagctaatatattattgtaaaaaattaaatggaaagaaattagaaatctattggtattattacatcaaaagcaggaagttctttctttctggtccaactttagagagaagaacaaatttgccagtgccaccaagggcagaatagagagagatgtttggaatttaagagttacaggttatgttatggttcatttatatcattgccatcactgcagttcattcattttgtgtctaattattgatgttgccacggttgtcaataaacgctcagcattactaatcatcagagaaacgcaagtcaaaaccacaatgaaataccatcttataccagtcagaatggctgttgttaaaaaatcaaagaacaacaggtgctgcatgattgtggaggagagggaatgcttacacattgttggtgggaatgtaaactagtcctacctattaggtactgtgctcattaccataggaattagggtgggattcctattccaaacctcagcatcacacaatattcctatggactaaatctgcatatgcaccctctgtatctaaaataaaagttgaaattttaataaagatggaactaatccctcatatcacagaattatgtagttgtgggtagtcaggataaagaatatttaggatataatttaaatgaattcactagctctgaaaatgaaagaataaacagaaaactaatctagacattaaatttttttctttccctaaggataatgtatagtccctaaggataatgaatattcaaggacatactgtaataaatcatatacatttattattaatataatatagtttattgcacacacacactatgagctccacgatgttcgttgaactattacaaagtttaaagacatacgaaattacagtaagagccatccatataaaaataaaatgttagtgtttggaaggaccaattgtaggagactatattggcgagttaatacaaaagatcatcttttgtttaagagttcatatatttttgtgtaaattatatctatttacagaaattttctttactaccaactgttctcaaacccattcactaataaataattactatatgtgattacttaatatttacctcaaacctttatgaatatcactgaaagcattactggcaaattaattatataggcaaatggtgaggatctctcaacctcacctctcaccttcttcccaatcactcgaagactgactatatcaatttgtcttgttatccagaaattggctttatttgttaattccagagatgcttcaactgtagtttcagccagctgtttccttacatctttctgggtggcatcagtttacaatgcatagcattgttgagggtcaaagttattttattttggtattactattggatttttcccccagtgcctcaaaggggaatgttgagtcatggagatgtaatgtgactccttaaactaagtagacttctaatacaagtatacttttattatggagaaaccaaattaattttatcaattaaatgagaatttatttaccatttgcctttaccagatatttcattagacacaattctcagactttacacaattacaaagaatgttgtataaaaactatctataaagcaggagatatttcattcttagttttttgccaaacaaattatgttgcttcgaggaacagagggaaaagaaacattgatgaaacacagccctcaactatggcataaagtccaaagcacagagaaggtcagaaaagaataaagcagttttgcagaattattatgatagggagtactgataaagaagagtcaactttttggccttagtcatttactgagttcctttattaaaaatagagcataaacattttagaaataattttttctcaatctttttttataaaacctctacagaaaaaagaagcgttatgtgaaaagcagctaaatgggaggaaagtaggggtctgtgggtgaaacaggaggttaccattgcaaaccctgtccttgatgccctcactcagtaggactggtggatggaagaagtttgaaaaacttttatgtagagatgaagaaaagtagaagccctagtttacagagaacgaaagatacatttttcttctgtgtaggtagagtttgtatttggagaaggaggagactcctttcttctgatgaaaactccttcttccaagagaaaactccattaggaaaaatggagcagcagtgagtgagagagaccaggtttaagatttgttttggaggttaaatttgttgtggaagttgacagaatgtggtgaaagcaagacacatcataaaataagccaaaaaaaatctctctcttccagctcattgtatattggagagttagttgacttttctactgtaaatgtaaagaaaacaaaagtttcattcatcctcctgtaatgatgccaatctaatttgctattaaatttctattcaaaagccctattttgtttagttacaagggatttgatccccttaaactttcccaggcaatttgtatggaaaggcggttgctaagggtattcctaagggaactggcaaacgttggaagataaataacctcagtacaatatgcagattaagtagaagggatggtttaagagttaccttttgaaggaaaaataaaagattcagaattcagggctagagttgctagttaatcactgatttgaaggtacttaatcaaggcagttttattttattttattttatttatttatttttttttagacagagtcttgctctgttgcccaggctggagtgcagtggcgcgatcttggctaactgcaagctctgcctcccgggttcatgccattctcctgcctcagcctcccgagtagctgggaccacaggcacctgccaccacgcccagctaattttttgtatttttagtagagactggctttcatcgtgttaaccaggatggtctcgatctcctgaccttgtaatccacccgccttggcctcccaaaatgctgggattacaggcgtgagccaccaagcccggccaaggcagttttatacttctcaagaaagtagaactttcacattgttcctcttgggaataaaggtaaaattatcatagagaggaaattagagagaaatgttcaccatttccttccttatattcttcctttctttcctctctctatctctagagctcttcctcaaagattcaaataaccaaaaatatgaagccatgggtggcagcttggagttctcaaaagtccaaagtgaggttagcttctgaccaaaacttttggcaatttccttaggttgagtgaaagaagcaatgtgaaaaagcatgagtttagagtcagtcagccatcaatttaaaatcaaactccactatttattattggtgtgatcttgaatacattagccaacctctttatagtccagtcatttctaaagaggtgattatctatgaaacctgtattacatatacaatgtgtaagtactcagtaaatactcagtacttctctagtatctctctaattggatttggctagtaatcatgacaattgtgggagagaaaaaaaaagatatgtaatcctgagggcactcagtctctgtaacaatcacttgataaataatcaggtgatacttcgttgacatctctttaatcttccaattgagaaaacattaggagtagaagaaaaatgattaatctccaacttctgtcattggaaaataactaaagatcagaactataagaaacataaaacttttctagattattaaagttaaccttttagacattttccacaatcacatggtatgcaaattttaactaaattattttacattaaatgtattttgtgctatgttttgactagttgattttactgtagtatagaatgtattatgacattccattatcctcttattactcatcaataaaaaatttattgagaaaacaattaattataattaatatttattattcattactagtaggcattgtagtaattacactattattggtattttaaatatcattaatagctataaacatgttatacataataataatagaaaccatttgtggagtgcttactgtgtaatacattttgctaagcattttatatacattcttaaaattaataatttcaaagatttaatgagctaagtgtcaccagataaacgagaagacataataatctttatttattaaaggaaaacttgccatatccacacaatcttccaaagcactgatagaacagaatgatggcatgatggcatcttaaatttagaaagtgtcattcataaaagtgtactgttaactactaatttgtgctatctgcaataataatattatattacacaagatggaaaggctaccccctaaaagatagcatttgataaattgtacataaaaatctagaagaataagagtataacagaggagtgaaatttgatctgaaatacagagaaaattaagaaaaacaaaacatgttagccctactggaatttgtctcaatgtatttcaaggttcaaagtatagcagaggaagatcattgacactgtcagaggattatcattaaatttcaacccaaaggcaactaactcaaactatgcagatatggaaagtagtgtttcctaaaatgaaactaaggcaaatattatttattctagcttctactcttttgactaatcagctgacccagaaattaaatatttaaaggcttaaaaataatatagttttaagaagttgacctatacgttactaaataaaatgatcctcgttgtatttgaagtagctcaccatttaaaaatttaatctatgtccacccattttctttcttcccaaataatacaatgatttaattaccccacagtttaatttgacagaggagccaaaaagatacactattccttcattgttaactttaaggagaaaaatacactataaactatattagaaatcttattttttgggtgtccaccacaatgttttcactacaaaatcccttgctgcctgaatacaaaatgttaccattcaatcagatgagtctccatgaagttagaaacattcaagtgaaactcataaaataaagaagatatactctaaaaattccagttcttgagaagctgtttacacacaaaagggctattaaaagtgaaagggtaagtagaaaatcttctgggctcatttaataaaagaatgtagagttccatgggattcttttctaaagaaaccactaacaatgttgcagatctacaaatcctaaaagagtgcataatggactcaagtctctgctttgtgactcatgggtgtacttcatcaggatgtacttcctcttttagggggtcatataggtgaataagctgacaacaccttcagagagagaaattccacatgtgtcataggaatagaatttatttgatctcaagctttctatatatagaaaaaaaacaaattctaatccaaactttaatgaattcagtattgttgttgttggtttgcctctagaatgtctcttttgaccaagtcacattcctttaaatttacactaggtaaattatatattttccaaatcttttataaaagcataagctaaatgagataacattaaaaggctgattggagatttccctttaaaagcagtcataagaacaacagcaataataatataacaacaatatacactacattttgggcaccatgctttgaatttatatacactaatattattaaggcaatctgtgcttttgagaagctactccagactaggcactacacaaactctgccacacacaagagagaaacaatttcaattacaaagagagctagaaaataaaatggataagagtatcatgaaagattttttgtaaaactgaatagatcctttcatgtttctcagttttaatctctccaaatatccctattgtctgctttttaaaagaaaaaacactgtaaaaattctgaaaaaattattcacaaagaaaacttccactcgtttatataaagcattattattaacttcataacatgcataatatcatctatttctgaaagaccattgaaaagtagccataaaaacttaaaaaattgaaaataatctttagagatcaacaggccaggaagagttctaagaatatgcattggcctttactaaccattttcaatgccatgcacttttgtctgtcaatactttctcctgttatttttaatatccctagattaagaaatattaacatctatttacaaaaaaatattctaacagtttcccccacaaaagcatattcccatgaagatcaagaaaacaaaaaacatagcagggagtcagtattctgacagccttttagtcttcttcatcttcttcctactattattattagacctactgcctattaccagtaggctttttaaaggtcttggacataaatatcagttgttaagttgctattttcatggtcatttaaaattatttcaaccataaatgcttttaatttcctgaatatcttaaagctgtctaagtataaatattctcccattatattcctctgtgctaacacaataatctagttggagtcaagtttcatgaaaataagaaaattggtacattataacattttaaacactgaaaaataaacgtgatagctgtaggatgtaaagtgtagtcaggcctgtagaacttcggatgcatcattttacaatatcatttatcattttgataaaactgaggtcaagtttctaaaaatacaacttgttaaaagcaggaataaatgaatgagagatgagtcagctcgtttgatggaaagggtttaaaaaatacttcaaaagcataccacatgacttggtaaatattcagtgtatcaaaatgtagttgccatctggcattgatagactgggctagaatatgtgtttaaaaagaacaagaaaggaaataactcagccaggttaatgtgcacttgtctacatttcataattcaggtattaagtgctttaataaatattcactatgaaagaaaggctgcattacaatcagacttgggcagtatttgttggggacagctagaaagaaatgaaagaagacaagacctgatggcacttaagaaagctaaaaacaacaataaaaaagtggtttaggtaaacagaattctcaatcatatgtaatattgccagaacactagtatcacagttaaatgcagggaagtggtaagcttatatttgaaaataaactgaaatcttgcttattttcagctttgaatattttaattattcttttctttggctttgacaatttaaaagtatagagaaatccagggaataagtaaaacccttggttggatagtaaaaaaaaaaaaaaaaaaaaaaggaaaaacgaaaaagtcctgacattctttgaagttttaaacctagagtttgatattaactttgcaatatgcaacaaaacaaaaagtaaatttgaaggactcctcttttctccctcttgctcaagaaataaaatatatttagaaagcagtatcattcacaaaagagaaaagtgaacacgagcagtgaacacttgcccaagcgttcgactgtccaaggctgtatctgggcttgttaattagatatttctgtctttaaccttgaacattctccagatttccaaatcttgacaatttacattctaccacatctcttggaatcagagcaataggcagaagagaaaagttttaaaacagctttgaaggttaattaggacagggaccagggtagccattaggaaaatagatgaagcacttcaggtgagagttgattagggtcaacatgaaatttttcagagttgaggtataatttatattcagcaaaattcatggacttcaaaatgtacacagaatgagttttgattttgataaatttatacacctatgtataaatatgtatatataaaaatgtatatatttaccaccataacagagacatagaaagttcctttgtgcccccttccagttaatttctatctcccataaacaaccagcattctgatttttatcacgatagaatagtttcgccttcacataacttatgtatactcttgtgtcctggctcttctgcataccatgtttctggaattcatctacattgttgtatcatactctgttttgttttatttgcttgttagtatttcattatatgaatataccacaatttgtatatccactttccacatttgggtgcttccagttttaggcaattacaaataaagtcagtataaacttgcctgtacaaatctttttgagggcattattttcattattttttggtaaataactaggaatgtaattaccaaacaatatggtaggcatatgcttaaccttagaagatactgatccaatgttccaaagtagaactatatatttacagaaagtcttgaaattaggtaatgtgagtctttcaactttattctttttctaagttttctgcaatctcatatacattttaaaataaatttgacaatttatcttaatgttagaaaaacaagatgttgatattttgatggtgattgcattgaatctacagataatttggggaaaaatgacactttagaaatactgagtattcatctataaataacggatttttctctaaggccttttaaaattttgagtggggaatcttacattcttttgttaaacttttatttaaatgtcttatatttataggctactgtaaattgattttaaaacttcattttcaaattatttgccggtactacataaatgcaatcaatttttgtatattgatcttgtgaccttcctaaatgcactgttagctctattagttgttttgtatatcccctaagagtttctaatgtaaacaatcatggtatttgtgaataaacacaatgttacttcttcctttcctatgcttatacctttaatttattttactcgtcttattgctctggctaggatctttagaacaacgctgaacagaagtagtaagaatatatatctttgccttctactatatcccaggaggaaagcattcagattttatcattaaggacggtattaattatatgttttcatagaggcccttcatcagattgaggaagtttcaatctgttctaattttctgagagttttcactgtgaatgactgtcaaattttttcaattgctttttctgcatctattgagatcatatttttcttctttattaggatgcatttacagtgatttattttcaaacgttaaactaaagttgcttttctgagataaatcctacttgatcatgaggtattatactttttactttttattgttgaagtttgtttgctaatattttgttaaagattattgtgcctagaaccatgaggaatattggcctatacttttattttcctgtaatatctgtcaggttttgctgttgggattatgcctgtctcataaatcaggaagtgttttgtttttacctcctatgttttctgaaagagtccgtgtaggattaatattatttcctccttaaatgttatatagaattctccagggaaactatctaaacctgaagttctttttttaggaatgcttttgacgacaaattcaatttctttaatcaataaaggaatattttgatttctttggtttactatgccagttttgttaatatgtttttaaataaatttacctattttatcaaagttgttgaaattattgacatgaagttttcataatattcccttgttatcctttaatattgttatgatatgtaatgataatctctcattactgatattcataatttgtatcatctcttttttcttgaacttttctgttatagcttataaattctgttaatcttttcaaatattcatgttttgctttcattaatcttctttgtagtttgtttttatttcacagttttctgcctttgttatttgttttctttttttactgcttttgggtttaaaatgattatactttcccactttcttaaagtggaaacctacgctattgatcttaaacctttcttcttccttctaatttaggattaaaagctcaaaatttctgctaagcttctctctggctcatattataaatgtcaatatattgtattttcatttaatcagtttcataaatttcaatatactgcataacttaatttaattattttaaaatttcatgactttcaaccatgaggtattaagtttgttgtgtagtttccaactggtcttttctagatattttattgttttctttttttatttctaatttaattaattataaacaagaagcatattttgtagtatctcaatcttttgaaaatgtttgaaactcatttgatgaaccagattagggtctactttaataaataaagtagaacatacatacaggactctattcctgtatgttttaaatatgttttaaagaacacatattctccaggtgggaatagaacacattctccaagtgggaatagtgttctgtaaacatcaaacaggtcaaggcagttgatggtgtttttaatttcttgtgtattcttactgattttctgcctatttgttctatcaagttctagaacaagaatgttaaaatctccaattgttattgtagattttactatttctctctagttttctgtcagtttgtgtctacatgtttatgacttatgcattcatgataatttcacacatatgattaggaaatatccctccttatctctaatagtactccttggcataaagtctattctttgtaatattaatattccaacctagctttctcatgcttattgtttgcattgtatatatctttctatcttttcactctcaagatatccatgttattacatttaaagtgtattcctgtagacagcatatgttgactcttgcctttttattcagcctaatactctctcttttaattgtagtatttataccatttacagtgaatggaattattgctacaattaagtttaggtctaccatttatttcattatatgcttttgatttttttcttttgggtttttgtcattgttattcttctgttttcctttcctttttttttttttttttttttgagacggagtctcgctttgtcgcccaggccagactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcctttccttttttaatgagttaaactgatcaattatttttccattcaattgcacaactggctttttagctgtaccttttttgttattttttagcagttgttctaaggattacaatatgcctctttaattatcactgtttacacagagttaatattttaccactttatgcaaatgtgagtatcttataagtataatttcatttactgccacccagtactttgtagtatttttacatacttcatatctgcaagtactatagactcatgagaaaatactataatttatgcattagtcagtttttcttttaaagaaattaaaagaataaaaggatattcttttacatgtaaatagatactttaaaatttttagtgaaaattttctgtaaaaacaagtttctatcttggttcatagtgtcatttcccttcaccctgaagcactcactgcctttcacactacttataggaattccactgacaacagaaaattcatttcttcattattgcaagatcacattgctctacataaaattctggttttgcagttgtttttcttttcaatcattaagaaatggcattacatttagtatgaggaatgagtcgatgtttgattattcccctgtaggtgatctattgtttccacccttagggctgcctttgagatttttctttgtatctttggtgtacagaagtttgaatacagtgcctacatgtgattttctttgcatatttttgtgttttttctcagcaaattttggacattttcagctatgatttcctcaaatatcatttctgtcccattttctcatctgccacccacaatctgctgttaagattctccaacaaatcattttttatttcagattctgtactttaacctttggttctttttagtaatttcatttcttttttcttcttctgagacatgcaaagtatagtggactggttgatattgttgtacagatcactctgcacatttttgaatcctttttctctctgttctttacattaataatttctattgacctgtattcaagtttactgacactttcttctgccatctacaatctattgttaagccacttcaatgactcttcaaaaaaatttcaggtattataccttaactttttacttatttttgaaaattttcatttctctgcttattttctcatctgttccctcattatgactatatatatacatatatttttagagacagggtctcactctgttgcccaggctagagtgcagtggagcaatctcggctcactgcaacctccacctcctgggttcaagctatctattctcatgcctcagccttctgagtagctgggattataagcatacgccaccacatctggtggattataggcgtgagctaccgcaccgggcctgaaaacatatttttttaaaatcctgaatatatttataatttctgctttaaagtccttgtctacaacttctgaatcatcgaggaatctatttccatggactttaaaaaaaaattacatgtcacatttttctgtatccatcactggtaatttttgaattacagttgaacattgtgcatgatatttatacaaactctgggtttggttatctttctctaatgcaatgcatttttcttctagcaggttattaaattactagtcgaccactttgatttgaagaggactggttttattatttgacagaaactttcaatgcttcaggtttgtctctctttctataattaatttcttagttcttagctatcatctatatttctaaggtttgatccttctgggattcataaagcctgagacatttaccaaacccttctaactttgtaaactcaaactcctaactttgtctcctcttcatctaatgtatctgttcagctcttttagctttctagttgttgcttttctccaggcacttataggctcccacatacatgcacagtttatatcagccagaatgttagggtaacttatatgtagattcatgggagccttccctcgatggctccatcctttctaatacttccttcctcaatttcagctactttgccaatgccagctccattcgctaacatcacaaaccaataagattgtggttttctgcctgaattctaacttctctataccatacagactgggaagttccttgagggaagaagctgtaacaaacgtgaattttacccgggacagttcactccagattccaactgcttttggtcactctccggtgccttcaaataattgtggtgttttttttttaagtttttaattggagtttagttttatttttaacccataccatggtttggaactgttatctgtggaaatatttgtcctgaaacagtacaagttactcctttattaccaaaatcacaactaccaaaattgtggttttatgttagatagcacttgaactgatatggaaaactgcattagaatcaaagtgtctatagggcttcctctctcaatattcagtattttaaaattgagacaagactattttttaaccttaaaaaaatcactcatagtgccctaggaaagtgctatatattccactcagtcgctaaatatggccaatgaatatttctataattaaatttagcagaataatctgtgaataaaatgaaacagacctgtatgtaaagaaaactaccttaatgaacttgcttgggagatcagtggtatgtgatatttctaatcatgacagagaagttgaacatgtggtacagttgtgtagggaaaatggataactcttatcttcattattttttaagtcattctaagagaagcatttgctaagtagtttatatatatgaacttatataattttcataacaatttttaaaaatagtattgtaacattattttgtagatcacaaaactacaaagtatcccaggccatcagactccagagttaaattccaaccattccctctaactacctgctcagaattgagataaaactcatccacagcagtcatcattttttctaagaatatacatcacctattaatgttctttcccatctcccatgttaacaactttcttcctctatcatgtaaacttgctctctatcatctccgtgcctttcttgttcattttcatggagcagccataaaatggagaataacaattgaagcagtgaatagccaagaagcatctctcaatcaatgaacctgagacagcctgttcacttctgtccatcattcttgtcctttagatctcagtttcaaattcatttcttctagacattcatctcttcccatgtttaatctggaaccatctacccttccaccagaccaattatcctggcaaattaatgtaatagaccagtattaattatttgcttgtatgtcttaacaacattctaggtgctgtgccaaaaacaaatgaatagcaacacaaggtcttctggttacaagcacattacattttggttggggagattttgacccatctcacagtcataatcttcatccaggttatctcgtcaacctctatgtatgcatatattccaatattttgttttgcttttctttcttccttgtagtaatttcacacagactattcgcttcaagaacctaactaacttcctgttggtacccaatcctttaactctagagggtcaaatggagccctgtggctcctggcagtgttcctgaagatcaggtccctctggtggaactcagttctcactgccttatctaaccttcctcactcagcttgtaatcaacttaacttttaaagtctttgtacacattaggtaatatttgttctctgaactcccagaggggctgtggtaactgcccaactaggaagccctacccttcattattcagcaacagcttgaagaatattctaattctaactttccgccctctgacagaccagctgcatcaaaggctgtgttcccctgtttgtttttttcctgaagcagagtcaccatttcaaactaagtaatctatgagaaaagtaagagctctgggtccaaatgtttaaaacatggctcttctgtgaaccacggcaaatctaaactggattatgccttatgctggagtcagaacttacttggtcccttgttctttgccctctggctccctgcatgctgttcaggggaagttactggcttttgaactggcggtttgaaaacgaaggcatttttcttttagggagaacagtctttcagtgatttaaacaacaagccttgtgatcaaaataattcataaaggaaaagatttatgaagtgacttcactagcacacaatgcattttaaaaactttgttttttaaataaatctgtcagtacagaagccaagacaacacatctgaatgcaatatcagtggacacaccctgaatctcttcttctttgcttgtccaagactgtggtagaaaagggaaatgattctctttgtcttttcttatttaatattattattaaaaattttttaaaaattctagttccatgaaaagactttgaaaaattgtgcctacttttgtttcctgcaggaaaacctgccttgtaaaaatgtattttccattgaccacttgtgcttgtttaagaaaataaaaaataaataaagaactccaacttataatgaatacctctggcattagggagcctgttctaatctccctttatcaagtttgagtgatagttctgctcaacgagtattgacagggccgtcctgtttctcaggctttcgtttccctcggttggagaaggatacagtgcattttcacattctcaaagtctgcagttgtttttatataagaagcaatttgcttgggtcacgtcaggtcgaatgggatgcctgcccagctcttggttttaaaggaaaaacatacagaaagacacaaaaacacagcagtttccttcattaaattccactctacctgccatgggcttctagccacaatggaatttcccaccctggcctagcctagcctaacttttatttttagggattttttttcccctttaaatcttatgagctttctttcaagtgaactttgaggtaaggattattaaatgatagagtaattgcctggttaaaaaagaatcagacataaaaaacaaatgcctagtgaccttccataatatcgctggataaccaccccctggataacagcctttcaaaaactgttcataatcagcacaacaagacaggtcatgtaatttaaaattaaaacctgaatcatttaatgaatagggatcagcatttttttcaatagtaccctcttcttacctaattgcattggatgaagataattttggagaagaaaatgaataaatgaaaacacaaggaactagataaatagatggggcgggtggatggggggtggagagagagacagcaagtgagagagagaagcttttggacctctctctccaaaaagccatttatgcttttccccattgcctaggggcaactgatttaatcaggattgttcatgtggattatctaaactatgaaaagcaacagggagcacttcccaagaaatccagactgggtgtgctgcagaatacttggtttggggcctggagctaagtagactgttcacattgtactcagggtcctaagaaaagtggctcagtgtctctgtaattctttgtccctttgatctacctcaacatttggtgtctcttggcattaggaaagctcacgaaaatgaccctgcctagttaacagattcatagtctgggcacacaaaaaaagggtaagaaagaaaaaaagctttggtaatgagggagagaaacgtaccttcttgctatctttgctgggcataaataaaaatcgaaagatgtgatttttggagatgtgaatcccgttcttcccatatttagtaatagccttttcagagccaattcaagaccttctatcaaccacctctgttaaacatatcaagttagatttctcattcattattttcaagctggattttgcataatcttccttcaaatgaagaagtttacttttcgaacatgtcatttgctcttagcactgttgttctccttcacccattttggcttcttatcctcaaatccctgattccttattaaagtggattgttaatgcagccattctttagcaccacagcacatttataaatcaaaaattagtttactctgcctggcttccaaaaccatttgctgcttgaaaccatttcatgagtttgtctactcatgtgaataaataaaaacttgcctataatgtgactttgggaaaggaaagagcaactatatgaaacgaattctacagaggccaaaattattttcacgagtttcatggattcagcccttgcatgtgccattctacattaactttatctctgagattaggattttgcttctctttttttttttaattatactttaagttttaggctacatgtgcacattgtgcaggttagttacatatgtatacatgtgccatgctggtgcactgcacccactaactcgtcatctagccttaggtatatctcccaatgctatccctcccccctccccccaccccaccacagtccccagagtgtggtattccccttcatgtgtccatgtgatctcattgttcaattcccacctatgagtgagaatatacggtgtttggttttttgttcttgcgatagtttactgagaatgatgatttccaatttcatccatgtccctacaaaggatacgaactcatcattttttatggctgcatagtattccatggtgtatatatgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactcacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccatgagtaggttgtgaaaattttctcccatgttgtaggttgcctgttcactctgatggtagtttcttttgctgtgcagaagctctttagtttaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacacaattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactatgcttcataagtgaaggagaaataaaatactttacagacaagcaaatgctgagagattttgtcaccaccaagcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaatccacacataacaatattaactttaaatgtaaatggactaaattctccaattaaaagacacagactggcaagttggataaagagtcaagacccatcagtgtgctatattcaggaaacccatctcacgtgcagagacacacataggctcaaaataaaaggatggaggaagatctaccaagcaaatggaaaactaaaaaaggcaggggttgcaatcctagtctctgataaaacagactttaaaccaacaaagatcaaaagagataaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacaggattttgcttcttaagtagatgtcatttttctccagtaaaaccaagtggtttaccctgacatttagtagtaatttagtgatttcagagttccttctaaatctaaagtaaatgttcatgagactcatgaacttgtatctagacaattaatctgagcattttaagacttccctgaggctacatataatctctcacaaccccttgcaaaacctgagattttgaaccactgtcaagtttgtggttgccctggtaaggagtaaagcaaaatcattacttatggcaactaccacacaaacattgtagtgaactgaagtataagaaaatcactactatactttagacagaacattaggattaatgctggtaaccaaggaactaagagcctgtaaatataactggcttaagaaggagaacaggattaaacaatattggagtttagaaacaaaagtagtactgtatcaacctgtcactatgcagccagtcattacaataaaactaaccaaaggatggcggcagaaagaaataaaagtatttttgtgtacaattcttcttgaagcactacttgaattgcatctgtagggaacaggtctcataggtctattatttgcccacctccccaacacacacacacacacacacacacgtactagcctaggccgatatctactgtggtaagtttgcatctgtgagccactgagcagctgctttatatatgcagcataggatgaaagagagaaaactggggtactcatggtttttgtgtaatatcacaaagaaaagaaaacaaaaaaaggcttagagaaagttaaaggaaaatgggcagtggtacatatacagaacaagttaggattccctaggaactggtaataggactaaacttgcttaacatctatcaaaatgacttacttattccagggtcttgcatatacatagcagaagcacaattaatttttgctgaatgaataatctggaacaaggaatgtaaaataaattatccaaaaatgttgatggaatgaaacttttctgagcaaggaaaagctaaactgatggaacacaatatttatccaggtgtgcagaaaggtgccagtgcaaatagagaaaaacaaaatattcaaatacagtcgtttgccgtgtaatgacattttggtcaacaatgaaccacatatatctataccatggtggtcccatagattataatactgtatttttgctgtaccttttctatgtttagatatgtttacatatgtaaatacttaccatctactctgttacaattgcctacagtattcagttcagtaacatactgtacaggtttataaggtttatggcctaggagcaataagttatactatatagcctatatgttagtagtatataccatctaggtttgtttaagtacactctatgatgtttccacaatgatgaaattgcctaaggatgcatttctcagattgtatccccatcatcaagtgatgcatgtctagtttaattataagtcttacctaggaaagggacttaaaggctatgagctctttcaggcaaaaaggccttcaaaattttggcactcattaagtaaagtaatgaaaataaggtttataattcccttatattaaaccctctgcaattatgtgaaactatctgtacttcaaatgccatgttcctataacataacaactcagggtgtcttacacaggacagtcattaaagagtttaaggtagattaaaataatctgcattagtagagaacaaattattttgcggtattataacaattcattgaacatgagaaaaagcaaacaaacacgcttgttaataaatgttacttaacagacatcacactgacatttcttagtgactgactgccatggaagctttctaataagtctaatttttcccacgctctgagtttataagatagcaatattgtagctttgggtgtttacctttgtttatttattgggcggagttttattgcgtgcctcctccagctgtgccaatctggtaagatcaaatggaatcctttagctattgtcactatcctaaatggaccgcatgcttcctttgtcccttgcattctctgattttcgctgggggttatctatcatggctgtacatccaagtctctaatctatctcctttctcatccgtttttcctgacttatttcccttttccctttgtctatttccctgtgagaagccaaaagactgtatagttcttagtagcggtagtagtgctatctagagttggcatccaacagcaccagtgttataatacactttctacaatcaagaaatgatttgatttccttgcctcagtagaaattttacaagttaacagtggttcacctgatataaaccataatatttctatcatatcatgaaagaattctaaaaaatctgttagactttcttctacaagtttgcctatttcctctgaatacagttaattcacctggcaacaaaggagattagctatttctttttgtatgcagacagaaagaagtgtgatctttctttgccaataaaaacttctagtaagtggtgatagacttcaaaacccttctttttatttgaaaatcatggttcagttatcaggaattccaaattcagaatctaagaacagtgatcctatatagtcttgtgattttgcacatgctagggattggtaagttgctgaagacttcttaaataagagaggaagcatttttcttttcacttgcaaagaaccaggaggtacattaaaagaggttttagagtaactagaatgtgtgataaactgttcactttctgttttaaaactgtccatgaggttccctttagagataggacagactacagagaacgtggtgtctcgtttctatgggttgaaattccacagaacaatgctttgcaaagagtcataccaccagttccttttcctgtgagatgcaaatactaaaaacagatatgggctggacaagattattttaaaaatagatagaaggcaataaaagctttggtgatattctagattacatatgaaatgtgtaaaagcgtaaaatgaaaagttctctactttttaaaagctgcatcaaaatttccttcctacactgtaatcgtgccccttaacccatctatgcctgaggttgcaatttctttgaatttctgcaatcagaccatggcgatgaccttgagcagtaggatataaataactcctccatgcttagcgttccaataatggaacactaggcataaatgggataaaacacaaattgctaggttcatgataaacagagcacatctgtaaacaaaataacttttaaaaaatatgcctacatatataattttattacttctagaaacacaagtgttattagacttaaagagagccagtgaattgaatcaacttattctgatatgaacctcaatgtgatctgattgcaggctgcaatgattaacacgttttaaaagaaatgggtccatactatactttccaactgcccacccttctgttcttcttatgctacagatttatggcagcctaacctccagccaacaagttagagaattgggtaagacatcattttggctttttaagaaaattatggataatcaaaaaacatgacacaaaagatttagtggctattatcagggtataaactaataactaaaggcatttatgtgttaggtaataatgatgcttagaaaattataaatatcaagatgctctttcaacaactatattccagatttaggaattttgtagaggatatggcataagagtgttaagaaatgtatacttttttgaaaataaaataaagtctgatttatttattatccaagttcctgtgttttctgggaaaaatgtattaatgagaggtagcattatttgatagttaatggagagtggaaatcatctgttacaggcccacatgctcacaagcaaaataatattctctcaatcctcaaatggaaatggggattataaaatgctataagactctgtcaacatttctgataaattccatgaaaattttgtgttacatattttaaaaattgtgtactatgattataacatagttgattattaaatatgtaatcctttctttcagattattcttcttccttaaatgtaaagggtatattattttcttgatttattcttttggataaatatcctgtacatagatgtctgaaatccagcccgtcagtttccctttaaattctagcatattttaaaggaccttaaaagatgactgtggagtactgcctgatttggaacttgcctctgtctcttacacactgtatgacgttgggcaagccacttaacttctcagtacttcagtttcatcatcagtcagaacagcacaataatagtaccctgctcctatggttactatgaggattagtgggtttcatactgtcaataataagttgcctttctgggtctttgaagtacttgaaatcaggttaattaaattaagcagagctttggtccctttgtttgacaagtaatctccaattttcatttccaggttctgatcccctaaaatcagtggaataaaaccttgtttgtgtaactgccatcttcctgccccaaagccaagattaatttacctgttggttttagttttcactaggtctctctttagctaggtgcttctaagggtaaaatatcaactattaaactatttgaggcaggagatgttgaaaggggaatttaattgttaagtcaatagcagtgtgccagcttagtctgcctttcagaaagatcaccatagtaataacgagaccaataaataaataaaaagtataaaatatacatctatgcagaatcttagaaccctttctctaacacataagtcattaaaggaagctctgaggtctgcctatgtgattcaacatttacacacatcatagttctatggaagaaattctcagttgagagctaccagctttcttcagatcggatcagatttttctatactccattataaacaacaaaaacaaaagcaaacaagtgaacaacaacaacaaaactgtagttgtggttcactccagtaatatatactaccaattcagtggttcttaactgggggacaattttgccacccccttccccaccaggggagaactggcaacatctggagacaattttgataatccaaactgaggggtgctccaatggggagaggtcagaaataccactaaacatcctacagtgcacagaacagacatctaccctgcatcccggcaaagaattatctactccaaagtatcatagtgccactgttgaaaaaccctgtgctaaactaacatctgagagccactggccttaaaccatcagccacatcaacacgtaagacactcagcctatgggatagtctaacagttaaagaagacaccttagagggaactacttcaaaaatatataaactgacaaatctggataccatactaaggaaaaaactggtaaaacaggtagttgtttgaaagcttcttatgcccattattataaaccaataattttagattactgaaccaaccagactaatattccctttgaattccaggaggtataaaaatatgaagtcatcgactatgcaacattatcctgctatggagacattctgaaatggtttataaaagcagtgaacacattaaaaaaaaaaaaactagcccaaatgagttatgcaaagttaaagtcattttttctaggaccagttttttttcctgtgcatagtattttccatatgtaccgcaaacattcatttgtgcagaacatagcaccacatttctaatacaactcctctctgaagacaaatcaggctaaagctaagagttgcagaaccatttctgtatgagtcatttttagcacaacataagccctagagtaaaatttattttctaaataagccacaattattctgcaaacatttaacctagcacctctcaactgttaaagaatgtcaattatatatgaaaggaagaacaaatataaaggaaatttgaaaatcaagaaaattttttctgagaaaagtttgtgagaattattatgaatacagctaaaattcaaatatgtgacattttatttttttaagggtttccctgtcaaagacaacacatatttttctaatgaaagaggatgcctgaagttgacattcataagagcatttggatactaccaatgtgaagttgtacagatttactcatttctgcaattaccctcttgtgtttgaattctactttggttagtggtagcaagcactaaactgtactgagggcttcgcaaaagttgactttatttctttacacttagaaccccaaaaatttacttcctaggaagatactagggaatcatatcttactgaggaggaaataagaggtggaataactggattagcctcacaaagaatgaaagctcagtaatttctgagttggcaatatttttcaccctccttttctccatttaaatttctagatttaccttcaaaacacttgcctttttctaccttaagggaagttctaggatcagggagatggagatagagaaggtagagatagttttaggttttcacagaagttcaattaaaaactgccaagtacctcctaccaagagaccaccactaaaatttatttctagaacaaggtgcagaaaaataaaaggtagaaagcaggaatgttctggtactgtaaaatatttggggaaaaagtctaatttctgttctcaaaatggttactatcttgctctagagaaaaacataaaccctcttaaaataactgaagaacaataagaaacagtataattaagtgtaaaaatgggtggtagaagcaaaatgctgtggggcacccatgtgtcttacatctttccaacacagagaaaagagacaatgggtcaaatgcagcctactctagtctctgatattagtttcattacacagctataatcccattacaaagaacttgaaggaactgttgacattttttgctgccctggagtttattgtctcaagtattgcttgaaataccagggtacatgcagagatgtctgctctaatggtatttgttgacctacattatgttagggttagcctgaataaatggagaggaacgctacatggaatcagttagttagattgtttgtaagtaggcgtgcattatttttaccatgttttattatttttaacctaaagactacgcatttaaagtagggtattatctgtaagtaatcttgttgttatatgaaacagtaatatttattaaaagtgcttttgtaaagcccaaaaaggggatctgcagaggcagatttactgcatatttaatggagcttaaacctcagggaccttcacttgcgcagccccccttccaaggtcctgtacttaactctgtaatcataattttgtattctttttcttcaagaggaccccccaaatagtttaagcttctggtaaaatcttgatctagcctaggtataaaataatcttgaagggatccaaactgatagttctaaaaggctgatgctgagaaagatacaaaatgtgcttttacaaggatatcatatcaattatattttccaaatgtatctctcttattgttgtcgctcccccttccctgccaataaataaatgccattttttttttttacctcactgttaaaaggttattagacccttttaaataagatcggtctgttcagtgactgggaataaccagagtgttaaaaaaaagatgaaaaattcagaggcagaagataatttccaagaatgaaaagatatcttagagagactcacaaaatgtttcactaaaacagcaataattattatccatacctaaggagtacatgcatttgagaaaaggaagggcatggaaagtctctcaatacaatttacagtagtacctactgaaaactgtgctgagtttacacagagtgtgggaatttttaccaccagtaacaccacgtgtctgtttttctggtttctgaaaaccccaaataaatcccacaagcgcctctaaactccaccatggaattctcacacttctgagtaagaagttcagaacagaataaaaactttggatgcagtatgtctgtctatagtttttcctataatgccttgtcccagtttttgaagaaaactgaataaaaattaattcaagaaaaaaaatgaatgaaattacctcaaatggaatattaaattgaaaaataatagtcaaattgctcataaccacttcctgttaattttttttctcttttagaaatggagtaagaatgcttcaaataaaaaacgtaaaacccatcccatcccataaagggcccactcacgtaaacaggaagcttattaaaagaacttttcttggtttcctggcaaaatccagcttttattttggtggcagcatctattaaggaggagactcattttgtgggcaggatgaaaaattaaacattgcaaatccatcaggtacttgctggattagagttagttgactgacttgttggctacagggaacaaggtagttctgaaaccaaggaacaagctgccaaggaacagtccagccctgcccaaaagatgatggtcttctccatccaggcagcacaaatcaactcgaggttccaagagggccagtagacgccagcctaccttactgtaaagtgtctcacatgcatatctaactgttctctcctttcctttacatttaaatcctgttgtattggcttctctgttttccctttcctggaagcgctgtagcgtaattaaaagagtatgagttttggaatttcaaaacttggtttatagtccagcctctgccaaatactgtgacatgttacctgcttgagccatcattttctgatatgtagattgggactaacaattcttccttaatcagctcaagtttcacaaaatatgggtaaacatcacgtgactcaaaatcaactgaggcaaaaattcagatgtcaatggccctttcttgacttattagaacctccatgagctagaaattcttggaatctgaattttaaactcactcccaagtgatttccatacacacagaagtttgagaaccacatcccaccttgtcttgtgtcaggattaaataaaaccatataggtgaaacttatctgtaaattgcatatcaagacatgcttagctgctctcaatagtatcattttccagatagcccaaagcaccaaagtaaggacagcgggccattttcccaagatctttcttccagcttttccctgccatgccaacagcattcttcatcttcaggtaggcagggcaggttcactgggggttggggtagagctcagcactgtgacacaggcagtacttccgtagaatttcatttatgtgactgtacctaccccacagggtgatataaggattaattcctatttggtaatttactgtgtgtaaaatgccttgagccccttggaggaaagtgctatataaatgtaaaataattattataataataataacctcgactatttaactgatcagtgaattagccagaagatttaggctgccaagggacaaggctgaaaccattataagtagaaacactttacatcatcatatctcaaactgttatcacgaaaaagggaaacaaagggtgaaaattaagataaatccatgttctcaactgatttaaatgacagaggatcactagtaatgattcatgaaagccaggaaatgcaaaaatgacagctgcattgtaattctaactcagccacatgtcctgaggttttgtacactttggtcttttatttgtagggaaaatatctcatcagtgcaacatctaaaatttagcattatgaaggcacttgactatgcttttgcttagttgaaatacgttcataatgtatcccctatttgtaggtaatgatttttctacctaaaaagcattgacattattctatgaagttccaggtaaattttgaatcggttgcttacaatctgcctccccacatacacaccctaagaatacactctaacaaaacaatggtgtatttctagatctaaatttaggaaaccaaaatatatagaagataccttttcttcccaggaagaaaatgctttggtatataaactcacatgagctcaaccgtcttcagctcttacattatttgttttatttatttattagattcatgaagattcttctaccaaaagctcaaggggctgaacccagaactttcatatattgaatgtgaatcacttcttaaaccacagaaaggaaaataaagggctatagaaatcttaatgggcaagctccagatgctcaaaagcaattgtttagttactctacttagttatgcatcattcaaaacactttctaacaatcgggcaagaaaggttcctttgtgaagaacaggctttggggtcttggacaagttttaattctagttgttttatagctcatacaaaatagttgtggtgcatatgtaaagaggtactgtacttacatgcaataaagtttgcagatgaatattttgaaaatcaaagaaaagaaaacaaggggaggaatgagcatgtggtaccttgctctatttttaattattaacttgtagcctcaaagatttccatttagtagaaacacatgtaaactacaatgaaggagtactagaaaataaagtcaattggtataactcaaattattttgtaaaatgtgaaattaagctttaacctgtctatgtggaagggtgatgaataaatgaatgaatgaagtaaaaaatcaaagatacagagttgtaactgattttctttgcatgaagtagtaaatattaatattagaaatatcttttgatttagataaaactggccttgggtatataatacacaacactgaaaaacatttcaaatgtggtatttgtttaaatatatacatacataaacacacacatacacacacaagtcaaaaatatgggtgttctggtatagttttctgccttcaaagggtctctggaaaaaacagaagaaaaggtatcctataaactgcttttgctgaggtctctagtagagagcaaatcgaggcaagtgctgcccaaaataatctctattacaaacatttaaaaaatctatctttcatatatatatatgaatatatattatatatattatatatatacacaatatttttaatttttaattttattttatttgctgtatagctaacagcatagccaatgccctgatcttctagccacactgtaatttcttgtccttgcatcacaaccccagctgtagtcatcaaagtggaaaaactgacagcattgtctgaaagacacagcttgggaaaattgctccttgtagctcccctgtcaatgaatattatcatatttttctcatggataaggttactgtgttttttttgctgggccgggggtggggaggcttctacatacttagctactaagcacattaccattccgtttgtggaatggactaaacgtgacaatgcgagctgtagggttagcattcccaacattctgttttaaagtttttgtgtgtatatcttcaaaaataatattcctttatgtattcagaagaagtaaaatcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttagatatactagatgccattgtaatcacatgtattaactcgctaaatcttcacaactctaccagagagtactgttattactccgattttattggtgaggaaatagaggcacagagagatcagaaacttgcccaagatcacacagtcagtaagtagaggagtcaggattcaaacctaggaagccagactctgttacaggatgaatattttggttgctaaaggccccatcttccttacttctcctgatcctcttccccaactgatcagcttgcagcattcatttgatcttctcaacaaattacgtattcatttgcacaccgtccatttagaataacacagtagttaaaaacttaggctctggagtctaatatgagggtttactgccacatattggtagtgcttaacttttctgtgcctcagtttccttctgtataaagtagtaataataaaagcaatttcatgtatttgttgtgagggttaaatgagataatgtatgttggagctcaatggaaggtcaatgttctataaacattaagttcattattattgatttttatctcttaataaatagaatccctttttccaattagattgtttttcagaaaaattgtgaatatgaatcttttttgtctcgtgtaggggttcccaaatgttcagtatgttgaactcttagatgtcctaggtactactgaaatcacgtgtattaacattcataacaactctgtcaggtaatacttacatttacccataatattataaatgatataatataccaatgtctaaaatttagtgagaacttactcactggacaagtgcattatggcattatctcattctccctctaagcctctgaactaggggatttttttttttttttttttttggagatggagtgtcactctgtcgccaggctggagtgcagtggcacgatctgggctcactgcaatgtccgactccctggttcaagcgattctcctgcctcagcctcctgagtagctgggattacaggtgtgcaacaccacgcccagctaatttttgtatctttagtagagacggggtttcaccctgttggccaggatggtcttgatctcctgacctcgtgatgcctgcctcggcctcccaaagtgctgggattacaggtgtgagccactgtgcccagccaactaggggatttttataatctcaagtttatgcaggaggaaacagaagctcacctcggtcatcagctggtaaatgttcacaaatgtaaattcttaaccacaatgccatactacctgctaaaaaatgaatttaaggtagatctttagtaaatatatttggtcttgatgatgaatcaattgaattctttatttctgttaccagaaaccttgcacttaacaataaactaatgtggccttgaccagcagccgccagtccccaggcttcagacactggtacctgttaggaacttagctgtacgggaggagatgaacagtggacaagcaagcattactgcctgagctctgcctactgtcagatcagcagcagcattagattctcattggagcacaaaccctactgtgaactgtgtatgcgagggattgagtctgcacactccttatgagaatctaatgcctgatgatctgaggtggaacagtttcatcctgaaaccatccccacacctccagtccatggaaacattgtcttccatgaaactggtccctggtggcaaaaacgttggtggctgctggcccagacaatatcactcattctgttaactattgaaaagagatgactgtatgtcaggtacatgccaaatactggaaatttgaaaaatatatatatatacattgtgggtctaaaactgtatcattaaaagcagctaatgatttaatatcatttcatttactatcattttctgtttactcttacaaaaatcaaacttcttcctctccccttcctctctctgcctactctttcttattccttcttttaaatcaaagttttacagtattaaccttacaaagatttttgcccataagaaggttatatgttaaggcaaggaactgttttaattatatttactcttcattttgagtatatttctttttcatacctgacaaagacttttgaaatgactaaagaaaggcaaagcaatctgattctttataaaaaaatctttcatatgcaatcttttgtctgtagtattctcataatagcttagaaattttaaaagaaggttttagctggttttgttcttttcaaattggcagaatttgatttttttcctcttcacatttggattcactttaaaaatcaacaaacaagaaaataaaaacatattcaatttaaaaaatatgctctccattggtgccttggcatcatcaaccaatatcagcatcactctgaaaaccatttctattctgtttttaaaaaaaagagttttaaaatgcacacataaaatgcacttaaaattgatcctactgtattaaggagagagaaaatttaagggcaatggagagctttgctgtaaccaactcttcagtcaactataggatattgttaatactgccttcacctccacactgaagatataggtaccattttgactgtgcttttgaacaatatatagctaaagatttgaagtgagtaacttcaaagtcagtagttttcatgtatacgtcgcagaatcactgcatcttatgtatgactttaagttgtattaagctgataatttcaaaaagagagactttcaatgaaagaaaattcctgaaatttggtcattaaatggttcgagtacgtagaattacttacaatgtaatgccaaagaaaggtatattgtatttatccagaaagcacgagcataagaatgacctcagaaagttattataatttattacttcattaaagatacatttctagtccatctattatgtgctaggccttataatagacaacaaaaatgcaaagaacaacaaatgtgatctgaaaagtagtaaaggttagggaagatgggactagtaagagagaacagaagtaagaaaataaagtgattataattgtaactgccatgagctgagggcatatcatgcattgaggtaaggtcctaggtgcttaatatgaacaagccctgcaagacaggtatcataatctttgtctcacaggtggtgttgggaaaactggctagtcatatgcagaaaaatgaaactggaccccttccttacaccttatacaaaaattaattcaagatggattaaagacttaaatgtaagacctaaaaccataaaaaccctagaagaaaacctaggcaataccattcaggacacaggcatgggcaaagacttcatgactaaaacaccaaaggcaatggcaacaaaaacccaaaattgacaaatgggatctaattaaactaaagagctcctgcacagcaaaagaaactatcatcagagtaaacaggcaacctacaaaatgggagaaaatgtttgccatctatccatgtgacaaagggctaatatctagaatctacaaggaacttaaacaaatttacaagaataaaacaaataaccccatcaaaaagtgggcaaagatatgaacagacacgtctcaaaagaagataattatgcggccaaaaaacatatgaaaaaaacctcatcatcactggtcaatagagaaatgcaaatcaaaatcacaataagatactatctcacgccagttagaatggcaatcattaaaaagtcaggaaacaacagatgctggaaaggatggggagaaataggaatgcttttacactgtttgtgggaatgtaaatatagttcaatgattgtggaagatagtgtggtgattcctcaaggatctagaatcagaaataccatttgacccagcaatcccattactgggtatatacccaaaaaaattataaatcattctactataaagactcatgcacacatatgtttattgcagcactattcacaatgtcaaaaacttggaaccgacccaaatgcccatcaatgattgactggataaagaaaatgtagcacatatacacatggaatactatgcagccataaaaaaggatgacatcatgtcccttgcagggacatggatgaagctggaaaccatcattctcagcaaactaacacaggaacagaaaaccaaacaccacatgttctcactcatacatgggagctgaacaatgagaatacatgaacacagcgaggggaacattacacaccagggcctatctgggggtctacggctaggggagggatagcattaggacaaatacctaatgtagatgttgggttgatgggtgcagcaaaccaccatggcatgtgtatacctatgtaataaacctgtatattctgcacatgtaccccagaacttaaagtataacttaaaagtttttttaaaaaatatgtgataaaataaaaaaaagaattaaccacagtgccttgcctattcttctataacagtatctatttcactctattttattttgaagctatttatctccaagtttctttctagaatctaaacagttaacagcctgagggcattgaccttgactcttgtctaagttttacaaacaaacaaaccaaaaagcacactgcattgatatacttggccaagtaatgatgtccaaatgctacaatgtcacaaccagtgctcagtaactattagataaataagatagagtcattcactcaatcattcactcctgcatgtttcacttagtaatcttgtacgctcattgaataaattaaaagctgctttatgaaaatgttttctgttaatttgaataaaaacctttacacatcaactagatacaaaagagaaatctattgtttgacaatgatcgttactgaatcaaaaaacagtggggccatctgcagggtacagatcatgctagagtcagggaaaactggtgataaacttcagaaagccaagaaatataccagcttacaacttagcagcactgcctccacacagtcttcaggtatttattgactgtctcacactaatgcatgagtgcctgtggtaatggtaaaagtatataaatttacttgcccagagatactaattgttaaaacaaatacaacaatttaatggcaatgcaagagaagacagactaacatttacaaagctatttcttgtttaggcaagatagtagactctaaacatatattatctcatttaaattatcatttaaaaacccttagattgttagtatttacccattttaattaaaaacataactgagcgtataatttttttttttttttttttgagacggagtctcactccgtaacccagattgcagtgcagtggtgcgatcttggctcactgcaacctccgtctcccgggtttaagcgatccttctgccttagcctccaaagtagctgggactattaggcgtgtgccaccacgcccggttaatttttgtattgttagtagagttggggttttgccatgttggctaggctggtctcaaactcctgacttcaggtgatccacctcccttggcctcccaaagtgctgggattacaggcgtgagccaccacgcccagcctgtaaatcttgacaaaattcccagaggcaaaattattagaaggctgggagccaggattaaaaaacataaaatccttggcttttccatttatttcacattgcctcttcttagaatccacttctacaccaaagcagttaaaatcaatgtggatttgtattttaatagagggtttatggagtagtgggaaagatagcaaataataactatgtttattgaatactactgttcctaacattttgaacctatccaatcatttaatcctacaacaatcttttggaagtgagtgctattattattattgccactttgtaacagagaaactaagccaaaaagaagataaacatttgaaaagtcataaagctagttagccgctgtgcagctgaacttgacagcctatagcccacagagtttaaccatcatgctatattgcttcattaggttgaaaggttattaaatgaaatggcttaaacaaagttctaagcacatggcatggcacagagtaggtcttcattaaatgttagtttctgttttttctttaatctctaaaattctataataataatacctttattttcaaagtaattctgctttttaaagactttatgacatctgatttaaatttcacaaaaaaaggatggtgaatgtggaataaatcttcacaaaaatgacactgaagattatttaaaggcatagaatgttactcacaacacagatttaagagacaaaagtagaaacagtgttcacagtgttttaccaaaaacaaaaagggtatatatgcacaggaaaaaaaatgattagaaaggtatatccccaaagtttgaaaacaaattacttctagacgattgtggggattttaatcgtcctcttgtaatttatgctacgcacagaattctacaatgccttttgtatgctttctatactaagaaaaaataaaaaagaagagtagtactccttttttgagatcataatactgaggggggagaaaatcagtagaaatgtgtgagatttcaccctcagtgatagagctggaatagaattcgcactcttcatctctaacctactgtgttttatctgacccttattttctattcagtgcttaccataattgatgaattcaaaactaatctatgatgaaaacccctgaaagtgattagagagactgtgattgtaaatgtggtatcaatcactaacacaaaagtcccttataactcatcaggcttcttaagttgtttattcaaaccatttgtttctgagtccaaaccaataatatatgtgatagaccggattactttctctaattcttcactccctctctataatagaactttacatccataaactttaccatatgacttgaatgtaactctcagtagagtatgtgttaatgtgggagatgggatatatatctctgtctcttggctttgagcttggttaagtgacttgctttgactaatgaaatattagtaaacatgaaatgagcagagactttaggtattttctgcgggaacaaattctgtagttgtcaatagtttattctcctagattaaatgtttgataaacttttctaaaagaaggaatttttttttcagagagaaatatagctaacatggaatatcatgtccttttgtacttacctggagccaaagtaaactacttggaaaattaaggtaccttttgctggactattcctcatcctttagtttcttcagtccagactgggacattttggttaaaaaggagtaggcttgtgatgttaaggtgatcatcttggtcaccataccccagaaaaaatctttacatatccatgtcttagacactgaggtacagaaagagagttctgaactttccattccattgtcatttgtgttgtggagtcttattaatctgtctcatggaaggtgggaatcaggctatgaatggacaataattcatggggggcagtcaacagtagagaagaagttgctgcaaattgattaatacaaacaaaccaacctgagtacctggctcattttaggttccctccaaaggcttcagtacaggcagtaacttagaaggtaatctcagagggtaagataataataaggattgacaataataaggattggccaggatctctgagatttacacaaaatggctccagaggtagacattataaagaaatagaggctagaacatctctttttccagctctattcctcctttagttgagagtttccccagggcattaagccctgggggcttaatgtaagccccactctccccatcctagattttttgagatctcccagcattggaaaaggtcctggggcagaaggaaaagcatacttgaggtgggagtctgggttagcagagaacggcttcaggtgcagctgaagggaccatgacagcactgcctgacatctctgagggactatgacaggattctgacagccatatctgctacagaagcctgtaaagacttggggtggggggcagtggtgtataatatactgtgtagtctgatattgcatcctttaaagtatgatctggggaaggttaggctgcatcttctttattaaattatattccaaacaagttgtctcctctgactcctgcatgaagtcagactttgggacagtaaatcctacactgtccagctaagaaaaatgacatgttgttaataggcttaactgattctcttgctatgatggcaagatcagatttttagcagtgcttctgaaaatcctgacactcattcaccaattattttcttctaggagtctaatatgtattcatcttcccatatttcagggaagaaatagttgaacgactttagggagcttttcccaaaatgctgacgcatttttgcagcattttgccataatggggcctattgaaaatttttctgacattctgaattcatagcattaagatttgtggtgttgtttttgtatctggtttgtatttatttttgtttttattaaaatacaggagaaattgggacaggttaagagttgcacctaaatgtatgaagcttgaggtctttgaacataaatgagttagatatacagaaagttattaagacctttaagcattcgtaaacatttcatcattgctgacaatatctatttactttaggtaaccctgcctgagcagctcctgcattgctacaaggatgaaggtggggttatttaaaaatttaccaagctgtgaaagagttttctggagaaaactggtttggggactcagagcataaggataaacaatggatacttttatggttacaggagaggagttgataaacccctcattcctctaatgtaatgtataaaagaaaatattgtattcctggtcctcacaaatggggaggtggtagggtaggtaggttatatgaacacacatgtcttccctttgacaatgagtgggcaggcctttaaaaaaaagtctgaaaaaataaagagccctggggaccatttaggctctatcagtgagttctatcctgagatatcaaatccagttgcacagaatctaaatgtcaatatttacaaagctctttccatcttatatcccgcttcctttttcttttatgctctttctaccccttttccttcctccctattcccttgatcccctacatcattctgttttcccatttgctctcatttcctaacaacccccatccccattagtcagtccaaaatctgttcatcccgctataggcttcagtgatggaaaagaaagggccccaaacaaagccaccatccaagacaaggagctccagagggtggtgaattggtgattgaggtaaagcctggggactgagaatgttcaccgctctggaggttcttagcccgaaaagtgattaggcatcagcaggcttgatagctgtatcaagcctcatgatttcaaagctttcatgagctgacaaggacttgctaatttcaaactttctaaccaattacaatcacaaagaactcaggacaacaatcagtgagcaaaatgaaactgctggagtgaagcagccctcggcaggtttcactcttgtagctctgctacgcaatgtgcagctgggactctgcttcaataagtaaataaaaatacattataaaatacaaacatacacaatggatcccacttgctgtcttgttcccagtaaaggggtatgtaggaacgctgtcttgcattcattcagtccattaatttctgatggtgttaattaaaaacttttgatgctggtttgaatggaaaatacctcaaacagtgtttcctttattgaaacaccaagttccaagtcttggattattaggttaagctctgtcagtagtgagaccaacataaatgcttttcataccgtatgctttgacaaaagagaatagtaataataataaataaataaatgaaaaggaagaagaaataaagtgtttagactgaaaactcctttacttcaccaacctgtttttttaaggactaaactaaaaatccaggtccctgaatgtagaacatataattttaaaaaaatcttttttcaaatctttatagaacattcaaatcacccaatgttccaggacctgaattttttatattttaaaatgaagaaagctgcttaaaataagtgaatcagctgctaagtgatttctctctgtcttttcctctactctctctttaaaaagactggaaaatgcttaaaatggtatatgcaattgatatgtgcagcttaaggagcttaatataattactgaggactcagactttctatttaaaaataagatagggtagggtaacagaaactctgagtggtgagtattcatcccttgtgatggtgaggtgtgggaaatgtttccaaatgtttaatccactgagcaaggtaaagagtgcgaagcagttattcacagaatttggtgtccttctgaaaacctagggaagcctaggaaatccagagaacaactgaggaggatagtatgagagatgctgtgcaggaaacaagcaaataaaatatccatttcttcaatccaatgcttttgtgaagtattaagccaaccaccaaaacattctgattgatttttaagactcttctctaattttattttttaattactcttccctttgtgtattggggtctgaagccttgggcacccattctgagaggtcttgtaaatgtgtctcacatatgcccgtttctcttttgttttctaatatacctttctctatcatttttcatttcccaacctgtttattcacactgtctgcaatgtcatctgaatcctcgaaaaaccacaagactttctctttattccccctgaaggccttcatcactcttgttcttgttttgatctacatatctctaacgagaatgaagttctccataaaggctaagcagtttggcagaacttccttccttccctccctaaccgcaggctgtattgacctcaccctcttggatcagtttgctaaaatggcctccaaactttatgtgatatgatagtgaaccttcaacaacaacaacagcaataacaacaacaacaacaagagcaacaggataacttcagtgtaaggcatgtgagaaaaatacgcagagtaatagaactaaaactccatgagggaaatgggcctgagcaaaccacagcatgggtctttttgttaacaaaatgtatgatttttccccagagtacattgatagaggacatagcctacaaaggaccagtaaatgtaaattaactaacagatatgtagcaaatgaatgcatttaaagatgatttccagctgaaatgtttttttttttttttttctggagaccaagtttttgttaaacttaatccttactctctttcctttccagcagcagaaacatctggtcggttttagattccccttggatttccaacttcaaagggaattataaagaataacaaattcatgtaccggcactaaaaaaaaattagagcagcaggagagaatggtaaaattgtccttatttgactgctagtgacaggcgccacaggcagaactatgagaaaagacaaaggcaagatcaccagttgacaaccagagttcctgcaagagactgaatctttggctacatgcaaatatgcacagggcccttaacaatccatagggagatttacttgcttaaggaaaataaataggtaaataaataaaaggagttgaaaggtaaaaaaaaaaaaaaaaagaaagaaagaaatgagttcatgtttgcctgtcacatagtttgttgaaataataacaaataaaccaataaatgtttattgaaagaatgacctggaaataattttaaagatccacttaaccccttgggttttatttgatttaaagaaaattgtgagagttctgattctacaaagggctggataagtcatccaagaaataatacaggctcttaagagtccactaaacttggatctccaaagttcttaaaagtagtttctgtttctcctttggctccagatccttattatcaaaagatgtgacgagaaatcaaagtcttcttagtggccgggcgcggtgtctcacatctgtaatcccagtactttgggaggccaaggcaggtggatcacttgaggccaggagtttgagacaagcctggacaacatggtgaaaccctgtctctactaaaaatacaaaaattagctgggtatgatggcgcgcatctgtaatcccagctacttgggaggctaaggcacaagaatcacttgaaccggggggacggaggttgcagtgagccaagattgcaccactgcaatccagcctgggtgacaaaatgagactccatctcaaaacaacaacaaaacaacaacaacaaaaaaccaaactaactgttcagtacatgctcagtacttgggtgatgggatcatacataccccaaacctcagcatcacacaatatacccaggtaacaagcctgcacatgtatcctctgaatctaaaataaaagttgaaaaaaaaaaaaaagaaatttgtaactgtgtcaagttgtgtttgacaccactttatagaaatggatttattcttctcctctatcattttcttagcaaaactgaaacacacttctagagtgcaggtcttgatataatcagacatgagaaaatgagaacagttagagaaaatacaattttgccattgtaattacctcttacaaacagcctttcctctttcctgttttatgtgcaatgtgtacagcaacaacaataaaaataaacaaagacatgattaaccgatcaatttgtttctccaaagagagaaatagttaagggctaaagtgcctttcaataattaattataagagtctttaaacttagtattgagaggttacagatttccataccacaaatacattaggttgattcacagagtggccatcaaatacccagaaagcaaattacttttgaccgaaatgtatacatcaacagtacggttaggaatgttttcatagaggaggacagaacatacataaccagttctctatggagcctagcatagtgtcccatggaccaatccacataagataagaccatctacagagcatattcttcatatcacagactctaggtaagaagaaagtattctctaggtaagaggagaaaaataagtgaagatttctttcgttaacacttccaccatgaaaggaatgagctgactacagaaccattttcttgaatatttttgtcttgagtggggtttttatccttccttcaccactctaggtagagcagaatcaccaaagttctctcattacggtaatgtcataaatcccatcctatagcagttgtgcatgatcctgtgttatgcatccaataaagtttattcagaaaatatgtcagcttcattaaacagggatctgatgatctgaacaaaccacttatcttgcttttgtgacatgtattggtatccttaggtctaaaatgaaaatcttggttggtgggggtatctgccaaggattccctgcctcatgtaagcagaatcatctaaccacaattctgagcttaactgggggaaaggaggtggaaggtgtatcgtactagttcgttctaagaaatgtcttatagcttgaggatacgtgaggtcacaaatgtaacaacaactgaactagcaccaagagccaaagaggccaagcataaggaaacctgaagcaagagaaaaaggtgtacgcgtacatacaccaagaagcaaatgctatcattaataataattattgttattacagctattagaatgatgaggcattgatggttcacttgggtgaaatatataatacataagctagaaagaactgtgggtaaacttatggatctttttaaaaggcagtttatattctaggtttatgtgatatgagacacataatttaacaccacatataagaacaggatgctgaaaaaagtgaagaagacttgcagctttaaaatagtataatggctagttcctactggtcttttcttgtgacacctgccttagtcaagccatccgatatagttctaaccttttctgatattttaatgatgatgacaggcccagagtaaaggagacaaaataatcagaagattcagaggggaaaaagaaatggaaagaaaaaaaaagagtttgtattgtttataccatctaatctgacaaattttatatatgctctctgtttgctcaggatagtttattgctaatgttatgactttctcttttttttccatgtgctttgctctaccagttttggctgaaaatattttgtatatgtccatactgtaaaccctcatatttttctagagatttagtgtggtggggaaacttttttttcttccccaagggttaggcacatcaatattctagctactcacttttgaggccaatggaaaatgtgctcctaagattaaatagacctgagtaacacataaattcagtttatactgatgcagtatgttgcatagttacatcctgaatttctgatgcgtgtaatacacctgttggacaacacatcactactgaatagtcactgacctacaattcaaagacagtgagacagcacaagactacagatacaggttctctacagacagcctgatttgtacagagcattcctcatctgtggaactctgtgtgtaaaggatctaggctagccatgggaagctggctcatagagggttctaaatatttttagaataaactagagcaataatacaagcacagagagcaccctttgttatacaatgcataatttctttccccccaaacatgttgtttaaaaatgattcagatttttattatataattcccccttttacatatttctaaatgcctcacatacccatcacatgttttccatgtctgccaataatcttaattaaaaattataaacttttaaagccagtgttacatttgatttaagtagatttgccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtgaaatatttctctaggcaaccaaattgccctgtggcttacagatgtgtctaagaatattaggcaactcactgatgagattttacaatcaactgttacatgttagaaaatatgatgtcaggatactatgaagaaaaatactactatatacaataataagaactatttatctgaatagtttttaacattaacgtgtaaaaaatatcctgatggatctgaaataatgatgtactaaatactacaatgtctggggtttgcttcaacataacatggtgatatagtgagaaaataacaggccatcagttagtcattgtgcaagctggtgatgagtacatgggagttcattatagtaatttgtttatattcatgaatttaagattttttatcataaaaaatttaaaaacatatactgatttgaacttttattcatttattatttgttgactgattcatttactgtttatgcaaggtattattgagatataaataataataataatgctcttattgggcatttaggttaaatgagctattcctcttcaggaatattatatatttattttaaatgtttataaggtctatgtaattacatatttcttaggttaaattttgaaagcaggacacaaaattatatagaaagtatgataacatcatgttttaaaaatatatcctcggggaaaatgagagtaaggaaatatatcaaatggttattaatgattggatttaaattatagaaataattactttaatttttcttcattttactcctatgtgtttttctaaattatttttaatgagcatgtatcattttaaaatgaaaataaatatttcttcattactggaaaagatatgttctccttccccaaggagcttttcatttactgaaacagagaaactgcaaacacacagcattgcccagatagtttaaatctccatacctagaagggaaatacacccacaggaaaagaaacgtcaatacagattttatctgatcatagaaacataaagagctttctctgtgttggacagcaatagggaagaaactggcttgtttgcaagccagcaaaagcgtgaaattcagtcctttttgtgatgagatcattttgtgataaatgcaaaaggagtgacaaattaaagtcaccaaataagcctttcccttgagctcctgaggcttactaatacgagtttcttttggggtagcatagcaagtaaagcgtgggagtggggagggaggcggagctacaatcccgaaggctcctggccttcactggtgagatggatatgctcagagagacagagatagatgtgcaacagaatcagaaacaacaacacagtgacaactatggattatgcacaatggatatggaaagtctctgttagaaaactatctttattaccccaagagattatttccctcagtttatgcacgttcatataaagcgaagtcaagagtgtaacttttaaaggtttggatgaatatgatgttcatgactaaacaggcctagatggagccaggcagaacacagttagatgccagggaagtcacccttttcctcctcctccctctccagtacagttgccagtgcatttcaatgcaggtcagcctctagcaaagtcagctgtttcaagctctgattggataatactttatctatacacccccagtcttgacctgcactcttctcccagtcatggaaatatcaagaattctagaaggccacaataccaatctttttgaaactttacaaactttacaaattttcactacaagacacctagaaaaatcttcaagcctatgcttacctgtagccctggtcttggtcctcttacttaactggtaaaagaggatagccttatttatgtctttgaagggtattttccttttttgcttgttggtaagtacaagagcaaccatgtctaattttaagattgatccaaatgaagcaaatgcatttcaaatttacagaataccatagaatactaatgggtagttcaaagtatcactaaatgtgtttggagggttttgagttttttcaaaacatacaatgttccacacaggaaacatcagtgccaacttcaccctatcactctttctgtccactcaggagtctcctttggaaatatatctctctggagggtcttccaaacaaatcctttgaatacttccatcttgtttagcagagtattctaaaatatttgtcaaaatctgtgataataggttctggagatcatgtttcttattcttctaaatgctggtatttcaaatgaacaaataggatattaaagatctgtcctttaccaatgtcaaaatatgttctgtcaaaatttagtattgctaaagtttagacccaaagactcaccacagcctttggatctcatattttctgaggttcatggaaagatatttgacttctttgcacctcaatattttggactgccatttagagataatgagagttacttaccagacagcaatgtcatgaggaatatcctgttagtaatgatgaaacattctgaaataaaaagagtacaggtaagtgctaggtatttattttaataaatgtatgataacatggtaatcatagaaaataacccatttattcctcactttgggatactgactaagtggtagtatataaaaagtaaaggatgtttccctttgggaatggaaatagaattgtgcactaagaaagtatcttttgtaactgcctgcatgtttaactttaaggtctctaaccagttgcaaccagttatgaatgacttgctgcccatttctgcaattcactgtaacttgtgttgagaaggttatgttttatggttaattatccatggtctgtttaaaaaaataaatcaaaccactgtaaaccactaggatttgcagctccatttgagctttactgtagttttgatcaaacattttgtacataaaaacaagctggtttctctttgtttttagttgtttgttatttgtgttataaatattgtggcaatggtgggagaataagctatggattatttaccctcggtttcatgagttgtgagttattggccttatcctcctttataagtataaataaatgtataatattatattccaagtcttgtaagacaaatggaacgagtgaactgaaaccttttagacccaaaatcttttatgcgaagtcatagaacaacaaaacaaaacccaaattaacatttaaaaagcttctactgtggagcaacaaagtctttaaatattatataatctgcatttaaaaaactgctcatctaacaggcagcagtctatcattctacaagcttttcaatgcctttaacattcagaagctacaggtggttttcccaaagatcactcagcacccccaatatcactaccacaatgaaagccttgaaaatggccagcatgattactttaagccaaaatggatttagaaaaatcaggaattcgtgtagctaaaagtaatgaaacactgtataaaagaagaaccctatagaattttttttatagttaccatcctaggacttatataaacaaaagaagtccaaaaacaattgtccagagaaaatgagaaaagccaagattcaaaggaccctgtggcagagtgcatgaggagcatactcgatagctagaatcataagtatctaacacatttgcatatgaaacttaatgaggatcaccaaagtagcttgccaaaaattatgtttgttaaatcagccaacagtctatgtagcacagacccctaaaaagaacctctaggaaagatgtaaaattgtcttctgaaatttgcttcttttataaaggcagaaaggataaaaaggcctttctcataaaatgaagtgattggtccactactacagtctgaagagttctgtatcagatttcttcttaccctttattacttgtatggcttactgcttacctgcatcagcagtctgcagggttggccatagcaggtcccttacgagttcactgaaacacggaaaatatttatgatggtactattatgtgccagacacaactggatggattctgcttgaaaaggtaagtcagtaactgaggttcttgttgccacattaaaagaaaaaatctatccctactgccaacagcaataagaagagaagctagggtgaaagagttgtcaaagacttatgaaaaattcgaaactgtttaaaattctccctagcttcttttcttgcatgtccaagtaacagaaagcttaggcctgccacctgtcttaagcctggatcccatattaaaaaaataaaaaaaaacagaaaaatgagaaacagctaatgtgttcccaaggccttggttacaacagaaaatgagagccgagaagtctacattggcacacatcgagatttgaaaggtcagtcctgccctagtatggttcagagaccgtgaaaacccaccaagatgaaaatggaagctattctgacaacaagaggcagggaaaaagttcaaagacttttcctctgcttcttttataacgagatactttcaactatttttgacaatcaataaaatgcaaatctccctcacttttgtgttctaagttttttttttttaaatttaaacaacccatttgaaaattagggtactcagaataacttcttgtatacagaactacacatttaaaaagctttgtgcagattgttaatcatattaaaattacatcataaacaatgcactttacatggtgcaaatgttttatgtttttttcttttgacaatcaggcacctacatgcaaaactgcatattggaatccaaactcaactataatacatgtagaggaacccttagaaaaatgcatgtgggaatatgatatcccagttagagactagaatattctgaccaattttcattatttctctgtaataaatttatctgagctatagatcctgttaagaaaataaagctaaatggaaaagtattgataaaatacattaaatatatatatactagcttagtcattattcatattaagatcagaaaagatttccgcaagtcatcacaaatacagagatgggataataccaataatctcgatcacccagttgttaaaacagagaacctcacatttgggcaataatagttttgatttttatcttgtgcaccagatttttccatacaaaggaattctaaattgcaatagttaacacataagacagtgttaaacaaattcataactttagtaaaattaaatgaaccaatttcttatggctttaatatccagaagtaaagtatgatcttaaagaatgatgctgatctgagatacaaggagatcaagcgcttcaatagttcctcctcacacactaatgatcgcatccatcctctcttccacccacctcccaccttttctggttgtattaaaaacaatcaaaactaccaccactgctgctacccttcacacacctgaacttaatttcttctaagagatgcctaacagtgcctagggctgtgctatcactttatatccattttatgaccgcttgagaggcagaaactaaaaaggaagaccaaaacaaaacaaaaaatccctccaacctcccttatcagacaaatgcctggttcccagaggacaccagtcagttaagcaaaaccaaatattacaacagggatgaaggacttataaattgcatacaaatctcactgtgctcccacttaaggtggaaagggagttactccaatgaaagaaaagggggagggggttgtgggaaggagcgaagggctacagaaagagcgagagaaaaagagagagagaaagagagagatttattgtacatttgagacattaagaaggcagtacagtgaaaccaaaggtgttccagggagaaatgtgacagaaagctctaaatgagaattacagaaactattccttcttaaataaaactgttgtttagatgatgaattctataggaagtctgaattaactgtctctgttgtagcatctagatgttttctctttcattaagactttggagtttgaatgtactttgttaaaaaaaaaaaaaaagaagaagaaagagaaaaaaagaaaaaaaaaaaagcattagagctttatatagctcccaaagtaaaaagcaagagaaagatgggtttatataactggcttttttacataaatattacatcaggatacatttcaagtgaaaacacacaaacacacacacacccgtcttccttatactctttctattttaaaattcatttcatactttaaatgttgttggtttttcacaaaataagtaaaaacgaagtcaaaacatctcaaaataagttgccttatattacctggaaaattaacccatcatacaggtcacgatgtctcatttaaagccagttaaggtgctgacaattatgggacattttgctgcagcctagggcaactagaaagggccatggatgttaactaactcccttttaaacagtctgagaaaagggaaaaaaaactgtaagtttccccatctgttatttccttttttttttctttttggctgtggaaaagtaaaattatgcaagagcttttgaatgtaaaggctgtgtgtgctttttccctttttgtctctgtgtaccggttaagtgatgttgcgtaactgagtacagagtaggcggttagcgtttactattgatttacactatgccatctaatgaattcagaacactaaaaagaaaggagcaggagagggagggaggaaaaagagaaagggagaaatagggagaggaaaaaataggaatgaaggagaggaagaaagagcttattcagagaaacagttctaatgactggaataggttcatttttattcctatagctctgacttttggttattgttcagctctcacaaaaaaatggtcttgagctggtgaccccaatattccaatcctatttctaataaggattactggcaggtgaatgcctgaaagttctaatgtgtcaaattacttgaaaccaatttcactatactgtcagactcctccatatgcatctatttatgattctctctatgcatttgtgaatctgtatctgtgatcaccatggatttggtcctactggcttacccaatcaaaaatattatttgaaatatatcacgggaatgtcatcagggtaaagagaaatacattctattttacccatctcctttaaaaatacataaagaacacatttagaactttaaatatatcactattttactttgaaaacagacatgctacaaattgtttggctgaacaaaacagcccaatataggataataaaagagaaataggcaaaatgaggaagaacgctaaattgaggaacaatattcataaagaaatttaaataatttcttatgtctatggagagccttttacttttgtttgggtggaatgcctgtagcattctcagtctttgaatgctgctcagtgcttcccatgccatataatgaattcccaaagcgtggaccagaaagaaagggtgaagttgtttctgctgctaggtacaggtccttcctgtacctgagtgccctcctatggctgagaacaaccactaaggtgagaaagagaaagagaagttctctttagtaatcagctgaaaagctgggcagggaacttgatttctccctcaatgtgtgtttgcaaatgatgactgggaaaaatcacaggaggttatccaaaggaaagaacaagagttggggtttctagtcatccagttgtcttctcttttcagccatctgagcttagaaaatattaaacagatgcgtactctgtccacttgtcaaagatgctttaatgacccatggtggtatgcacacagttgtatacctagcacttgccatggtgcttggcacattttctatactcagcaaatatttattgaaactgaaaaatgatgatgggagaaatatctctgtagaaagaatgcactagaaaggcctgaaaaaatatattccgatgttttacaagaaatcttaggctatattgctctatcattaatctgcacacaaaataatactgtaagagaaatatcaggcagttatttaggggtcagttgacttcagttccattttattaggaaaaagcttaacaaaaattataatactgataacatcagcaaagttttgtgttcatttccaccagcccttttgggctgtctttcatttcagtcttgggcacagaaaagtctattttaatttccatggacacattctaaagaaaaagtcatgggatatcaacgtaattcatcttttaaaaaatactgagacaaatgtagccatttagtaatggaagagaatatggctttttgttgaagggcaaggcaggtggagttttgattaggttacacaaatttaaattactagaaggacaccaagaatgtactgatttccattttcttggttaaacagtttttttttggaaaaaaaaaattctggtttagaaagtcagaaatgccatctttcagttaattggagaataagacctttagaaaaagaattgcaactacaatttctcaaaaattccagcgaagattcaacttaaagcatgtttagcaatagtagccatattcttttaaaaaatggggctaccatcttgttaattctgtaggactgagcatgtagatattagtcaaaaccttcaaaaagttttttatttctctctcttggtcatctatttaatgtaatcggattcagcaacttccttcaataagcattctggcaatatgtcaacaagatcattcatttcatgattcttaaaagtggatgagaacttacctgttcttcttcattttatatatgaagattctgagactcagaattaattttctcaaaagcatatattttgaggcagagctgggactagtatctaaagctcacagttcatttttttcacagcacagactaaatcaaagttgtataaattcaatcttattttaaatgccataggggaagatttcaaaggattcttttataagacaaggaattcttacattatgtaaaatgttcacctcaaagctatcttatacttttttttatcttaaatgtgagcctactgttcaaattgttgcttctccttttccttgtcttaatttttgactctttagagtctttgcctcctgtcctctcacttgtactctgtgtctagttcatatatggcccttcctgacttcatattcttccttctctctctcttttcatctttttatcaaacttttatttattcttgttcctcacagaaataatttccttgttaatgtgatatcctcagaaactacaaaggaagaaaaagtgtaaatttagtattattataataaataggcctttggtttatatttaaaacaaaactgcaataagatattgacaaacagagtaaactacagctataggcttccctatagaaagttacagctgtctagacctccatattatcaatatgaaaacttgggggctagcatttcaaagtatctcatcaaagacagagagcaaaggctcatgatctccagaccactcattttccactacatcaggacacctttcgtttcccttttctttctttccattctacattattgatatttgagactgattacggcacagcaggaggagattcagagaaatctccttggcttaatgtggtcaaactctctcaattccaaaaaaagtcagaaagacctgcacactaaaattgtagttacacagaaaaagaactctgaggaggttaaaagagtcctctgacatgagaaagtagtctctggatagcagggacattgctgccaaaatcattgtaattaagattgggtcattgtttccattataaaccttatgcttatggggtttgtaattcagttaaaatgatcagctgtaggctgaaatgcagccccaagtatcttagagtgggaggtgtttctcccctcctatttcttaaaaaagaaaacacatagcaactatttaataatttcaatgagagttgtattctgacccttcccctacaaagggtagttaatcaatgagcttaatctagagtgagccaaggtgagcaacatccactgtggaatgaagcacattaacctggcatatgaatgggcaataaaaggatttcctattatttcataaggtttaatgtacatcactccattccactgtattgatgtgaataggctttcagcaacaccgtgttgaaaaatctcccacttctgtttgttaactcattattgtaggaaacattacaattataggagacaggaatttctgatggtttccttagatttctttcctcataagctcattcccagggtcagtattagataatcaataatttctaaaatttcttgctcctatttctttagcattgtctacaatatctgatacctatagtgtaatgctatgtgccaccatgatgtagagggattggggaggaaatcatagctatatattaaaattaacaggccagaggaaactggtatttactgagtacatactacatgacatatattccattaatattatttcatttaatacaaacctgcagtgaagtagctgtggcccatgttttatagattagcaacatagttaaagagctgttagctaacctgcgtaaggaaacagagctaatttaaaaagttgcgaagtgaggtttgaatcaagatctgtttgactcccaggcccatatgtactgcaatgcaatgcaacaccaggaacagaatatgaaaccatctaactgaaaaaaaaaagtctccatgccaatgatgagagctacctcatgctccaagtaggaggtagaaagggtaaatgactcctaaaaagagattcttgctttgctcttggctctgataaatccctgtttattcatatgcaaatatccaaatgcatatttggaaaatgttttgtcttagataagaaaatgcacaatctcctagaaacctttaaatgagaccagacatttgaatgtttacaaaaattcctttgaagatttatattaggagaaagttttaaaacataatgcataaaaaaaaatcagatgattggctaggcatggtgactatcgtcaccatgggagtcgctttgggaggctgaggtgggtgcatggcttgagcccaggagtttgagaccagcctagacaacatggtggaaccccatctctacaaaacacagtgaaaaaaaaattagcaggcatggtggcacgtgcctatagtcccagctactctggaggctgaggctgaggctgaggattgattgagcccaggagaccgaggctgcagtgagccatgatcgtgctactgcactccagtctgagcgagagaacgagaccctgtctcaaaccctccacccccaaaaatcagatgattaatacaacattaacatttcaatctggatgtgtgtgtttgtgtgtgtgtgtctatgtgcatataaacctataaatatacacatacacagatgaatttttttgtctttgtcaaaatttctggtaattattataaagtatttgacaaaagctaaacagtaaatatgttacaccaggagaaaaggaaacaaagaacaagaaaagaggagtatgtgtatgtacatacttccctcagaaatctaatcctaaaacattttttaagctaaatgggacatagtgctttagtctaaattgtgtgtgtgtgtgtgtgtgtgtgtatgtaaagataaaggacttttactatgttattttggcaagtgattatttttctaaaatctttgctgaatcgttttatgtagatatactataatactcttgaataaataaatacttgttcaagttaaccttagagctcatcaggtaaataacagaatttaaaaaagaatctgtagtctgaaacactgtagagtatgccaactttacacattacattaagtattcgttcaaaataatttataaattgaaaagtatactccattttattcaaacaatgcaattttttaaatgaatcttacacaaatttgtgtgtgtgtgtgtgtgttagagagagtgtgtgtgtgatcctcaagaccactgagtcattctttaaaaatattttaaaatcataatttggtgaagaacttaacaacaaagtaactgaagccagatttgagagaagaagaatgaacagttcttcaggaagcaccaattcattccttaacattcaataagtctttattgcttcgcccttccctcctttttttcctctagtctaaactctgatttggagcagaagttaggaggaacacgtattctggtccctcttctctcatccctgtaaggaaaagcaatggtagactaatgacagaaaaagcaattgcaacaactttggcagttttgtggtactgggaaaaagcaggctttgtatttgtacatttcaaggaatttcttcaaattttagcttctttgaatgttcctacaacaagctgaaggggagataagatctgctagggaaatagatgaggtttagagagggaaaatggagggactactttttttttattcaaatagcattcaaacacatgagcaagatataacttgcaacattaaaaagtaaattagctagctaaaaataactcacaatacccttctcactaaaacaaaataaaataaagcaaaaactcacaaccaattattttgactggtaaaaacagacagtgatatgaaagtaacagatggaagcccagttttactcacacaacacactcactaaagacaattgcaagtgtccccatgacaataacttaacaatggtcactttagcctgagatatctcctttaggtgagtttccttaaagacttcagaggggcttgtagaaaatactgtagaacgaaaccaactcatttgtctatatgtagaaataggcaagagttgcaaatcacagcctgtggacgaaagggatccaggtgtcacatttgccaaatctttttgcaagactggaatagatattcttttcttatttattttttgttgtatggcagtatttttaggagtggtgacatttctgtacttttaaaaacacaacactacacagcacctaaaaactttcctaaatcaaataattaacagtaataaatcttcctgctaatttctcctcaaagttgaaagaaaggttattttcttacctcacactgagccttctgatatgacagtgtcattcagtcaataatttcaatgtcagttactgatttctaactcttttattacaaagacttcaagcaataatgaaatggtgctgatctgcttgctttcactctatataacgtctatatttatatgcttatgcttctatttggatctatatttatctgctttatctgcctacagtgcatctgtttctcatacacacagacatatatttatatatatacacacatactgtatatatatatataggttatatataaacacacatacccacaaaaatgtatgaatgtatgctagtgagcttacttcaacaaccatgcaggtgcataaatattcaggcacatgacaaatatacaaagaacataaatgaacatgtaaacatagttacacaggaaaaagaatatcttaacaacagccctgtctgccatacttggctgttggcctttgagacttatacactgttgaatgatatgtcatagactactctgagaagcagaaaaatcttctgaaggcaaaagtatatgactaaatcaagataatgaattctaactctctcattttcgcaatgaggagtctgagatactaaggtgaacagcaaagattttacagctttctggaggcagagctggaagttttacccaagtctctgcctgctagacaaatgctctttctactactatgctgaattgaaaggatgaaaacaattttttcaaacccaatatcattattttctaattgccactctttcccatttttcccttttcttgctgtgtgaaatgtaaacaaacaacattcactcagggtcaggcactgttctaaatattctatatgtactataccatttaatctgtaaaatatctctatatagtaggtattattattcaaaatcttagtttagtgaattaaataactcactcaaagctacacagctagtaaggaaaagggctgagctcccataatactcaagacccatgtttttctcacttaactatgatgccttccctaatacatatttgtatataatactaacccttccctcaccaccacagcctgatagtcttagaaatctaatatttgatctgtttcagaacacataacaagtttaaaggttctctcagcctgaggaaaaaaaataaagggaagtagagcaggtataagttacatccctagtatgcagcacatgccctatactagagaactgaaatatgcaaaattcccccccaaaattactccaatgatagtgtgatgtgatttaaagccttaataacttccagtctatgaacattttatgtcttttgcaaaggattatggcaaactgataatatagaatcagattggaaataagaccacaagaaggcaaagggaaaatagcaaaaggaagaaagacccacacccacttcttcttcctctcttggcacaacacttccaaaaacaaacacccattaaaaacaacaaacccagtatcaaaatttggtatttttttccccactcaagtgttagagacaaattcagaaaagaaactaagtctacgtatggtaggtagttttatacaaatctcttcagatagtaaccagttgtgagccatccgaacacggaggaattttacactttggccagctaacccagaacccagcactgggagatgtcatgtggatttgtgaaactccctggggcatactgcatccataagccaaagaacagaaattatactgatccatacatgcagctcttcatctgtgccatattgataattactcttcatttgtgaattaaatcctagttataaaaacaactttcagacatttgtcacaaatggcacattttacttaactctttcataacaccatctagccacggtctataggaaatgggagctaccatactcccatataggtcatgatattataggaagaatatgatgtagagaaagagagagagagagagagacagacttgagtttgaatcccaggttttccatttattaacaataaagctgtaggcacatcacttaaatgattctgaaacctcattttcatcacctgtggaataaagaataaaaccacctattttgcaggaacgttgtgaagattagagacatcccagcacaaagaccccctcataaaagggggcattaaatattaattattgtatatttaagaagtctatttgtgtgtgactttctcttgtattaatgatacataaatctgctgggagtaacagaagatgtgaggtactttttatgcttttttaatcaaagacaaactttttggtgatcacatgtgttccatgtaaaagtggaaataaaagcatatcacagtgtaacattttcagtggacgattttaaagcacttaataacccttgactttttgtgattgctggcactctcatttaacagttgggcaaaatggggttcagagatacatcctccaaatcagtaataataataaagaaatcaccagcaggggttagtagaaagtctgtttttaacatctaaatcccacagtgtccagctaaggaataactgctgcaaggtcacagatacaaaaggccacactttccccaaagctctttgagattattcactgaggccaaaacattaggtaatgctgtgtacatctgctgagataacaagggtgagtcagggttaggtcacggtttcaggttagaggggtggggtgaagagtggctttcagatcaaatgacgagagtagtttaatttaagcaaagaacaaaccatacagtattttaagtaagaggggaaaaaaagggggtgcaactacagccaagagaaggtgggtgggaatatagaccctgtgggggtcaaatgggtaactgtggctcaaagaggaaacccacccacattcacacacactgaaaagcgaacaaaaagcccagggtgcagcataaatcctgctatcccaataacacacacagatgttccaccattgttttcttttatgcacattttaattaagagatcagaatcaagcattaaaatgttattaaatggcttgtttacatttttgctatatgtcatttataatgcattttctaaatgtgtgtatatctattcggaaggactatttggaatttttacatcagtgctacaattgtcccactaactcacagtcatttttgctaaccaaatatgtgtcagaaatccttttcagtttaagcaactggacaggagctctcactctttaattctcagtcaagcaattccctacccccaatcacacctcctttaagcatgacaaagtccaccacagtacttcaagacaataggaaggcccaggtacactggcaacctttctgatttttcacaagagtcccagtttcaaatattctcccattgtgctcacaagaaaatagtcttcatatacatgcccgaccctttccctagaacagttttgaaaatgtcgggaactcaaagctaccacatgaaggaccctgacctatgagtgtcccctggaggggacacagtggaagaagcgggaactagtagatttttttttcctccccacaatccatcttctatttgcagtctacaacttatccctatttgcctgggcaggaatttgagttctctatattattctggagttaaaacaggtatgcctttcccgtctctcagattccacagatatcatgactgatgcacacaatccacctgcatatgtggatcacaagtatcctgtagtctgctggcaccatataacttaattacttttaaccacagggcattgtcctagaagcccactatttatattgtaccttatcaatcatggtacttggaattgcaaagtctcagaaagcaggaatcatatctcctccacgttcagttcaatgcctaatgcattgtgagtgttcagttaggacaagcaagagaggtaaggttttttctttctttttgttatttgtttgttatccaggataagcagaatgcttgtacagaacatgcataagaaagaaacgcaatctaatctcactgtcaatttatattctgtaaactgtctcatttgcagcataaatgactacaaaaatgttttggttactctaagtgttaaccttaaggtaagagttaaattaagtctgctataactggtggaccagaaaggactcagagaaaagcaacagcatggctttgaatcaaatcacttttggaagaaaactttaagatgttaccaccgaaaaaataaaactggcaaaatgctctggagggcatcttagcaatatgcatcaaaaatttaaaaaatatatgaagactgttgacccagaaatctcacctctaggaatgtatctaaaggaattactcaaagatctacacaaagatttagaagcaagaatgtttaccatggcattatttataattgtgaaagactggtaaccttgtctgacaatagagagttgattaaataaatgacagtacattcctagacttaaatactatgcagtttaagaaatcatattttagataccacttaattacatgaagaaatgtttttggaatactgttaagtgaaaaggcatataaccaacaatatatgtacaggaaaatatattgtttaagtaaatattgctaagttaaatattgttaacttaaatattgtttaagaagtgatagttgtgtacacacaaagtgcaaaaagaccagaaaacactagaagtgcttgtttctgggtagagaaattataaataatttttgtttatttgaacttttccataataaaagcacatttatttcatagtaaaatattacttaaaatattcatctataccaaccttccttctctaaaggcctaaaagtgaccctctgtaggcactcttttgtctctagaagtcttccttctcctgtttttatagatgtatgtgttgcattctaaaatcttaagtatttgggactatgtagttataaaagataccctaccaattaaacaaataaaaaatcttattaaatctgtggttttaatcttaggttcctgcttagaaaaaataccaatttctctttaagtcctatattttgctttcaattcagcctccatagtattaattagttatattatttaggcctgcagcagaacagtttcatagttcttctcattctcacagttctttgtaagagacaccacccctctcatggttcttactcacccctacacccacaattgaccataggtaattgtgcaagagaccacaaatagaaagaaaatgaaggaagccttaaaaggccaaggtagttccaagttataaaacagagaaaggctgaaaatttaggcagagatgtggagaaaatccgagccatgacacttaagaatgaactggagtaaagatccatgagcacctggtgcagggagagacaactctacctatcaatccagtacatgctactcacacaggactattaattctagtaaataaccacagctttaggaggggcaaatgttctggaataggctgcctgttgaaaatacaagtgctagggcctttccataacctataatcaggacttccagaagtaatatccaggcatcttcattgaaagctccaaatgtgattctgaattatactagaggtgagaaccaatgggctactggggaagttcaaatcccttagctctagccaacttttataaattcatctcccttaacttcacaaacatatacactctgctgatgctagaccggtgtccttgttctccatccttgctccgtcataaagagaaagctagtttatgtctttgtacaatctacttatgactttatatcttgaatgccctgactgctccttactacctgtttaaatcttcactaattccaacaatgggttagagtttcaccttcctatgaattcacattgatttttcctacacattaaactacagaatctgtgtcttcccctatttctactcttacatcaatatgaaacaataatttgtttgtcttacaactcaatatgatcataaaccatatgtgcccttagaaagtgttcacatggttttgttggtacctctttgcaatgtatatcagggaattttaaaaaatagcagactgaattgagaccagtacttgcatgttcatcatcatataatatgggacatgtatatttacctccaaacattctcagagttcattcttcgtaccctgtaggcttatgctgtaaagaaaatacatatgcagaaataaaaacagagtttgaatctccagtcctaatccttcctctgaactcctgtctcatgtatccaactgcctactacatctctttatttggaaaagaatttcaaattcaacattctccaatactaactcataatcatctctttcccaaatctgctcatttctccatatcccctatagctcccaactccatgggatattgccatttatccagtggctggggtgaaatgcctgaaattcatcacacctgatgtctctctcatgtaaaaccacattgagaccctcagcaacttttgtcagccctaccttcaagttatgcagagttgaaccacttttcatcccctccccactgccattgccctttgcataactgggctactatgataactactacatgctcttcctgtatcaccctgaccctgtagactgttctccacagtgtagccctggaactcttttaatatgtaaatgagatcatacatgcttaaaaaaatcctctatagctttctgtcagtctttatcatggcctgtgtgagctggtccctacttatctacatgatcattcttactttggtccacttgagccacacatttcttcttgctcttcctggaaaatttcaagttgttcctactccaaagtctttacaatatccatcccctttccctaaaatgttcttcctgctggtcaccacatgcttaggttcttctaataatttaaatatttgctcaaatatcttccactcggtgagacctttcctacttaccctatttcaaatagcactttctaaattatatatccctattttctacctccttattatgcattattttcttcctagatctgatcattatttaaaatgatttttttttgtttacataattattggctgtctctccttccactataaaataagtttcataggaaactttgtttaatttctcactatattcccagtaattagaacaatgtctgaaacattataggtacttgatagctattaaatgactgaatgaataagtagatgaataaagtgttccagtacttataaatctcatcccagtcacataaactttaaataggaaatctttattctgcatggtgcagcggcttctctggattgtcccagaggcctctattctttccatctgactgcacaggccagtctgggaaaccacctacatgcaatagctcacatgtcttataataaacttcttgggaggagtaagtcaaattagatagttaactaaaaatagtatctctgagtttataaaggagacgttttcccagcccaactggtcctggtaagttagactggcatcaaatgctgacatggcaatcttatgcttgatgaaccctcaatctggagaggagtgagctatacttttatactatttattttgtgaaagttccaagtatagttcatctttgtatccacaatgtcaagaacattgctgagcagagagtagagcttcaataaatgtttattaaacagatgaacaaactaatccatgaagcaaacaacattctaagtgctattcttctatgtctaagctttgacgatgcgctatataaaattcattcttgcaattttccttcatagattagactgaaaaactcatcgtgaaggaccatgtcttatccatcttgtatcccaagttcttagtacagtgctggatgtaaaaggaagaaaaactccaaagcaaaggatagagaagttagaagtcctggcagcgatcagtgagtattaaagaatgccagtatgacgtgattatcagatgttaggtgatgaaaatcatgccagctaacatatggatttctaccctgtttctgtataagacttgagctctaaatttagttcctgaacacaggggatcagagttgaaggtgattatttactatgaaactgctattttccacagtatacatgatcaaagtgctagaaacttaatgcatgaaaatctacacttctttactcaacctctcttacagttatataaaattctttagaaaattaatgttataaaaaagagttcaggccgggcgcggtggctcacacctgtaatcccagcactttgggaggctgaggcgggctgatcacctgaggtcgggagtttgagaccagtctgaccaacacagagaaacctcatctctactaaaaattaaaaaaaattagccgggtgtggtggcgcatgcctgtaatcccagctactcgggaagctgaggcaggagaatcccttgaacccgggaggcggaggttgtggtgagccgagatcgtgccattgcactccagcctgagcaacaagagtgaaactccatctcgaaaaaaaaaaaaaaaaagagttcagtttgttcactaaagggctcaatttgttcactacataaaaggatatagcagtttgttcacgaaatcaaagccttttcaaatataataagcaatagaagaggtgacaaaatatataatgtaactattaaatcagtatgccttacaagtatccatcatggttatagtactaattgccttggtttgtccaagactgaggagggatgtgagcttttccgtgttcaaacagagaaagctccaggctagtcaggacaagttggtcaccctaataatggtataacctgctaagctggttatcagctattccgatgtatctatatgtaggatctataggtacatgtagaatatatgatagataactaggcattactaggttataagatgattaagaattaatcagtctgtactagtataccatatgaagtgcaaatcccttgtttcattttctcttcatttcccctcgatgttggacttcttatgtttttatatcgtatgcttatattgattttattatagtcaaatacattaatttggggtgttaggacaatttcattttcttcagaagaaaaggaaaagtgagtagcagcaatgcagatgggtctcaattgacgcatgagctcatctgttttttacaactccaagtgtggtaattccccgtagaattaaaatttcctaacacagaaattaaaattttcctagctgaaaatgccggctttttacatatcccaaaactgaacacataaagattaaactccaaaagtaaggcaagatctacagaactatcccagccctaattctgccgagatatttattataagacaaactgagacagtcccctgtggtctccttaaggtcctgatggccccctcaaagcatcatctggctttaagagaactccaaaatagtaattggtctttgggcacagaatagccattggaatctggattagagtctgaaaaacactgcattttccaaagagattacaatgccaggctttgaacattgaagggtaatatcttctttctaagtatctctggtcagtctcagtaactagacctacttttgaggctccatttcttttatgtcttttaaatttaatgataaaaaagaaatatctaaatttataatatacacgaaacagtgaaattaggagaaaaaattctatttgatgtgtccatttttttaagctcccatgactaaaaagatcaacagttacctacatttgtaatatttatgcctcccaggctcagtgtaatgagtttcatctctgatcgaatttttataactgactttcacttacctgtgaaataggtaataggaagccttggtaggtgctttccctaaagaatcagatgcaaaagttagacctactgcaaacaatacagaggaaaaaaatgtcactctaatatactactactatatccgtctgctttttgcaggaaaggaaagctatcatcctagacagaaatactgaaataagtgaagtacagacaagtgattaatcaaaatctgaaaatcatagtcttcagctttttcttccatgaaaccatggtgtgtcctcttaactttggccaagtgcccagctaagagaattcttccatgagatgaacatgcttcagggcaaaaccttattctaactgatggttttaaaagcccaactctacattctgctcaaggctttggttacgtaggtaagccaaaacacaggagacatgacttcctccattaaactggctgaagcccaggttacactaattgagcctaaatagaaaacctctgcttttcaatccctttgttctcttggatgtcacagcttcctgctctattcgcttccttttatagtcttctctcaccaagcatttcaggaaaaaaaaaaaaaagctaaataaagatcacagcctgttccattgtgtccccttcttcttcatcatcttcttttccatgtgtgcaatgttgtggcacctattaactaccaatgttttcagaatgacattatacaaggtgcaggctgtaccactgtgccctaaaaatatcaacaactgcattagtctcacaataattaatggcaggcattatgcaaatgacaactttttcgctgcaaaataatgacatttcttcattttgagcagagttatgcaaaacaatgaatttaggatgataaatcacacaggagaattaagaaagccataacgttcctgcccaggcaggcagaaagatagacagaccaacaatttagaagacattgttttgttctcacaccactataaaaaatcatagccagtcggccattaatgtgtgtaggtttttttccttctcccctttaggcaacaatgcataaggggatgctaaattctagcaattggatcattacaagtcacaagcaaatttttctttattaaccttaataagtcattcactcagagactatagtcatcaagcaaataaaaagtatcacatgccattctgctacacattaactaattccttatgcaaacatcacaacatatagcaattactgccgctcaaaaaaacaaagtcattttcaatttattttattgcttttatacttggccatttcctgtagcacattatcgtttctttccctaacaacccgaggtggaatgaagaagaatttcggtagcaatgagccccttcctctagccacctttgtcatacctttttcccctccgggaggcttttaaggaaggttagggataaggtatgtgcacgctccttcacaggaaatgtgcatcaagctcagagaaatggtacattcagctcctattcttgcagcaaagagagtgtggggtaggcagtaagacccaagtctgtctcccacatttgctacaataacactgacagctttcctttattcagtaaaacaaggtaaaagtgtaggcttagacctgtccccaacaggtgaacgttaaagtcaatatatgcaacgttgacctgagagatatagtaatggttaatgagaattatgaggttacttcgtcttgcttcactcagcacataacttgtcccttccagaatgctgaatgaagagcaataataaatactggacactaccccacaacatgcacagtattaaataagatctttgtgtgtgtgtgtttttaattctataacatcctttatccaagactcccaggatgtgaaacaaatgctaaacaaagcttacacattgctaacagattcttttagcccattttacagactgacaaatggattctgagcaactagaggctttacacaaagttggactggaacaggtcagactatctttccaatgttctaacctctgaggcccgtggcctcttataatcatgagcattctttcctgctgataaacaattatgctgtaaacagcctgtacatgtcccttttcacacaacaggatgataatctctctccgttctcctaaatccacaatccattcccccctttttaaggtagaacatttccgaaatacacacgggaaaagctctgttttcagtttctcctcctgaaggtaataacattttgcagttctccttaaataaaatccagcccatgctggatcaataagaatgatgcccatttccctaatggcagccgattgccatttgctattcaaatcagactagataaattacagtacatgccagggaacaggccagtgaattaagacaggcctccagaggaccagcgatattattaatcttttaagacactatcatatttcttcttgacagtgtgcgtagactcacagacacactgcacccagattgaaatatcagctgctgaaaaaaatcaatagtgttagaaacacaataatttttggtctgcagggtctacactaagcaacacttgtacccctcctgtgccatctcttctcccacttcccctttgccatatttgcctcctacctttttgctcttcccttttcattctctggttttaaaagcttgtaagtccaaatgacaagatattatgagaaggtttccactgctaacactggccattgtggttacagcgttgatttttcatgggttgtttgaaatgcaattttactagtctggcaaaatgttttggcgtgggattgtttttcctatgaacttaatatagattttcaacccttatgcacttggttctgtattatgaagaaatgaaaatatttataggggtggccatacctgaaagttctgaggaaagtggaatgcacagaagggaaaataatggaaacctggcccagaaatgaaaaaaagtggggggtattcattgaagatccaggagaataaacaaaacaaaacaaaacaaaacaaaaggctacaggggaggtgtatgtagagcagaacatggtaggaagaatattctacttagattctgaaaacttgaagttgacctctgcctctgctgcctgcacactgtgtggttttgccagttacttacccttgcagagccttggtttccttttccattaaaacaaaacaatctaaccacctacctcatagcattcttgtgagggctaactaacaagatgtgtgtgttttctaaataataaaattgtgaatgatataaactaatttctactagagagaggtttatgaaatgtgtctgcttttttcctttttcatagatacagaataccataaaggaactttagacgttatcaataaataagcaaactgatagccacagaaaggttattgaggttcacattaccagtagctagtagaactttaagtagaccaagatctgttgaatctgagccagtcccttttacattttaccagatggattttaccttttccatgtctctttctactagagatttgaggctttgattcttgtccatgttgcttttccactggggaggcagataaacaaaatgccacataagaaaacaaaaacagaaacaaaacctaccatgtttgtgtatatttatatgctattcttttgatcccaagactccctccagttcaccccccattttgattcttcctttcataacaaaatgtattagaaaaattgtccgtattagttattaccgtatcttcactttctattcttttcttaatctattccaatcaggcttttatccgttccactctaccatatctactgttgccaaatgcaatggtcacattttaattttcatctgactcaacttcttgcaacaatttaacacggataaccgcttcttttcctcctcgaaactgtaatatcttttgggatacccctcttttcaactttctctactatcttacagggcacttaagcctatttaagcctcatcaaatttgaaatctgttactagcaattcattcttatttctgaattgggataaacacagtatatttggaaaaacagtggactgtcagatgttttgatggtctgattttatgactttgatatacaaaaaagagtagaaaatcttattcttggtttggcttgaagcttttttattccacatacctcatggcaaaatttatgaactacttttgaaaattcataagtgatcatttacctagatccacttaattgctccacccagtttcttcaaacacttgttctttgaggtctacatggcaagaagtaaatacgaaaaccatttccaagtgaactaaagtaacctgaatatgttttctgtgttaggttgttccccctacccacagcaaaagcatgaagacttcctttaagaatacaagatatattctaagtctaccagtactccatcttctgatgtcagatggagttaaagttcactttcatctcaagagaaaaaacagtcattcctgacttacaaacatgagtggagggaagtacctgaacacagggattgctttcctcacatctggctctaagatacaaccacgcgctgtgacatataaaaaggtcactgacacgagaaaatatcgcaagatattacaaggataatcaaagccaaaatatatccaaacccacttttggagagaatcccaataacttcttttgaatgtgataataaaaataacatgaataaagatcattttcttaagaaaaaaaaggaacgtttctatcacttgcctgccacttgccacttaggagtagactctggctcccttttccgcttaaattcttccacagagtcagcttgccagactcttaaccaaggtttttcttttatctagactataacaaatactccattttgggtcatgagaacatagtagcaaaattcccagagttaatactttaattatacacatatgtatttattattttgtatgtgtgtgagctgttccactaagttaaactttaaccatattaatccaggaaaaaaatccctgattatcaactaacaattttgtaaacagttatctcacaggttaaatattaactcgaaaaatttaactcaaaactccacacaagcagaaggagccaaaaggccaggaagaagaagtaaagattagctgctttaggaggaacacagccaggaaagtgagcattttggtagctggataatgtgtaggaagtccagggggttgtgcaggggggggaaatagaagcaagaagggagcctggaggacacctgctgcttatcataatatcaaaacataaaacaatgaggtgagaccttaaggaaaagaaaattcatggagatatgaatccattgataatggccacaggaattcaggtgcaataaaggtttgaacctcaatgatatggacatagctaaaagatccaacacaaagctagctggagcggactgcctgcctgccactgaatatcatgaggaacattctggggtccctcttccactagaaataatgggatgaaggctgctctgcctgtcctgtttctgtttcctaacaataaaacaaaactgaagtgtctccctccagtattgggttattaggggcaccgattgcaagttctaagcctttatctaactgtccatcaattctctccctgattaacagaaccatatcacgtaagaaaaagttggaaccagcagtagactaagtcagaaggcttttctgtaccggaattgctgaactacaaatattgttctctggttaggattttgactaaaaaatgtcaagaaaatccacatggccagagaattcgcacaatcttgatatctgaggtacagggtaaagctgatgtattttaatgctgttttaggaaggttagaaactgttaagattcttcctgtcagtatgtcaaatatcagatcagtcctgcttgctgatttttaaggaagtcattaaaaaaatcctcccagtgagtagctttcaaggaagactcccatttgcccggcagatctaaagaaataatgaggccaaataatgcaagtttctcaagagaggtgtaggattgaatgaaaaaagggaagatatagaaatgtaggagaaataattcttacatatataatatatataatgtatatatgtatatattgtgtataatatgtatatattgtttatattcaagaaatatgatatagcttatcatatattacttttgatatttttcttatacatctagtacatgaatacatgcttattggaaaagtacaagtacaaggtgtagtctctattatctaaatatattatttaaatatatatctaaatatattatctaaatatagatgacacctcgtacttgtaaagctttttgcagtttataaaatatttttgcataaaatatcttttgctttcctgacaaccacaaaaagtaaaaagggtgggttctataatttctgttctatagacatgcaagtattactctaccattgacgtaactggtgcagaataaacctgaacagaggaaatagaatccattagtagcctggttatccatatccacatgccaagtaagaaagcagcatgatgactgtggaaatgtaaaggcattataagagtgatttttggagaggattaaggagggagacatcaaaataattcaaaaggaagtttagaaaatcagtagaaataaagggctaaatttggagtaacttttttggaaaaaaagtgtttagaacaaggaaagaaacttccaattcagaccatgtattcatttggcatatactaattgtatatctatgtttgattttctttgatagatgctattgggtaaataatgatgtgtatggagacactgacctgtgcctgacatatttaatatctatttgttgggataatgcccagaaggaattattatgcaataaaattcagatattcagaataggggtttagagagaaaatcatcactgatatgtaggctgacaaaggaaagcttcagtatgatgaacaaatctagttatactttgaaaaacatgtaagatttgggaggtgataagacatttcaagttgtgtgaagggcatgagagaaagcatggaagcagaaaattgagatatgtatttgggagcagcaaataaacaagttagttggaattgtaataggaaacaatgctggaaagatgggttgagtgtggaatgcgaaacggggtccttgaataatgggctgagtagtccactttattctgtgaacacaagaggtctattaaaggcttgtaaagtaggacactggcatggtcacagtgatattctagtataaataattgggaatggtggacagaaaaaactgaaacagggagagcataaaggtaatgagagagaaagagagagagtgcgagcttgtgagagcaagagaatgagaagtgatccactgcaacaacccaggtactatgtgataaatatctgacttcggtagtgtcagcagaaatgtacaggaaataacatgttctagagacattgtggaggaaaaaataacaatatttactaaagttctactctgtgccaggcaccgaactatgtgctttatgtagattaacccattaatctccatgctaaccctaagaggtaagtaactttattgtttccattttacagataaggattaagcaactttttcaaggttatgcagttagtaagtggtgaagcctggattcaaacccaggcaatctgactccagagcctgttctcctaacccccacacttactgtttttcctaggtacaagggatcttttggtggattatatatgacaagatttgatataatttgatgactgactacatatgagcaataaattcgtgggattcttgggattctcaattctgagatttttgggttatattatgaataaaaagaaggaaataaagaagatcttcttgacttcacattgtacatttgttcctaatggtccaattgctttttggacttaaagtatcaatttacaataaaagccacagaagcaactgaaccaccaaaccggaaagctctttgaaaatgattcttctttctagtttcactaatgtatatctggagtatagcacagttcttcgcatataggggatgcccaacaataacatgatgaatgagtcaactggagaagtattaattgtaataagtgagaataagggagtggagggtgtaaaagtcaaaagagtatgacccagagtcagacaaatattggttcatatcctggctcagggccctttctaactacatgacatacagaaagttactttaaacattttgtgtaatatggggtaataattcataggaaagctagctaccttactggattcagtggttttatataaaggcaatgggtgtatgcaaacctagtaaggaatgctcccaaaggctgttacctctgacagaagaaaatctgcaacccctttctctttgtttaacttacaaaaccacatgaagacctaagaaaaaaaatctgccaaataaattccagttacaaaaggaaaataaattattttgaaagtaaaaactataatttcaactgaagaagagattttaattgcagggagatagatcagttgaatggtttaacttggacttgagaaatcagtagcagccagtgggatacatattaaagaaaaaaacaagtttaattacccttaagattttatacagcttggctcttccctcccacacctagtctgcttccatcaggtcagactccttttcaatcacactctcttccatccttttctcagttgctgtcatgacaagccaatgagagaatgacataccgatgaaaacaaggtttgagtaattactgcactgtggctggttgttgtctgggcatcattttatttcttccaatcaaacaggtccttggacttcacagctctgtttcaggtgggggtgatgctgattatattatgacattatagcaaagacaggcagatcagatgaagtgaatttcactcagtaattaaactgcagtttctttcgtctaaagtccagggcaggattaatcgaaacgtagctctttatcattcctattaatgctgggatttgaagagtgagctctgatttgatagctagccctgaatctggctgactggtgtccccaaatctgtctaacttgcaaaaataatatcagatcaagatacatttgcaaggttatacccttcccttttattttacttttttttttgataaggaaatgcaaatagattcaaatatgctgccatttccactaccttgttttctattacaaaaatgtctgtgaaaaaaatcaggtccttccaaaccccacagcattttacaaatggttttccataattccacttaacaccatgctctaatggcttctaattttgtgacttttcattatctgagactcaatatgaatatttggatggcccaagcgacagcttttcagaggctcaaaggttctacttttattttaaaggactcattctgggacttatatagagattttgtttcattcaatcactcttgtaatgcatatgatatcaccaaattctttaacaagtatgagttggatcactgattctcaatcctgggtgtccatagaaggacctgtgaagctctgtaaaaaatcagcctccagcctccactccaggccacactcacagatcggaatctctaggttttagacacaagattttatatattcttgaactccataagtgatttgaatgtgcagctagagttgaggaccagagtcagccacacagtgtattagctgtatttgcaaaatatttattaaaacaagccattgttcagagaaattagcctcacattattgtgagagatctctcaataaaataataaaaagcttattccagtagcctttgcatagaaaaagatatacttgggtttctttccttcttttcttttttttttcttagacggagtctcactcttttgcccaggcaggactgcagtggcgctatcttggctcactacaagctccgcctcccgggttcacgccattctccttcctcagcctcccgagtagctgggactacaggcgcccaccaccgagcccggctaatttttttttttgtatttttagtagagacggggtttcaccgtgttagccaggatggtctcgatctcctgacctcatgatccgcccacctcggcctcccaaagtgctgggattacaggtgtgagccaccgctcggcctcccaaagatatacttgggtttcttaagggaagtagaggaaaaggaagactgtaaaaacagacaggtaactgttgatggggcttccattgttctctctgataacattgaaggtgatggtttactgattgagctcatcacatggtaacactatagctaccaaccatataatttaagatgacagttgactaacatcatagaatctcagagtttggacataaacttggaattagctgtcatctattttaaccccttctctattcagctgcctttttagaaagagaggcagaatttagaagactttatttcaaattctgttttcagttctgtttcagagtttaagaatacacgttctagggtcaaactgaattcaactactagttgggtggcctagatatttacttctctaagccttaattatcccttctttaaaatgcggcccagaatatgtatctcaaagagctatttaggttttatattaattaatttagataattaactagaatgcctggcacacaaaagtatcagaactcaataaattaagtctattgaaggaaattgcaatagtcacttttaaggttgtcactgagactctatgcttaacaactatcagtttggtgactcacagatcagttttctggaagatttgatttgccaaagaaaaagagagtgagtccaaataggaatggctttcacatttaattgagccataaaataaaatacattttattaaataaattttataaaatacaattttattttaatgatcacctggaaatgatcattaaaaatgcaaatttctgggctccaatcccagagattctgattcagtttgtaggagtggagtctaggaaccatccaggtgattctgactcagggtcaagggtcttcactttaataaagacagttataaaggaatataaattagccaagcatttatcccccaaataactacagtgtggcttgacctggaagagaccatgctttctattccttaagtcagaattcagttagatgagtttaaaccatgtgcaaatacaaaatgtttatagagtatatttatgcacacagagttaaaaaatctatttctcttcaattaaatatgccttctcaacaattatcatttagccactaacattatcttcatctcttttcatcactactgggtacatgtaagtatacagacaagggtcagatttgctatcgactcatccattttcttcttacaaaataataaacaggtttcataaaattggtaaattccttgaataaacaaaagcagctatttcctcctctaaatgcattgtagaataaagtattttcaaaacgcattaatcgaaattgataatgaaagtcaatatataattgtgagttgaatattttaaatgcaattgattacttcgctaaaatgaatatactcaacttacacatggagactgttctggatctaaggagaaatttaaacattttcattcccaatcagcgaaatcccagaaatgtgtttagagtttctaatacaatataccaacaaatgtgcattaactctctatattctaaaagttattgtgtaacaaataacaggagaattatggtctctaattgcagttgaacataaaattgagctggggagaaaataaggcatcaacatgagaaaagtttttcagcattatacaacaatataggctagtggccaagtgtaaggctgaaggagaatctttttagtacatactgtgtgaggcagggtaagctaccgaagatctgcaaaagtcaggcacagtaactcactgagggggttgtggtgaccacagtgggtactgaataaatgtaacctattatttattataatagttgacagtttattttagtaacacaagatatatcacagataagactatgtaaccggtaaaaggtgaatggtacaggcactgagagttacagggagccaaaactgagagaatgctggcatgactggtaagggttttgtgaggaagagacatttgaatggataatgcaggagagagaggatttggctagacagaggaacaaagatcattttagacagggtggggtgttttgatatgaatcgcaggtcaaagttaaaaagtgtttaacgactgttaaaaaaaacagtttaggatgaagccataaagataaatttgaagtagaacaacagagggttctggattccaaaaatcacttgtagtttctggtagaatttttaattgtcaaaatattttctcagtggaattcaatatctctttagatcagtggttctcaaattttagtatgcatcagaattacctgaagtgcttgttcaaatacaaattgctgtgttccacctcaaagtttcttattcagtaggggaaagtgaggcctaagaatctgcatttctaacatattcctaggtaatgctaatgctgctggtcacttggagaaccactgctttagaagacagtgagataggccgggcgcggtggctcatgcctgtaatcccagcactttgggaggccaaggtgggcggatcacgaggtcaggaaatcatgatcatcctggctaacatggtgaaaccccgtctctactaaaaatacaaaaatttagccaggcatggtggcaggcacctgtagtccccgctgctcaggaggctgaggcaggataattgcttgaacctgggaggcagaggttatagtgagccgagattgtgccactgcactccagcctgggcaagagagagagactccatcacaaaaaaaaaaaaaaaaaaaaaaaaaaaagtcagtgagataagagaagagttggatgaagagtttcatggataagaaagagttggacgactatttcctaaagtcaccatataatggaatagccctctttatttcctataaaatttcaccctccctttcataccaacacatagagaaacctacatgaagattacctagggatcaaaattcttctttggctttctaatccctctattgggttcaggtccttaactgtgggaatgaagaggcccatgatcaaaaggagcccaggcccaccaacctggaaacttgaagacaacttaatcactattaaggatattcaagaattcaaaataacagacccaagagactaaagaaagaaggtggaatttttattccaaaaagcctctgtcagtttcatgttgaacattttgtacttgggctgcacttaactgcctgccccttaatccacaaactaatatcatctcaccttggttcacctttttcttttcttcaaaaggcagtcagaagcaagcaggggcaatgagaactttctacctaggcatgggccactgtttaagcatctccaccttctgcttcaaaatctttctccaaaacaaacttccactatgtggtaactatactgtaagaaatcatttaaaaggcagaaagaggaaatgaaatgctctgagagactattttctcatgcataacttcgagggcagtatctcacaagtcagtactttatttttgatggcagacaaaaaacatgttgtgtttgaagattcatgtagaaatctttgtgaaaaaaggtcaaaattggatttaaaatgttcaaaactccaaaaatctctaaagaacaggagcttgtttattttctagcaatttatctttccttaaaataagaagctatataattacaaagtataattaataataataacaataattaccacaaatacaacagaaataatgatagtaagcaccatgggcccagatccccatagttacaaaggataagaatttgtctcagtatatttgagaacagacagcagcccaataatacaggaaaaaaaaattggaaaggaaataatctttcttgtgctccctggaaaataccacagaaaaatagacaatcaaatttaatacctgttgttaaatatcttcattgtacagattaggtcaggcaatttaaatagacaacaacatgaggcctctaatgtctcttaggaaacagtttcaatgtaaattcctaggaggtcccaattcaatttctagttaagcatccccatccactcgtaacactcataagaaggagaaatgcatttgtatggtgttttacagtttataaattattctcacaaacgtgttatttgattgtctcaaaaatcctgtggggtaggtaagtagagaaagtattaatagtatacccattagaaggtgaaagaattaaggatcagagaaaaaggacataaattaatctttattaaatatccacattgggtcaaactgtgcagacctggaaagaagtccaaataaagttttacataacatggataggcttggagaatttgttaactgcccaaagtaaaaaaatggaagagctagaacttgaatgcagataatgcagctcaagatgtaatggtctttccatcagaccatagactaaactctcagttgtaaccatcgtctagttacagtaactgcccctctcaagaggaggctatttcattgccaagaaataaaaccgtgaatagtggtcaggttttctgtttttagttagactgaaagaaagcacatactccttgagaagacgtgcatctttttaacatgacttagtctgtcaagagaataagagagagaatgtgttatttcattcatgtagaatactgacttttaaaagtcactcaatttctctaatgatcagtgatgttgagctttttctcttaggtttgttggctgcatgtatgtcttcttttgagaagtgtcttttcatgtcctcaggggagggcagtgtgggggcagagagaatcaagaaaaatagataatgcatgcggagcttaatacctaggtgacaggttgataggtgcagcaaaccaccatggcacatgtttacctctgtaacaaacctgcacatcctgcacatgtgcccaagaacttaaaattaaaaaaataaaaaataaaaaaactgactccagctacccatggacacaagagacaacacggtcccatttgtcaccaaaatagacaacacagtcccatttttcactaacatactctttgcaagaaagataaactaaaagactatccaacattaatagctagattctggcatagtctcagcttaaactattagtttctaaataagaggcaatacatatgcatagtaaaatagagaataacagcaatggatgtattaacaaaatgcattttccattaattgttatgaattaaaaagtctcgaagctatagatcgagactttgaaacttctggaacaaattaacctatctctttttatttttactttatgcatgcatttacttgtgtagttggtgttgctatgttttcttaaatttgtttttaagataattatattctccctctacttttatacatatatcttctgaggcatttaaaggtttgacaaagcagtgtcttctcacaagagacagaggtttcacttagaagccatcttgggaatttgggctgcagaaatcaagggaggtctagtacgtaagtaaatattagtgcaataatattaaatttttgaatactaaaggaaaacatttattgaaagaaaattgctttatatccttaacaactaccttgctatcgaggatttttagagaattgcagaatttcagagttgatgctatatgtaggattttcttttcttttaattttttttttagagacagggtttcactctgtcacccaagctggagtgcggtggcatgaccatagctcactacagcctcaaactcctgggctcaaacaatcctcccatcttagcctcatgagtagctgggatcacacatccggctaattttttttttttttttttttttgtatagacagggttttgcttgggggcccaagcttgtctcaaactcctgtcttcaagtgatcctccctccttggcctcccaaggtgctgggattacaggtgtgagctactgtgtctggccccaaagattttatttttataatgacagaatatcagtgttagcagagtccattaaaattatatatgacaatcatctgtttaacccatttatgccaaatgttgcaattttgtgtgtgtgtgtgtgtgtatgtgtgaaaaatcagaacttggtgatgaccttgagcaacaggatatacataactgccacaagcttagcattccaatagtggaacactaggcataaatgggttatggcttcagtatcctgcaaaatatccctgtaaggtagctgtctatgcttaaacaccttggtcttaggaaactaggatttgtggatattaggcaatgttatgggctgattgtgtcccctaaaatacatagggtgaagccctaagctcctaccaactgtatttggagataaggcctttgaagaagtaattaaggtttaatgaggtcataaggttggcactctaatccactaggactggcgtccttataaggacaggaagagacatcagaggttctcttgagctcacaaagaaaaggctgtgtaaggacacagcagcagaaggctatctgcagccaaagacagaggcctcaggaaaaaccaaacctgatgacacctcagtattggacttctagcctccagagttgtgagaaaccaatttctgtttgctagtccacccaccttgtggtattttgttatggtaggcctacagactgatatggtgcctgtatcagtgcctatatggtgcctatctcatcacaacctgtaaggaaggaattacttaaagccaatttataggtatagaaacagactatggaacattcaagaaatgtcccaagagacaaggattcaataagtggcataactgagatttaatctaggtctatcttccatattattttttaccctcctattttttacctttgaacacagaaggctgctacaaagttagtgtttcatattgacttgagtattttattcttgtaggtttcatcactggctgatggtctatttgttggagtaacagaaagcaacataatttatcttttagatgactgtcattcatatacttgaagatagttattacattccttcctcctgaatttcctgttaatcccggttcccttaaccattgctcatatcacatgtttcagttccctaccattctggccacttatacctgaagatgttcctatctatttaaatttcttgtactgggttggaaagtcatatctctgctacgtcattcatgactagtctttttaaaatataaaggcaatatcttgcatttatccatttagaaaatttcatctgttagatgtagcccataattccagtctttcaatgtctttggaattcgattacttcattcaacaacttttctatgtatctggactcatgtcatctgcaaatctaatgaatatgttttcattccagttattgaaaaaaacttgtgaccaagataaggccgaaaatatccttgcaatatgccacaggaatcccctatattatgatattgagccatttgtttgtacctaatagtgtggtcaatcaaccagttactaatccagctgtacctacattagttactaatccagctgtacctagattagtaactaacccggctgtacctagattagtaactaacccggctgtacctagattagtaactaacccggctgtacctagattagtaactaatccggctgtgcctagattagtaactaatccggctgtgcctagattagtaactaatccggctgtgcctagtttagtaactaatccggctgtgcctagattagtaactaatccggctgtgcctagattagttactaatccggctgtgcctagattagttactaatctggctgtgcctagattagttactaatctgtctatatatctaacccaggagatatcagatcacatattgtagacatcattttactgaagccattctattgtctagcaagcaccacttctttcagtggatcatgatacattgttttatactttattgctttaataatccattctagactgttgctcaggactaacagcaagtagttgcatcatcataaattgcctttctatactttctgtaaatcagaagatttccacatctctagttatctaacattgtttctcttctcctcaaacatggatggtagtaattgactatctcattgacaaatcctctcatgagtatatggttctctatccctatttttaggctcttctccttttcctttttttcctgttatcttccaaggaaagagtcactcatgtttaatcatgaacggtatgttggtcagagatagacctgcaaactggaacaactgagaagatttatacaaagtgttgtcctagagtccctgactgtgcccgtagaggaaaatgtactatgattaggtgaggctttgctctcatctccacacagggctctgcatggcttttctatttcacttctggcagtactcctggggaaggctacatccttttcctattcattctgggtgacttcctttgccaaagattcaagacagctttgtatttttcagtctttaactgagaaaggttgtgatatataatgcctttattttcccatgaagactttctctgaggcatgcacatagccacgacctttacctaatcaagaaaagttgcttgggcagtgggggatggggatgcaggttggactttaaatgcacaaatcagttctaataaaaacactgagattcaggtgcctgaggttagaaatactggagggaattcaattacactaattaatatttaagaagggctagagatcacacactgaatgtgggaaactaggccagtcagacatgagcatatggggagggcaagatcaacagataaaagtaacaaacaaatcatacataaatgctccaacaggaatgaaatagagaatataaaataaatgttccaacagacactgaagaggaggtaaatggtctaccagacataaaagcaaaatgttccaacatacacaagacattttattggtttaatgtaaacacatatattataaaaatgatttttccacataagttagtaggaaatgttacccatttatagaaacagacttacgggttctatgaattcacagcatactatatttgctctcatttcctcactggctcatcatgcaggagtctcaataaggcttgactttcataacaggtagttctccaatgcctaagcctacctggatacccaacgcctgacagaaggctgaaaagctgcagagtgtgcctgcttctgcacaagtttttctagttccggttgctctaatgtgatttggttggtgtcacagctaataccacattctctatttgatctgatttttcatctgtggcccagacagttgattctgatttttggtcattcttttatagacttgaaagttttctagagaaggcactagtggtgccaggactatcttgcttccttctgtcctgtctacactagcatttaattacacttttctacctcttttctacctctatgccctctcaccctccttcatcttgggagcttccaaaactagaagccaagagaattaactaggttgctttataaaaattgtatatatgtagggtaaacatgacattttgatatacattggattgcttttgctatcaacggcatcatgtagaggtagtagtagaagcatggaagggtagaagaaaggactgagactgatatttggactcctctttcaagttttctgatgtacacatagagtaactagatggcctggactgtctatgtacaatacggaattttaggctcctggaggaaacaaaccaaaacaaaaataaaaacaaagtccttttccttcagtagctttagctttagaagaataaatgattcacatataccaaaacccacaagatacggtatccccaaaaagttaaattgtctcttacctaatagaggatcagaaaaagaaaagatagttatttcctaaaaattgtttgaaccaaatttgtggttttcaaactatgcttcatggtccccagacttacaaagagatgattacaaaaagattatcaaatagatataaataaataaaaaaataaatacatatataatatgtagtaaatacatatatatcaatttgcaattgtgataaaaatgacatgcaaatttaaatgtattatataaatttaaaaaacactggagaccaatgtgttattacaagttaattatgtacaataagaataagcagctttcatgcaggcctctaattaaggctctcagattggaatacaagctgttgaaaaaaactgttacaatatgcaactacttatcagtctcatgatttttttgataccatatagtatagtacagaaagtcttcacttattgccatccataggttcttggaaactgtgattttaagtgaaacaacatataatgaaagcaattttaccatagactaattgatataaataagagttaagttcttatggcaaattttgggtcacagaaacatcatcaagtttctaaataaagatcaaaacacttttgatattaaacattgaaataaatgtgagctgtacatgcatttaagaaagattaataaaagcaagaaataaatgtgagctgtacatacatttaagaaagattaataaaagtaagataattatttaatcaataattccagttcagggtcatgagtggatggagcctatctcagcagctcagggactggtaaggtgggaaccaagcctagacaggatgccattctatcttagggggcactcacacacagccacattcactcagacacacccatgagcctaacacgcacatctttgggatgtgggagaaaacccactacccagagaaaacttatgcagatatggggagaaagtgccaactctacacacacagtggctcactgggaatagttcttttttttttttcccatcagcgttatgacaccatgttatttgagtatctgctatattccccatacaaaaatacattgatttttgagccaatacaataatccaatgctgagtttttattcctttgtatatttgccattatattcttattgaatgactttataatattcaatatgataaataatctgaatttgaaaatgagtttatctcaataaaatattactcattattccatatgttaagtttctaataagatttagtttgaaaagaggattctgcttgtttaaaagaaatatgaaaaatgtctggatcaaataatatatatgtatcctgcaactcaaggcagtatgaatctcatatggctccaggctgctcagtttctgaatttatcaacttgctggcttagaccactgtatacagcagatgcattgggcccaaactagattttatatatgggccactattccttcaggcttaagaacagtatttttatactgaggaatagcttatttatcatgaaaccatcatacatcaaaagaagtcacgttgccttaaacttatccagtacatgaaatttatcaccctcaaagttctagattatcagaatttaatatattagtttaaaatataaccagttgataaccaagaaataagtcaatggaaacctctttaattatctaagcagctcatcttgtttataataattgtataacttacagatacatactcatttatttttcaatcaaaatatattatattgaaagacttcagaagatttttttcttaatattaaccaacattacttatagttaggaacagagtgagccaaaaaggattctcaccactacagagaataaaactagcaaacctggggaaagatccattttccaaaacctgaactacactctatgatggtaacgtttcaagtatttataacacttaagtataagtcaagagttgattgaatgaggcctttcatgatgtttatgtagagtagtcaaaccagaattatttatgtatttgtttatttttaaaggctgtcatttgaaagttatcacagtataaaggtaaaggatacaccggagtttccattctagctccacattcctggctgtgtgaccttggataatttagttaaactaaacttcagttttcacttctgtaaaatgaaggaaatagtagaggttctattgtcatgaatttctagcaagaaatcaatgaataaatgaaatgatgaatgaatgttgcttagcatgttgcctggcacataaaaagctctcagtaaatattaactgtaattaaaaaatatctaaaagccggttgctttcttttggttatttttttaatatgacttgattttattcataacttactgactatattttcttcccttctggaatgatgttctattgaggtttctttttcttttattccagaatgttctctgagcaatctcttcatttctgcctcattcatcagataggattgtaggcgttcattttggtagttctgcatttggttttctgtcactgcttatgctgttttcttgttctaactcagtggtttaaaaagtaaaattcaagtaaggactaaacataagagaatttactgggactaatggttatcaaaattgggcataaagggatgttattaaaaataaatcacacagagggagaacagctgatgacagcagctgtgaaatggatgtacatggtgggaatcagtgagccccaaagaaacaaacaaaaaacactggagggccatgaaacttacatgatttacaagggaaacccaagctttatgaacagcctctgaagactacagaggccaagcaagtcacttctggatgaaaatttggataagacagcaatactgaaaggagttatgttccctgatcaaatgggagctacagataagaaaagaatgagaaataaaatgaaaatctttaccgagtttgatttctttattgtataacctgcactgaggggacaccatctctgggtataccactatagatacacttaccaaatgcttagtgattattgcaatagttagaagagaatatattttaagagccaaagttacaaatctatggacaagatgaattaatattagaacccatgttgagatatatagggcccaagtagtctatgacacaaaagtttgtgtttttatttaaatagaactctaaagacttagttgtttgaaatatatttaatgtagagaaacatttttttgaaaatttggtttactgtaaagatgaatggagatgtctaactttttgccttttttttctagatatggacccacctctctattttcaagagcattaaattcagttaaaaactaaaaacaaaaatactgccaagggattgagacggtaaagtaacatcatgcctgatagaataaactatcaagacagcatgaacaaacccaactgaaatggaacaagcaagcttaacacaagtcaaagaagctctctagagtgttaaaatgaaaatacaactaaacagaaccaaaactgctattcatgggaatagcaaatgaagaattttcttcagaatctacacggataacttctatgagattattcaaaatgtggaaatttttttcagaatttttgtttccaaatggaatttaatacatttcatgaaacaaatgaaattttatcagaaataaaacatttaaattaccaaaagcctagcctccttaggaaggctgttttaggaagacatgggtagaaatattttcatcaaagccctgatcatcttccctttttgaggtgaaatcactctactctgctggaaacctacatttagttatttataaaccagtattaaatgtatattgtttcaaatctctatgtaggaaaaatatcccacattcattcccattttactatgaactgtataaacttccaaaatcatcatgaaaagaaaaacatcaccctttctgctaattaagtgttcttgctttttttctagtaatgggtatttgaaaaataacaatatgcaagagtatgatcttacagtgaatatagccactaggtcaatatgataatttaatgtgagactttaaaattgagctttccttttatgctactattctctaaataacttctttatttgctatgattaaaatatcttttcatcaaatttgatataaatatactagatatggtaaatatatttatcatttaaaataacaattgaattgtacaataagcactatatcattgcccaatttttattttgataaaatctttttaagtgatatcatttcatgttaggctttttgtgctgcttaatattataattaataattcatatttttgtctttctcctctctgacaacttttatttttaatcggtgggcatgtgccaaattggtttgttatttatttataatgtaaaatgacaagggaattgaatatgtgaaataagatagattttctttcatatgacaaaaatttcttagtaatggggatgcttcttgcttacccttatagattcaagggttttagagaggttaggtcaaatgtcacacttctcatataacaacatgtggtaagtgcattaaatagactgttcattttttaaaaattcattttagttttgtgaagacatctgggcacatgcataaaaaacaggacaaaacaatatcaaaatttgtaaaagactccctattccgataaatcctatagtgtcaattaagtaaaaattctgaccaaacagatgtatttgtattctttcctaaaaactaaaacaggcaaacgtaataggaataaacagagaacgtttcaaagatacagaatttccattgaaaaaatcaaatgttctgtctgtaggactttatagaacattaaataatcttttcagtactgtccataaccagaaaccacataagctggatgctagactattgactagttatgacaaaaaattcacagtttgatctcaagggcatcagcgatcctgggctcaggtgatcctcccgccttggcctcccaaagtgttgggattacaggtgtgagccatcatgcctggccatcgtgccaacgtattgaagtggaaagaactaatgctgagcagagaatgggccatacctgggtggttttaagaggtgctgctataatgaaaaatcacaggctcacccaagaactaccgtggaatcagaacctctagggatatggccctagaatctgaattttaagccagttcctgaggtgcaattcagtttgagaactacagtcttaaggcaaaacctttctatcataccagagcttccaattgtcaggccctttgaatccaccctttgtgtcaaaccttagataattcaagagacataacaaacgtgatcatgttacatgcttcctcacagatttcagtgtctcccatttcttctattagtttaaaaaacatagtccaccatcacagggccctgtttaagccagctcctcctctgtggctctgcctttgtggtcaacctgtgcaaaactttgaggctgtgacatcacttagtcagtctccaacatttggaacaagagaactttttctaacaatttgatcccaattcctattttaagcttgagcattatgaaggctgtatctgtatataatattgaacacttcaaaacaattttagatcttaattattttgttattaaaatgttgggggtgtttaagttgacattgagtcagatgtaggaactgatatacagtgaagttaaatcctttagggtaaactcattcagtggtagaggctgaactacagagcctaggcattctgacattccaccactgtgcttatcagcttgctccttgagcaaaccttttcctgcctttatgagaatatgcccattttatgggctctgtatctatgagatattttacctatgcttatgtacacatggtgtttatctttcaaagctggactatggaaaagcctaattttacaaacatgttagtaaaagattatgtaatctgaggtgattacgtttaaaatggcaatgataatgatgttaattccagtcctgtgaggtactgtttctgatctggaaagagcagttttcttttttaacagcttattttgtattttcataatccattttaaggtttggtattaatatagacatgagaaataaaatataactgttgccatgccaaatgtatatcaaaaagttgctaatagccatgactgctatttggttaactgtatttcactatttaaataaaatgatggaaaatggtgtgtctaggatctcattcataataatgaaagacaatagaaactattagcataggtatgatgctaatgaatggtaaattttcaatagagatccatcgaccagattgtttgaaaaatgtttcctgtgggtacgaaaaatgcacacaaacaaacacatgcatcaaaatgtccataattaagtttttagggaaaaataacaatatatgttggttaaggactttcacttaaatggcattatagatctttcagaaatgagagttgatttatacttcagtattttggttcccaaaggttgggacagtgggtggtagaggagaagtagagtaaatggaaggtatacatgtatgtgtgtgcatatgggcaactttaagcaccttgaatttaatgaacaaaaaatgtcattattctgtgtttatatatttttgtgtgaaacaagtacctttctctatcactggagtttacatggattttctcatgatatcttttgagaatctctttaaacactaaaatacatttttccaaatgaaaactcccataattctgctttattaatatctgaatgaatatttccattgatttgtccagaagaaggaactgagtactgtttagagagcaatctttttcatgataattggcagcaatgtttccctgctatcagaaagaaaactatagaaatacgaaactttagataaacatggagataaaaataatattatggagtccaactggtatctttgaggtgaggacaggctgagatggactccttggcttccttctgtccaaaaatttcctgtttccctatttcctacggttaccaccatggaacatgttaaaatctcagtagggactctgtttcaacttttcctgtcaaaacacagtgaaaaagcttaatggaaaaaaatgtccttcctatctccatgccaggcacagtgtaagatccacaaacttaaaagccaggaaaatattcttttatgtgccccaaagctgggcaagtgacctagtactacaaaaattcccaaataggcatgtgacctgactaatgtgtgctgtgagatgagtcaagaaaaatggaaccatctgtacttttattggacagtcaaataatttctttctgtccacccaaaaacataatttctatgttaagagtgatacaaggagacttttagaaagtctaatttttaaaatcagagatattaaaatatatgaaaagtataacctattaaacactggtggagataagcaaataggcttatgaaatcattattgctttaaaaatttgttacctactcattgtgtactaaggcttctctacgacatacagaagaggccggtgcggtggctcacgcctgtaatcccagcatttcgagaggctgaggcaggtggatcatgaggtcaggagttcaagaccagcctggccaagatggggaaaccccgtctctactgaaaatacaaaaaaaaaaaaaattagctgggcatggtggtgggcacctgtaatcccagctactctggaggctgaggcagagaactgcttgaaccttggaggcggaggttgcagcaagccaagattgccccactgcactccagcctgggtgacagagcaagactgtaaaaaaaaaaaaaaagaaaagaaaaaaagacatacagaaggaaatcagggaaaatgggaaaatgaagggaattaacaaattgcaataatctttaagaagtagagtatgaacaattttccttttctaggatgaaagctaccaacaactgaactcttagagtgagtgatggcagaaaaaaatagcaatcaagaataggggcatgttagtttttagacatgtttacaaaactctgccttttatttcttaaacccataggtcaaccacccatcatacctacattaccccatatgacaagtggatttgttgtatgtttcaagtttttaatcttggtgggaagggggagggcagagaagtatttattggtaaaatatcataataaaggttgagcctgtcaatgattgtacctaacaataataaatatgtgtaggaagtaagaacggcaaaaatgaagccgggtaggatactgtggatatggtgacagacaagtatctatacgaaatcctgagatatttgtcctccatttcataaattaaagtgccccctcttttgctttacagataaggaaactgaggtgcattataatagcaacagcagctgatgtgtagtagatccataccacaagccaggtacgatgtcaaacatttaaatgtatcatttaatttaattttcatagatctcctacaagacaagtgctattattttcattttacatacgagaaaactaaagctgacagagattaaataacttgtccaaggttgcatagtaactaagtgaaagagccaagatatgaactcagatctgtctgatttcaaaacccaggcccttaaacactaggccagtggttttttaaccctgattgcacattagaagcacctggcaagcttttaaaacctactgatactcagaccctaccccagaacaattaaatcagaatttcttgtacctgggccctgatgtgggtgtttgtttcaaagcctttctgggtgactgtaacatatagcttgggtaaagaagaattgttgggtgtctcccatggaggtcagtatatctgtgccaatatgtgaggtagtacaagactcaagtgtcctcagtctgtctgcagtggtttttcccttgccccatcatgttcactttgacatcttttttttattatgatttttggagaagtaatatacaagtgacaatttttttacaaagcattgtcacagcagaacatggtcataagtccatcaaagagaaacctgttcatatctatgtacaggctatgatgaatgaatacaaagaagactatgtttattactctcatccccaaagggaagtataaagctggccttaaaagctgttcataccaaagctaatcactaaaatttggaatggcttcctcctctcctttcacaaatgcaatagggtagccactggatctaaggggaaaagatccaattaccactctttacaatgctttttcacttaggatctcaagacgactgacagtcattcaaaacataaaagtaaagtgaaaatatctctagtagaagtgaaaagaaaatgtctgtagtaggaagaaggcctaaatttgtgtctatactctgccactttactgcaatgacttgaggccaaaagtaaagtgacagagtatagacacaaatttactgccatgacttgagccttgatttccttttctatatgtacttaagccatatcatccttagggcagtgatccaaaaaatgtggtccccatcagcatcatgtggaaacatatcagaagtgaaattatcagtccctaccctagactctgaatcagaaacttggtgaaggggcagtaatctgtgtcttaccaaacattgcaaataattctgaccacctccagctgactctgatgtatccacctccatggggttgttgtctaagaataaaaggagatggtccataaaattgttattttttttactatctactgaaatcagaaatttcaaaattctctcacagagatattttagagaaataatgttacagcctacattagttagataataacctcatttctgaatttcactttgaatgtgtagacgaggcacaagtcaaccagaggttatgcaattagcttggagtcaaagagaaagcaaggagtagagctgagaaggaaaccccagtgtgaacttgatttttattcaatcaaactgttaaggtaccaaccacgcactttcatctataatcacaatgaaccttttaataaacatgtttctatcctcttagcttaaaaaatataacagtagctttttggattttaaaacagattgacttctatacttctgggctaaaggcagctcaagagtcaataagaatcacaagctttccacagtgagaagaaagtgcaattgcccagtcctctctatctatgaagtgcagacagtattcctcttcctcacctcacactttcgattattgcaatggtggaaaccatgataaataaaagcgcttatctagtggtttggttttcactaaaattacagacttctgtaacattatttggataccataaaacacaaaccaaattttaggagatgctttagggtgttttttcccctgccctcctgtcggaagccctctatctttttactgtaatttatctgatatagctaccaagatgcttgatacttttacatgcaagggtgctgaaaaacaaagagcgagggaatgggttgttaatgaaattctctgattgtaaaaagcactctggaatgatcaggtggtaaataataataagaggaaataacataaagtgcttaggtgctacagcgatagtcaccatataaatgcagaagagatcagacatgaatagaatttgcattttatgcagctgctgtgtgtgtatatagaatatacagtagctaatttttcaataatgctggtaaaatattgttcaaaatctattcttgctgtcttctcactttaaaaggcattatatagaaaaacacccatctgtcctagtgcaatggtgaatgtgtgcaaagagcctagaaaaagagcctctttgcatacgtgaaaaaaaagaactcaaataaaaggagataatgaagaagagacaatagtaacactattagaacagctatgcagacaagcacaaaggtgatctttgaaaaacatcagggataaataactctgttaatgtgtggcagagaaactacagttaagacatacagtaatataccaaaaatatagacatgcttttattttgtctactgggctattgtgatagtgatggttgtttttgaatagaaaggaagaagagagtgggaagtaggatttcgttgtttgttgttactgttgctgctcagtttagaacaacaacatcaactacacaccagacccgtccaacagttccacaaacaatgcttaccatgaatctgccctcaattttcttgttgttattttcccttaatacttattgataacccaatgcccattcattagatatgctaaatcctcgtccatggttactctcctttggaagagactgagaagatgctaagagggagttcctcttacacataagggaagagtctgtttaggaatctgagaaagcagaggccaggataaagagaccactagtcaatcaatactaagcaccgaagactgaatcacccaaagatacaattatctcccttcctttgttctgtctcttagtcaaataaaggattgtttgtagaaccttttctgttcctgatctctaaaaagcaggactggacttgcacatccaactataattcaaaatatctcacacttccaacttgaaagaagacataaactgtttcaaagaaactcagagagagcaaatgcatattcacaaaacttacacttattcctagaataggaaaatggagagagaactaaccacataagaaagggctaatcataataataatagtaataatgatgatatcaatcaatactttggattctagagaatgatttatcacaaaaattcacctgtattaagggagactccaggacaaggaggtcattaagctacatttccatcttcaggattcagccaaactcagactctccggaaagctgtaaatgctctcagaacagactttagtaatgagattggaatgaacactgggcctatggcgtaaaagcatctccctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttgtttttgtttttttttaattatttgaagagtcacttgtctggatgcttcgttctagtagaatttggctgatttttttcccaacaccttttagtggaatgcagtaacagatgcatggagggagaattggtcttaacagtatttttaggtttcatctgtgtcagagagagatctcttccctttattgatttcttgcatacactatccacactacagcttgaaacagctacaacagtgtttgaaaaattggttgttcctcactgttcaaaccatttttcaaaacagtcgttacaagcttcattttactttctgttataaggagggttttgtttgggttggtttcattttccttgtggcgtcatgctagcagagaaacacagtcaggaatatagcttttaaatgtggtatgattgggattataaccatatcagaatctatattgaaaatttattagattgagccatgtgcagttaaaaagaaagaagtcagaagtcttcgatatttttcacaaacatgaacaccatctcatgcaaacgttaaaattcaccaaacaaatgataccccactgttggaaagatattttctcatgtcaacaactcaggaaggagtggggagggaatgggacatatacatgtaaaatttttctctatatttttgataataactctctgtgaatatgttttactacctaggtaatgcttatatttgtaaaaacatatagttatatcagaaagtcaattttgaataaacctgagaatggcaaactataatttttaaaatactaaccttttagaactgttcattttcacttttatttccaggactcactatcttaaagagaagaataaaagttgaagatccttgggattaacagaaagggtggaaatagccaaatgtattcatatttttggccaggcgcagtggcttatgcctgtagtcccagcactttgagaggctgaggcaggcagatcacctaaggtcaggagctcgagaccagcctggccaacatggtgaaaccctctctctactaaaaatataaaaaattagccaggcatggtggtacacacctgtaatcccagttcgggaggctgaggcaggagaattgcttgaacccaggagatggaggttgcagtgagcaaagactgagccactacactccagcctgggtgacagagcaagattctgtctcaataaaataaaataaaatgacgttcatatttttaaaatacagcaatattcatttgtttaaaaaacaagattgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaaaaaaaaaaaaaccaagattgagagcacagttatatagtgacttttgatacatacacaataaaacttattgaattttcaaaaagtgagaaaaaaactactctgctttaaatttaaagtaataaataataatgaagacatatcaacattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcacgagatccttttagaggttctgacacaaataaagtaaaagtaaacctgttgtggcaaagttactaactagtctacactaactctcagtccttgctcaaagcaaaataatggagtttggggtgcaatctggtgaactcaatggtccaactgcataaaggcaaagaggaaagccaggcttgggcacttctgtagaaaatgaagattactggtttgaaggccagtcttctcactgcttcactgtatgtggtgactattgttaaattagatatccctattctgatgaaaaggcaatgtgctatttttggggtatacatgtttcaagctgtaaactgcaaagtgctgtataaaagtaaagtggtgttaatgcctcataagataaacatatagattgatgatggaggcatttaaaatgctttaattgcccactttaataaagcactaaataattataataaaaacaattcttcagaaaacttggtgggaaaaaggcctacaggatatgtttgttaagaataattagattttagttttggaggaaaaggtaggacaagtcacaggaggcactcgatgagaagtcaggaatgcctagtacataagccacacatattaagttgtagtttcttcaaaactgacaataacatgtcctccaaaaccaaagggaaaatcaaaggatgttgcctatacttatgtaccttttgctactggagatctagtcaatctatagccttggattcatagttctataacatgacaacatagcaaaatctcaccaacactttgttttaaagaaattggcagctgggtgcggtggctcaagcctgtaatccatgaactttgggaggccaaggtgggcggatcacaaggtcaggaatttgagaccagcctggccaacatagtgaaaccccgtcgctactaaaaatacaaaaaagtagctgggtgtggcggtggatacctgtaatcctggctacttgggaggcagaggcaagagaatcacttgaacccaggaggcggagcttgcagtgagccgagatcgcaccattgcactccaacccaggcaacagtccgtgactccatcaaagaaagaaagaaagaaaaggaaggaaggaaggaaggaaggaaggaaggaaggaaggaaggaaggaaggaataaattggctatgcctccaagtgaattatactataaacttctttcccattaccaataatgtaaatatataaccaggcacaagcatgtggaaatggagaaaggatgaacgttagtcttagaaactttggtttgtatcccatttccaccttttaacaagtcatttagcctctctaggtcaagattttcttacctattaaatgaagataatggtacccatctcacaaaattgttttaagaattaaatgtaaaatgcttggcacagagaggtcactcaatacatggcagccaaatcaccacatgcagtaaaacccagataaaatatattcagccaggactgttgctctgtgagtaggtctggtatccatgctacaaaatctattaagcctaaataatttggtcattttagcaatactctttagagattttttaatgacatttcccaaaggtcaagctagcttatggttatgtggaactgctgcatttataagagagtttagtgggttcataaaataagtcttgctccccaaatccggatcataaagaccttctatcataaaggataagagtgacatttaaaaaaccagtttttaaaaaatgatggtagcaaataaatgcagatgatcaggatgacagcaagtaccaagtcaaagcaacacggagaagaaataggccctagcctgcaggttacactttaaacactgaggagaaatgggagagtaaagagcaacactgagcctcatcggactgtaggtgaaaaaagattcaaaatctgactctaaagcaataggtaaagaaatattttaaaatgcttatctgtaggaagaaaagcagtaaagcagaattcctaggaattgagaaacacttaggaagaaaatgcttaagtagtacgatccaaggtgaggctagctgcagaaaatacaaatatttatgggttaaatcaggactgaggaaaatataaagccaaatatgggcagctctgagggggaaaaaataggcagcttggtactcaactgtcatcacaattcatttgtgtttcacgtcccactgtttgtgacattaacagaattttgaatttagcaatggactatttttgtattgtgaatctctgcagccattttccatatgtagctaccactgtaactagcaataacagccttttgagctttaaaatgcttccaattaataagattcaaaataggggtcacctaagagttttccaagttaattccctttgtctactctttgaagcagagtggtattcctgctattcatttgcattgaggccaaattatttgaccatttcagtaagatatccttaggtagcttttgcttttattgtcattttccaaaggattaagttagttttagatttttgaactgcattttcatttaactaaaataactaaagcaatctttttatgagggtatttaaatagatcaaatttataccaagttcctactgtgtgtcaaacattagcaaagcaatttaaaatgttattatttatatatcaatacatacaaatcatatgtgttatatattaatgagcttatagccattatacacaggacttttatgtgttattattgttgtggttatttctgttgttcgcaggtatcagttatcaagtacctattatgttccaagaactctaccaaggactatacacactcaccatgtaatgaagatattattggtttattttccatttgaagatttagtcacaaaaagtaacttgtccatgagcatataatttgtgcattctcttaaaatcacttaaacttccacgtaacacctggattgacgtatgctttttcttacaaaatatacttcaattcaataaagattctttagtcacctactatgtggcacctgctaggatagttatctttgtttgctattatgctaaatcacagatctgaccattagaatctcttccttcctgaaaataccctctttaggtaaaactgtatttcttatcattttccatcactgattgaataaagaaaggtggcactatctggaaaacataagagcgttggatttacaagtttcttttaataaaacaaaccaagttaatcacaaattgttgcaacaaaatatgtgacatgaagggcatttaaggcacatttagacattatttctatctagaaacagaaatttagtccacataatgtcatttatctactgagctaaatcgtattacaattttcatctataaaatccagattcttaatgtgtgttggaaagataatatctctgacccgctctcagtaagaaatgtgttttgaattgttttgttagtaataataatggagttgtactggacaaaatatattttcagcaagtttctctggtaataaaaataactataatagtagtaataatactagtaatcaccaataaataatagatagcatttattgaactctactatgtgccaggtactgtgattagcactttacatgtattatcttattaatttctcaaaatattacatgaggtaagtaccgtaaatccaatttaacagaaaagcacattgagatatagaaatccaataatttggtaaagatcacacagatagaaaagaggtacaagtcaggattggaacccaaggaatctgactctcgtatctatctactctaggtgggggatatagcaggtgctatggtgtttgttcaagagaatactccatttgtgttgttttatctaccttattagggttggggcccatttggtctgtaagccaaatctgaagacagctgaaatgagttaaggtttgaattagtgctattcacactatctgccaattaaaatgctcccttctgagaagctgtagccagttggcataaccttaggacataatacatgctcaaaaaagtatctgatgaatgttaacaatggtttctctaagtggtgattttactttctttaaaaaatactttttcctattgtctgaaatattttcaacatgggcacattacttaggtgatcaaggggaaattcaggactttacttaaaaaatgtttttgttttgttttacaattaggttgttagtctcagttaaaacataactcctgctgggaagcctttcctgttgctgtactctctgaccttttgaaggacagtactccttactctgtctgcctcagaaccttatgaaggccacatactattgttaattatcagtcttctctgctttatgtgaagtcccttgaagattgaccccattacttatctacctcttagagctctaagcatcttgagtgcctaccactcagttcaatgaaaaaacccagaacacacatacaccagaacaagcacaaaagatgaaaaagaattattttagggttgacaatgcacactcttggtatttgcagatgacttgtttctccccttacattatgtgcaggtccccatggaaagaagtttcccacaagaagtgtcttgaatttactggtctcttctctggaggattttacaaatgcatcaaggaatacacacacacacacatacatacacattatgaaataatatgaggataattagaagtaatggggaacacaggaggcaatttctaaaaaatgaagcatattttttatatatataatgtatatatgtatacctgtatataatgtatatatgtatacctgtatatataatgtatatatgtatacctgtatatataatgtatatatgtatacctgtatatataatgtatatatgtatacattatatataatgtatatataatgtatatacacatacatgtatgtatatatatacacacacgtatatatatatatatatatacacacacacttttttttttgagacagagtttcgctttgttccccaggctggagtgcaatggagcgatctcagctcactgcaacctccgcctcccgagttcaagcgattctcctgcttcagccacccaagtagctttgattacaggcatgtgctaccacgcccagctaattttgcatttttaatagagacggggttttgccatgatggccaggctggtctcaaactcctgacctcaggtgatctgcccgccttggccttccaaagtgctgagattacaggcgtgagctaccacacccagccacatttatattttatattaagtaattttgttcctttcctaccccattataatataaacttcatgaaagtagaaactttattttattcactacagtatccctagtccataaaagaaggcatggcattacatcctcaataaatatatgtcgaaaagaaggaaaaaggtatagatgtttccactgtatttcttatatttttctggaaacaaaggggaaaggtgttcccaaaaggtttccaggaaaacttcaatcaccaatgaaactgcaagctcttgtcatgttcctcagaccactacctaattaattcctttatgtgcaatacatcctttctagcctgttgatactcaatttctggcgctgctgtaacttgtggagcaaagagtgccacgtgagaggtgcttgggccccttcatactgtgcctcacctgcgaactggggaggccactgccatttaggctccagcatcttttacaggccagctgagccaccagaagggaaggggagaaagagacatgcaagttctcagaatgtctggtatattcactcacacacatttctcttctcttctcaaaaaggatcctggcaacaaatcactgattaatgatgagagaaatggaatcaggaggaccccatgataccctctcatcctagttttgggagataaaatctcccactgtggggaggaggaagaccctacagggttttcttatgttttgcagcttccaaattgtagtagggtcctattctataaaattgctaccaacaactgtatacttagtgatataataccatatggaaccttgagttttacttaaagagtagattatgtggcaattcatagttatcctagtatggataagaaaatatcctagtaataacataattattctagttatgagtttttttcagacaagaaactcttttattcatctttttatctctagtgcccagactcaacatatgactttgtatatagtagttcttaataaatgatagcttaaaaattaaataatatttttaaaatggtgagatatggcttaaaggggttcaaacaaattcagagttttgtctaatctaggtgtttctagatttatgagcaggcaatcacatattattgagtatgtattagtgttttagttagtgttaatacagtataataaaccctcattgattgttgtagagaaatcctactattttacactcatatactagaaatgtttaaagtcacaattttaaaatagtggacttcaaactttattatgcacaactaacctgggcagtttcctaaactgcagatccaggctacattctcagagcttctgatttagaaattctggaatggggttcaggaatctccattttaacaggtgctctagataatcctgatataggtaatccctaggtaatcctgatacagttggtccttggactacttaccatggactaggctacaaggtaatataataataaatctatacagttcaccttttcaatacgaagagaagagactagcctattaaatgtgacttaactatcaaaattacccgtgaaaagaataggcaatttgctaagacttctcaaaatgaaccaagggaggacataagggcgagaaatattaaatttcaagccagaaatgactctttttaaaacttcaaagagactgacaatctgcttaaagtaaaagtggaagaagaatggcagcagtacagaagtgttttatgaacaatttaggaaagcaacattgattcaagaggtttatttgataacatgttttaatggttattataaaagtgaatgccttctaatctttgatttgctgctaaaatatatatgtatttatttacatgaaattttttttttaaattccccccttaactccctactttccacacatttttagcttgccaacattactgcgttaatggtgtcctttttttctctctctagaaacacatgccctgggattaaaaggggattactttggtctacttccacatccatgtcccagggaaggtactgcttctgcttccgacctgacctttaggtatctgcagccttcaattctttacagtgggagttgctttagcattgatttcttggaaaactaagagctgttttcaaaagccattttcaagacaaataatgaaaattattttcttatgcttatggatgttacaaactgtgtaacaagcttttctctttaactttgctgcaagaaagtttaaaggcaactgtatagcacttcactgaatatagttttatgctgacctcacttctaactccatttttatatcctttcctttattgttttatttttcttacctatttctaattcatgtattttgctgcaatcatgtatttatgtttattttttcattgtcagccattttaattcccttattggtgcaataaatagtaaataagacaaataaacaaaacaaaaacatatgtatgtatgtgtatttggtatttacatcgcatgtactcaaaataaaaaataaaaactaaccacctaaaataattgacatatttcattattctttgggctatagattcacttgactgcagcacttccatttagggagatataaaattaaaataccaccatgaaaaaatccatatgaaatttgacataggtattttcagccccaggtcattaattcagttctgactgacatctttcagttctgttttaaaatttttgtgttcagtctttcgattacacacacaaaaaagttttggcttaatcagcctaataaagtgtatatttctgaaaacatttttatgtaaacaaatatagaagtatacatgatacatacacatacattttttacttagagtcttcaaaccaaatatttcagtcctttgcttccagtattattttcttttaagtaaatacttttcattaagcaacaaagagtgatagtcatctcaacaccaaaaacttgtattcaggctaagtttagtctactttgcatattttcctctgagaatgatccagccagtctcagtctgattctagtaaaactcaggtaatgtggaagaactctaattgagtattagacattttaacaattatattcatattgatatgtccttatacgaccactctaggtgaaatattactatgcttgggacttaaatatgatttttgttcttttattaatttctgaatctcatatccttccagataccaaaggaatacagtaccacctgggaataatgtcaattttcactttaaaaaaatattttgttgcttttcccctcagcatgggcaaccaatagctgattcatactttcattacatcacagttggattacagaagggctctttagtctggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatgtcactcaactatactttgccattcacttaccatacgtcaaaaaggtggaataatactattcttacatagaggactaataagatatacttagcaaaagtaggtggttgcaaaacatttttttaaaaatcagagtgctgtatttttaaaatcttgcatagaactctggttcaatttttgagtccttccaatttctcataactctgtggtattcataataaagcaggcagatggttaagtctctgaacatatgctttaaatgccccctttgctatttctaaataatggaccaaattttgccctcaaatagtcacaggaaactttaaggaggctgcctcttgaaatctgaggacagaatgtgatccagtgggaattaaacctttaaaaaatatattttctaaactttcttatgagctctattccctataccaagacaaattacattttttaataaaataggatatagtaagagaaaaatcctaaccaatacaatattacttggctcaaggaatagattagaaggcaacatatgttttatttatttatattttaaaattctgattttctaaaacatgagagtcatctgattaatttctgtgtgattaccagattttccatttttattattattcctattactagtatcatgtagatgttatattgttaaaacatcttgcaattattaattagttaatttagtttaaattatgattatgcctttgttttaaatcaatgtttttcatagttattaaaagccaaaagcactatttttccagtcacttactttcatttcaaaaacagtttgttgtcgatgaaagcgcattttccaggttatcacagaatatgcaattcatctgcaatggatatatatattctggtaatgttgctcacataacctagctgtacttgtaagagtatctctgtttcttaatgtctatattttatacatggaattaaccttcatttgcacactcatatttctatgtatttaaatttattcctgaaagacctctgaactagtctctcctgtcttacgatgtccacaaaacttagcagtctgattaacattacagataaaaagaccacacaattgacaataaggacactttagttattatagacgtctgaagtttaagtattccaaaactataatgtccctttagaaattctcaataaggattagcttggtcctaatgaaaacagtgtttacttttaaaaataaatgcaatagttgtacccaaatatgttcgaaacactgtatgacgtgtcataatcaacaatgttgaaaataactaaagatctttaaatcaagtgataattttacacatatatccacaaatatctgaacaaaatttataattactattgggacaaaacattaacatattcttctgctaataaagacaaacaactttgagaaaatcctctctcattctcacgtctctaactttcacaataaatgcagcactgaaactaaatttccaactcagaaatacgctgagctccaataaacaagttgattttaaaaactcaccagactaacagttatgctttttcccttatctttcctttgctttcccttgttctttcactttccatgcacacacaatcacacttacctgcacaagtctgaaacatcagtctatgtattttttttgaaatgtactctgtaccgatgcatttttctgtgtttctttctaaccctcgagaatgttaagaatttaggaagagagccacagcttaagagtgcaattatttgccagtaaatactcaatttgcttgtcctgtgatttttcttctaacttgcatattcaataatccgtccctgactgcgtcacgagcacaaaaagtcttttctccaaaggagaagactttcgccaatcaaccttcagccatgccagggcacagcttgtcagggtgatttgttagctttaattaataattcctcacactggccattttcacaaataatgcagtgaggctgggaggctagattgctat

SEQ ID NO: 2215 - DNA, 421178 bp, Homo sapiens; identical to SEQ ID NO: 2214
  source 1..421178: mol_type = genomic DNA

SEQ ID NO: 2216-2299 - skipped (84 entries)

SEQ ID NO: 2300 - DNA, 3304 bp, Homo sapiens
  source 1..3304: mol_type = genomic DNA
tccctgatcctctcctctcctgccgcatgagattattttattaaaaaactcaaaggaagcagagtgtggagcggtatctgtcctgcgtgacgtctcacatcggagttggctcagaccctggctgtgcatccatcagaaagtgcaaggcccaggccatgagctggggaggaagcctggaaagaaaccaccgctgcaggtcaatggagcctgggactagtgaccaagagttggggcagacccaggcactcacctgacagcttggacccgagcacagagggacgtgcagggtggctcatactcatactggaaggcagaaccatcacgatgcctctttgggggttcctgaaaggggtatggtgtctggggaagagctaacaaggaccccaaccccatccaaggctacccatgctccctcccagctctacctcaggccttccttgttctaccctccagctgcagaggggctatgctcacccagacagagcagggctcctgggctcccctggtagctccggtcctgggaaaaggcggccgattcttgcagggcaaccctacaaactccttgaactccaggctaggtttctggggcctggtcacaagagcctggtgtggactggggacatggctacggggtgagagactgggagtgcagctctggagtggggagctgggggtacggctggcgtgtggggacctgggggtcagggtggcaggggctgagcagatggctggtgagggctgggagctgcttctctgccctgggtctggagcagccaaggacagggcaggcagaaggctgatgctggtaccactttcctcggatgacatgtggccgggtaaggccggggttcctgaggaggaggggacttattgtaggcacagccctctccgctcagggcagctgagtggcctgcgagctcagacaggactgcagggaccgtgttcatcccccacccaccgtgcacctttcacagcatcctgcgcagcccgggaacctgactgacaggcggcagtgagtgcctgtgacctgtgcatcacctcacctgaggaactgggtgaggaaggaggagaggctatgagggtcagagataggtcctgcagagccgggtctggtgggggcagctcagggcctggggggttcaggaagtcttatcagcactgtggacctgggccccaggtatccccccaacctctccagtcccccttaccctgtgtcctctgacaggggcctagagagctcagaattagctggtcattctcagagatgcacagcattgagctggggacagtgtacacagcttctccctgtgggacatgaactctgtaggacaggcccgtttactctcatgtcctgtgggatatgacccttgcccaactcctcaccctgacatctcccaagcaaatccccagactgaccgtggccttgcatcgtgaggcagcccagtgggtgacagggggtgctgtgcaagggccctccagtgtcaggcagctttcagccaggcacacgagtgccccctgatgctcctggtcctcccgcatttcatccagaagctgggacagtgataggcctggggacaggggaccatgggatgagtcaaggcttaaaggggaggaccaggagggtgagggggaagacagcttattgaggaagcataaggttaaggctggagagatcactgcacagcgtgttaggatcactggtcaagctctacagtacctgcattggacgaggtggactctgaaaggtgctccctacaggaagagagtggccaggactcaggaaccatgctgaggcctgtctacctagatacaccatcccctcaccaaacaacacgtggcccccgagcccaaccccagactcactcaaggcagtcatagagctttttctgaacatctaagtcttggttgctaagaaaaagagaagggtagttaatgggggcccaagccctcctaccccataggcgtctgccagcgccggccaggctggggtggggagagctgctggagggcggaggcatcacttaccaaccaggcacccgtagccggggctgctccgtgggcagcaggctgaagcggtccacctggagatagaactctgcgggctggaggagttcggggggaagggggggtctcagaatcgtcacgaagagtcatgcccggtaacccgcccaaggcagtctcaccactcaccgcgccgccctcagcgacctggacatgaaccccgcagtcctgcagcagcagcagccggccctctgtcccgcggaagccgaactccttctcctccctgcaacaagcaggatcctcactgccgggcccacctgaacacaaggcccgcccacctcgcgctctcctgccggactccgacctccagagccgcgcggggcctctcaccagtccgaggtgtccagggcctcccgcgtcaccaggcatcggacactgtgggtcccgtcagacacaagcagcgtggccccgacgtcggacgtatcaggggcgtgggatgggcccgcgaccgcggcctcggcgtcctgtagtacctgacggcggcgagcggcgtcaatcccaccaccccgggcctccgcctcggtctccgggccctgaatgggggctcacctcaagcagctgcccggctcgtggactggagggtgtctctgaccccagaatcagctcccgaatccagggccgtaggaccagcctccccgaacctgccatccccacggctacacccagcggatgcaacgggcccgggtttcccgcgggcgcccaggccccgcctttcctcggaagaggaagctccttcgctgggcggggccggaggaggaggccccgcccacgtacaccccgcgcctgcgcacgagggcgtcctgctcgggggcctgtgtgcagactcccgctggtccaccccgctggtgcacgggatgctggcccgtttactctcatcgcggcgtcactctgacagcggccaggcatttgggccgttcgtcaagattcctgtggtaccggtagggaacagaacaagggctggtcccgtccctggagagggttccagggccggaggctgaggccgagtgccgtccgagcgagttgactcgaaaccatttcagcaccgtgtgacccccgaacggttcagcacatatttattatgactcagtttcctcatctacacagtgcacggtcttgtaaggccagtggaaataagagcacacacacagcgctaaataaatggtacttccttcgccctcccctcggattggcggagccctgctccccagactccgggggcgcgcggacctcagcgtgatgacgc

SEQ ID NO: 2301 - DNA, 3304 bp, Homo sapiens; identical to SEQ ID NO: 2300
  source 1..3304: mol_type = genomic DNA

SEQ ID NO: 2302 - DNA, 3304 bp, Homo sapiens; identical to SEQ ID NO: 2300
  source 1..3304: mol_type = genomic DNA

SEQ ID NO: 2303 - DNA, 3454 bp, Homo sapiens
  source 1..3454: mol_type = genomic DNA
tcatttttaaggtgtgcacttttattcaactggtctcaagtcagtgtacaggtaagccctggctgcctccacccactcccagggagaccaaaagccttcatacatctcaagttgggggacaaaaaagggggaagggggggcacgaaggctcatcattcaaaataaaacaaaataaaaaagtattaaggcgaagattaaaaaaattttgcattacataatttacacgaaagcaatgctatcacctcccctgtgtggacttgggagaggactgggccattctccttagagagaagtggggtggcttttaggatggcaagggacttcctgtaacaacgcatctcatatttggaatgactattaaaaaaacaacaatgtgcaatcaaagtcctcggccacattgtgaactttgggggatgctcgctccaaccgactgctgtcaccttcaccgttccagtttttaaatcctgagtcaagccaaaaaaaaaaaaaaaaccaaaacaaaacaaaaaaaacaaataaagccatgccaatctcatcttgttttctgcgcaagttaggttttgtcaagaaagggtgtaacgcaactaagtcatagtccgcctagaagcatttgcggtggacgatggaggggccggactcgtcatactcctgcttgctgatccacatctgctggaaggtggacagcgaggccaggatggagccgccgatccacacggagtacttgcgctcaggaggagcaatgatctgaggagggaaggggacaggcagtgaggaccctggatgtgacagctccccacacaccacaggaccccacagccgacctgcccaggtcagctcaggcaggaaagacacccaccttgatcttcattgtgctgggtgccagggcagtgatctccttctgcatcctgtcggcaatgccagggtacatggtggtgccgccagacagcactgtgttggcgtacaggtctttgcggatgtccacgtcacacttcatgatggagttgaaggtagtttcgtggatgccacaggactccatgcctgagagggaaatgagggcaggacttagcttccacagcacagccccgaggggtaaccctcatgtcaggcagagccgggagacagtctccactcacccaggaaggaaggctggaagagtgcctcagggcagcggaaccgctcattgccaatggtgatgacctggccgtcaggcagctcgtagctcttctccagggaggagctggaagcagccgtggccatctcttgctcgaagtccagggcgacgtagcacagcttctccttaatgtcacgcacgatttcccgctcggccgtggtggtgaagctgtagccgcgctcggtgaggatcttcatgaggtagtcagtcaggtcccggccagccaggtccagacgcaggatggcatgggggagggcatacccctcgtagatgggcacagtgtgggtgaccccgtcaccggagtccatcacgatgccagtggtacggccagaggcgtacagggatagcacagcctggatagcaacgtacatggctggggtgttgaaggtctcaaacatgatctgtaaggcagagatacaccatgtcacactggggaagccactggggacagccaggccagacgggggacatgcagaaagtgcaaagaacacggctaagtgtgctggggtcttgggatggggagtctgttcagacctactgtgcacctacttaatacacactccaaggccgctttacaccagcctcatggccttgtcacacgagccagtgttagtacctacacccacaacactgtcttagacacctagtcagagagacaaacaccagaaaaagagctcatctgggaaaaagcaaatagaacctgcagagttccaaaggagactcaggtcagagaagagagtcctacggaaaacggcagaagagagaaccagtgagaaagggcgcagctccgggaggccaggaaggagggaggcggccaccagaagaggtagcgggccactcacctgggtcatcttctcgcggttggccttggggttcaggggggcctcggtcagcagcacggggtgctcctcgggagccacacgcagctcattgtagaaggtgtggtgccagattttctccatgtcgtcccagttggtgacgatgccgtgctcgatggggtacttcagggtgaggatgcctctcttgctctgggcctcgtcgcccacataggaatccttctgacccatgcccaccatcacgccctgggaaggaaaggacaagaagccctgagcacgggcgcagcccccaccccggaaaccgggaggctcctgtgcagagaaagcgcccttgcctcccgcccgctcccggggctgccccacccagccagctcccctacctggtgcctggggcgccccacgatggaggggaagacggcccggggggcatcgtcgcccgcgaagccggccttgcacatgccggagccgttgtcgacgacgagcgcggcgatatcatcatccatggtgagctgcgagaatagccgggcgcgctgtgagccgaggtcgcccccgccctggccacttccggcgcgccgagtccttaggccgccagggggcgccggcgcgcgcccagattggggacaaaggaagccgggccggccgcgttattaccataaaaggcaaacactggtcggaggcgtccccgcggcgcgcggcaggaagccaggccccaaccccctcccaaccgggcgccagccccgcctccgcccggttcaaacagcgccgggtcggcgcgcgcgcacgcagcggccacaccctcgggcggccagcggctcgggcaggaagtgcgcgcaagcgcccgggagccgcggcgaccccaccccttccggccgagcccgccttcgccccagcccaggccgcggcaccccgggccccagaacgcacgcgcagttagcgccttgagtcccagcgcgcacgcgcaattagcgccaattcccagcgcgcacgcagttagcgcccaaaggaccagcgcgcacgcgcaatggcgccccagcccccaccgggcctggcgggggctccgccgcgcccaccctgcgatccccattggcaagagcccggctcagacaaagaccccgccggttgcccccgccccgagagcggcacccccggagcgcgcctcccgagcgcggcctcgcgcctccgaactggcgtggggtgtcccccatctccggaggcccaggggcttctcccgcgccccccacggcggtccggttccccccccatgcgccccccgctgcggcccagacggcggctctgcacgggcgaaggggccgcggccgcctgcggccgggccgtgagccgcctgccccggtcggctggccgggcttacctggcggcgggtgtggacgggcggcggatcggcaaaggcgaggctctgtgctcgcggggcggacgcggtctcggcggt

SEQ ID NO: 2304 - DNA, 82905 bp, Homo sapiens
  source 1..82905: mol_type = genomic DNA
aggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcgggcaatggcgctggcggcgggggcagcatgggcgactacatggcccaggaggacgactgggaccgggacctgctgctggacccggcctgggagaagcagcagcgcaaggtgcgcggcccgcgggccggacgggctggaggggcttttctgagggggcccggggaggggtgggaggtcctgaaaggtaactggagcgtctgtgatgggaacgggggggtcccgagaaggaattggcgggtccgggaagggaattggagtcctgaggaggaatcgccgagctagaggaaggaattgggaatctgaaaagagaattggcggctgggtggggaatatgggagtcaaataaaaggaatcgggaaggctgatgaaggatttggagggtctgggcgtgccattaggggaaaccgaggagatgactgggcaggctgaaatggaactgggatccgaggcgggcttgaagggtcggagcatgggttgggggtgctgggaggagaatcaggggaggctgagaagggaatttctgggtctgggaagtgtgaggaggagcttgagtgtggaggggttggttatttggagagcagaaagatctgaaggagattggaattgggggagcctcaggttgggggagttataaaggggatgaagaatcaagtgtgaggatggagtggagattgtggggtctgaagacgggtgggaagactagggaggctgggaagatgaaaacaggggctaagggtagaattgagcatgaaaagacatgggcttagggtgtgaggagggtagaggtgccaggactgggggtctgaggagggtggggtgcggaaggaagaagttaaggggcccgtgaatcagacgtttttgaagggggtgagatttatttgtggtgccctgttccaaaggggagaagattaagagataggaggaataataagaggaattgatgagggatggagaagccgaagtagaggggatacggagagtggggataatttggggagggatttctaaagaattgatgggaagctgaaaagctaaagcgttggagagaatgaggaagtgtagagggagaaggtgagatcggtgggagggagggtgagctggaatggtggataatgggagagaggttcgtttaggaaaatgaaagtctcattagaaagggaatgcgtaatggatagactgagaaaggaatttgaggagggggtgctggctcctggaggtgcagtcccgggactggagagcgtgtgtgtgtcgtgcaggcagaatgagtttggggaggaagcgttgagagtgtccaggaagaattgtgtcttttttggagagaccggaggtaggtgaagggatcctgaagcagagactgtgttcaggtggcactgtttttttggggggcggggggggcaacttggtagggccccacagcagtgaaaaggtgatcagaagtggagtgggatccccgagcgaggtgtcagtgtctgtgggggggggataaatccagtgtggttgaggggggagctctgagtgtgtgcaggaagagctaaagaaaggagcgtggtgagtgggtgtgtgtggggggaaggggttgttcagaagttttgtgcgtgaaatgggtgggaggtacttgaagttggaagcatttcgtgggatctggagatctggattttctttccagatttgttactgattcgctctgtggccttggacaagacccttgaactctccgggcagttttgttatctgcaaaatgcaaagggatccgagggttccctgcggtgattctgttaataaagagggatgtgtgtagagttgggactttggacagggctctgaaggtttgggagagtgagtttggtggagatttttcaggaacaggctacagggctttgagtggtgacctggcagagtggggagtgactggaagcctctcgagggcgcgagttggtggccaggagcttggcacaggcagcctagcccaggctggaggggaaagggtgggaagggtggaaggagcagctgttccaaggcagcctgaggtggggccgggcataaccttgggtccattaccagcgttgcttgaatttcctcatccgtagtaactgaggggcatggcagtggcttggtgggaggggtgtccttatccgtggccccacctactgcaggatggacaggttgcgatagttggcataaattcactttttgaggggaaggtgagatctgttctggagtctcaacaataatttattgcctgaggcagtgccaggttggaaaaggttgccaagagacctggaaagttgggagggagcaggggccacagtggtggttttgagaatgtctaggctttgtcttctgcagctgaaggtgctggagaaaataaacccctcccccttttttctcaggtgataagggtggggggaccttccttttctctcccttcctgtcttctgccactcctcaagtgactccttttgcgagccgggtttcactccctcccgagagttagggtgtgggctttgttcgtggttatagtgtcccttgcctacagggtgaggctggggcaccattcaggccctgggtggaaaccaggactccccagaacctccaggccttgctgccatgtgtcattctcttacctcccagctcccttcctctggggccgggcaggtttgagggaaaagggtggctcacagagtccgctaataccatctgctttcgtgtctcagccagagccagattctagtacctcctgctttacacctcctccagcaaatatttacccttagctgctctgtgggggaaactactgcttcacctctgtgccctttcctgttatggggtagggattctttttgaaatgggggaaggagtaatggaaaggaatacaccaatctgtgtggctctctaccttcctactaagaaacatccctgcactcccaggctggctgggttgtttgtttgtttgtttgtttgtttttggagacggagttttgctcttgttgcccgggcgtgatcttggctcaccgcaacctccgtctcccgggttcaagcgattctcctgcctcagcctcccgagtagctgggaatacgggcatgcgccaccacgcctggctttttgtatttttagtagagacggggtttctccatgttggtcgggctggtctcaaactcccgaccccaggagatccgcccgcctcggtctcccaaagtgctgggattacaggagtgagccactgcacccagactggctgggttttttctacattgcagtgttgctttagtgaatgacagattgcccttcttgcctctccaaggctgagccactgggcacgggaagaatgacagtcctgggggttctgtacatgcatactccaaaaaaatatgcatccagaacagctgtaggccctcaaagtgggtagaattgaattcttctaggaattaagcaagagttggcccaaatcagaggggacgtgtgtctcacttctgcttggaagccctttgctctgacttctagggacccctgtaacccgtaagtaggttatgcaacggtttttacatgagagggccatgagtgttctcctggcgggatggagaagcattgttctggtctttgagcaaattcttgagcaattacagttctgggccacagttccctctcccaatttctaaaagtggcctgggtaacctcatcaccctctgttgtcctggaagggtgagatctcttgaaggttatgccaaatctcattacagcaagaagaaatgactcacttgctaagttttcgtgttcattgaaacatcactatttcaggggcctcaatgtttcaaccctgaccgttggctttttttttggagacggagttttgctcttgttgcccatgtggctgtattaggtatgagttaactatttgaaagtttttgtttgttttttgtatttgttttttttgttttgttttgttttgttttttttgagacagagcctcactctgtcaccaggctggagtgcagtggtgtgatcttggctcaccacaacctcttccaggttcaaggaattctcctgcctcagcctcctgagtagctgggactacaggcgtgtgctaccgtgcctggctaatttttgtgtttttagtagagacagagagtttcaccatgttggccaggctggtctgaaactcctgaccccaagtgatccgcctgcctcggcctcccaaagtgctgggattacaggcgtgagccactgtgccctgccttgtttttcttgaagtagatctttttttctttttaaaggctgataatggaggccccaaagtagccatctgttactttgttccattactctaattgcttgcctcttaggatctggctaggactaacagttttcaaaattgagtaacacacttgacaaaaaaaaaggaaccaaactcaaactcaactgttatctagaaaaaagactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaagatggcctgggactgcagggtcacttacactcacctggctaagagttgagatctggctggtgccctggagtggcacctgccactcacctaatcctaaacaatccagggtgtgggcccaggattgccctctgccttttgaaacaccctccctggttccggcttctaagaccaacagggaggctactttggtggcagggagctgactcaccctccagttggaactggtgctaaaagcctccatttaacggcagccgactgcttggccccaagtgggctgccttgtgggggggaaagttcagtggaaagtgttggaggaagcagggtggtgtgtgaatatccaagtagtgctggtgctattaagctctgacacagtcagggaggtcagttaaaatgtggtcttatggccgggcgcagtggctcgcgcctgtaatcccagcactttgggaggctgaggtgggcagatcacctgaggtcaggagttcgagaccagcctggccaacatggtgaaaccccgtctctaccaataatacaaaaattaactgggcatggtggcaggtgcctgtaatcccagctacttgggaggctgaggcaggagaatcgcttgaacctgagaggtggaggttgcagtgagccaagatcgcgctactgcactccagcctgagtgacagaacaagactccatctcaaaaaaaaaaaaaaaaatcagatgacagaggggagcggggacaagttttaagtctaagcctcctgggtggggagttctgctgtttcaacatatgctccagtcatggcagactttggccagacagcgccctttttcagagtgaactgagtgtagcacaagttatctgccagtgctagttagcaaacagaatggagccaaaaaagaattgatttgggaaggcccaaggaatttgaaaccgttgagatgaacactttccgtttttgctacactgatttatgttgtgctgggaattgtacaagcctttgaccagaccttagggttgttctttaaaaaaaaaaaaaaaagattcccttgctgctgcttttacttttttgaagggcagaagggaagggcaaatataattagtgaacagctgtttgctctagtatcacttgctcgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcccaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctctactaaaatgcaaaaaattagccgggcacggtggtgcacccctgtaatcccagctactggggaggctgaggcaggataatcactcaaacctggaaggtggaggttgcagtcagctgagatcacgccactgcactccagcctggacgacagagtaaggctccgtctcaaaaaaaaaaaaaaaagaaaaagaaaaggagttaaatctttgcatatatttaactggcaagagcatccttacatcagtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcgagtggagtgagtttacgtgggatttgctgtttgccacctgttgttgtgctggctccttccttcctgggatgagttccattctctccccctcccccaggagtgaggctccccagccagagcagtccccctgtgcttatccccttccttcgtaaactgcagccatttgtgattttccataaccacttttatagacacataataatttcctttgaatcagtttgcattttaaattaagttttgaaaggaaaactgacaagagtatggcaactggaaaacccagctcccctggccataaatataatagaaggaaactgcaaaaataaacacattgaaaacaaaacagtgttgtttccaggtggttaccactcgggctgaaggccccccaggcttgaggcctgctccctttgttagaaagggattggcaagtgttggtgaggtgttaaagacccaccagcaccaagcagagactttctctttgaagtcatcaggtttacaagagaatcaaaggaaataactttctcaatgtgattcagggtgtaatgtaaggtgtagataacccttaaaattttccatgtgtgtatgtcacacttgggaaaaaaacttgatctcatctggtcgaggtgggcagggcagcaccttgtccaggagcacacagcccctcttggctctgtgtgtcatccggccatactagactcgaacatatggctcatgactggatgatgcttgattcatcttcagtttcaagtgttagtgcttttgaggttttgtaagaaaccaggacacattgaaaatacagtcatttctcagtatctgtgggggattggttccaggaacccccttatataccaaaatccacagatgctcaagttccttatgtaagataaaacgatgtgtaatttgcattttaactatgcacatcctcctgaatactttaaatcatctctagattacttataacctaatgctaaatgctacgtaaatggttgttacactgtgctgtttaggaaataatgacaaaaatatgtacatgttcagtgcagatgcaaccattcattttttttcttccagtattttcgatccattgttggttgaattcacagatagagaacccatggatacagagggctagctgtaagaaatgtgggtttatcatttgttcctcacacaacttttttctttcttcgtttttcttgcctttgttccttttttttgagacagggtgtcactctttttaccaaggctggagtgcagtggaacaatcttggctcactgaagctttgacctcgggctcaagccatccccccacctcagcttcccaagtagctgggactagaggtgcacaccaccacgcctgactgatttttgtgtttttgtagagatggggttttgctgtgttgcccagtctggtctcagcctcccaaagtcttgggattacaggtgtgagtcaccacgcccagccaactttttctcttaaggctccagttttcttcttagagttgggcccctcccacgaagaaagcacactgccaccccttcatcggatttgaaccctacattttgaaaggaaagcagtgccctcctgctgagttaacaaggcttatttaaatgtttttcttccaaatatcagagcagaacagattctttgtcttccagtggaactatccacatggggcagaagtagttggaagcggcagttactaccctgcagaacacaatgaagtcatcttgggaaatatcgtggatggtgttgcaatgattgaatgggatgctagaacaccagcaatacaatagcatttgtgtcttcagcttcaggcaggaataaagaagactttgtggtttgttttatgttttttaaagtttcccccccaaaggtgtggggctgagtgatgtctgtcactagctttctagtgggtttttcttttcatcttttcccctccctgatgtcttttgagagtgggtggaagccacagtctaggtggatcagaggaagcacagaaggcaggcagtataccccactttgtgttttccatgtctgaagggaacacatttggtttttgttctgttttgattttttagagacagggtttcactgtcacccaggctggagtgcagtggcctaatcataactcactgcagccttgaactcttgggctcaagggatctttcagcctcagcctccctagtagctgggattatgtgtgcaccaccatggccagctaattttaattttttttttttttgagatggagtctcactctgtcacccaggctggagtgcagtagcacgatctcagctcactgcaacctctgcctccccggttcaagtgattctcctgcctcagcttcccaagtagctgggattacaggcgcgcgccacgacgcccagctaatttttgtatttttagtagagacagggtttcaccatgttggccaggctggtcttgagctcctgaccttaagcgatccacccaccttggcccaacaaagtgctggggttacaggcatgagccactgtgcccgaactaatttttaaattttttgtaaagactgggtctcactatgttgcccaggcttttaatctgcaaaaagcccaagataaagagttttaatatcttacctcctgagtagtaatgactgattccagttctaataatgtcttaattacagctatacagattgaggggactgcaggaagtgaaatagatgcatttcttttttctttctttcttttccttttttaaatacacacttcgtttcggtggtgaaggccagtttgaggttaggagaggcatcttggaaggaagctcgcaggtggttcggcatctggacatgctgggaagttgcctgagggggacgtcacaataagaggactgtgggtctacagcctgccttagcaaaatgacaggccttcttttaccaaggccaagggcagtggtggaagctgacttcagttggtgtcatcaaggcctcagtatgtgtaacggttaacaaattactattctatgatcaatctccatctgggtgtgagtaaaaggtatttagttgctatcaccatggaaaccaagttgcttacttactgttttggggagtgccctcataccagaggcagtgctaatggtggagtgttaggccccgggcagaaaaaaagatcctgccacttggtatcacaggaaaatacctacaggcacagcagccttgccaggtaggggatgaaggccctctgtcctcggggcaggagttgggccagttgattgtgttgatgaggagtgtgcatttgtgcatgagagagggagaagaaaaaggagagcactccatgaaatccgctgctggctttgtagcctagaagagtgctttttttctctaggagtttggaactggaatctcagctatgtgacttcttaataataggacaaaatatgcctgtatcttttgcctacttccacaaacactgataaattaaaaagaactctaaatttcccacaaatcccaagcacaagtaactttttttttaaatccacatcctccctaatccaaatctaacagcaaatccttttctctctgtcactccctgcttttctttaagaaaatgagtaccttgccttaaactatatattggatgaaaatattaaacactttcacaaagtgcttctttggctgttactggtatgccttgcatttggaagggtcagagatttgaagacttctgtgatcttccagttctggcctatgaaatacagtcagtttcaaaattcaaaatgtctggaagagccaacttgccaggccggttcaagggcagtcagatgaatcgacccttcttacaggctgtctacgaaccagtcatgattcagatattcaagtcctggaaggtatccagacggtaaacatcaccaggattgtgaggcagttacttttttttttggatcgtttgagctacactgccaagactgtggtaggacttgtctgtgtaaaacagaaagggctgtctctaaatgtctttttcaagaatgtcggctataatcacccgacactgtgtctcatggtggggtgagatgaaatacctagaccggttaggggagggccttcttggccattttttgaactaattttccctttccctttgtaacttttttttcttcttttcttttctttttttttttttgagacggagtcttactctgtcacccaggctggagtgtagtggtgcaatctcggctcattgcaacctccgcatcctgggttcaagtgattctcctgccttaggctcccgagtagctgggactacaggcatgcattccacgcccagctagttttggtattttttaggagagacggagtttcaccatgttggccaggctggtcttgaacccttgacctcgtaatgcccacctaggcctcccaaagtgctgggattacaggtatgagccaccgcgcccagcccctttgtaactttcattaacactgatgaggcacaagccataggatagaattgaatccattgagagctgtgagccaattgagggatgattggttaatagattgtggcttgaagctgtggaaggtaaggggtgacacttgactcctattagccttgtagaaacacctcagagattcacaggaagcaaactttgaccataaaaatataagactcacagcgcaccgagttctcttagcagctaccttagagttgagaaagttttgggcctctttaataaacaagcacaaagcagttcttgccaaatacggcctgctctggggccacagggttagcttaggagacaactttcttgcctaaaaataaatgcatgttcctatcagacattccaagcatagtttaaacatgagacttctgagcagcagctcaagctctgtgggttcaattatgtcagagtatgggcagtgagggtctttggggagtgtgcccccttatttgggattggttgtggctaccaaggaaatcagatgatcaaatgcaaaacttcctccatcttatttctatatgatcttttttttttttttttgagttggagtcttgctctgttgcccaggctggagtgcagtggcaggatctcagctcactgcagcctctgtctcccagattcaagctattattctcctgcctcagccttccaaatagctgggactacaggcgtggccatcatgtccggctaatttttgtatttttagtagagacagggttttgccatgttggccaggctggtctccaactcctgacctcaggtcatccacccgctttggcctcccagagtgctgggattacaggcatgggccaccgcccccagccttatttctacacgttcttgatctatcacaggctggtgggggagacagcatgcatatagataatgaacaaggtaacttcagataggattatgtgcaataaattaaataacagctagcattttaccttgtgctagacactattctaagtgcttcccatggactgactggtttttgtttttttttctttcctttgagactgagtttcgctcttgttgcccaggctggagtgcaatggcgtgttcttggctcactgcaacctccgtctcctgggttcaagcaattctcctgcctcagcctcccgagtagctgggattacaggcacgtgccaccatgcctggctaatttttgtatttttagtagagacggggtttctccttgttggtcaggctggccttgaactcccaacctcaggtgacccacccgcctcagccaccccaagtgctgggattacaggcgcgagccaccatgcccgacccatggactcacttgtataatcttgtgaagcaggtgttgttacccttacatgcagaaatggatccatgggcctttaagccacttgcccctgtgacagtgccaggatttgaatgtagaagttgaggctttcaagtttatgctgttatttctacactacactgaagtctagtgattgggaatggctttgcgagcgggtggtgaggggaggagtgtgcagtgcaggtacttcagatggagaggaaggtctcaaagaggtggcatttcagctgttccttaacggatgagaaagagagaaccaagagagcaccagaggaacgcgcttccaacagagaaaaccaagcaagggggcccccgaggagcagaaaggcccgagtggtcagagcggagcccgtggaagagatgggcacagccagattgcttagagctgtgttgttagaagtgctgatgagtctacattcaacttgcgcctgcaaactcagtccctcttagatgccagtaggtcaggaacctcatgcttccaggactctggcgctcctaccctttcctcccaggcctcctggacaggccaaaccagaactgacttctaaagtgggaaccccaagacggcagaacatgaatcagccaaacaaaagctgcagttatctctgtgatgatttcggcagtcggcacgtgtatttgattaaagcgttggtaactttgaatctggagttttatggcactgtgtactactcataatggctttgtagtgtggctctcttagggagcttaacttttacaacatgaacaagttccagcctcctttggtcccatcaagaggccatttctacctggtgggatgccacttgctttacaaagcatcttttgtaaaatgttgagtctccttctttgaagttggaagccaggaagcctgattttttttccaataagtattgtagaagatggcagcctgatttatttttatttatttatttattttgagacggagtctcactctgttgcccaggctggagtgcagtggcacaatctcggctcactgcaagctccacctcccaggttcacgccattctcctgcctcagcctcccgagtagctgggactacaggcgcccgccaccatgcccggctaattttttgtattttttgtagagacggggtttcaccgtgttaaccaggatggtcttgatctcctgacctcgttatccgcccgcctcggcttcccaaagtgctgggattacaggcgtgagccaccgcgcccggcctggcagcctgatttttaaactggcttttctcctaggtcctttccttctctataaatccctctttcacttagtatttcctccttgtttcctttggtcagttggagtgagggtggttctagttcagagaaagagacaggcatacaggctgattcagtctgaggtgcttagctttctgtacctcactggaaaccagtccaggaatatgacaggtttcagtaggtttcattggacccacaactccccatttgaaggcagagcttgtcaaacgagttatgtggcttttactcaaggagggaggaacagcaacagggagctctgggctattgatagacactcctgcctctgaacacacagcacccagcaagaagttaccttcatgggttgtctagagtgaacatgggctgggattctctcagccttagcactgatgatttgacaacaaaaatcgccccgtgggtagagtataacggagcaaatgattatggtggcctgtgatggtgcagccagcccagctgcttcagctggaaagaagatggcgaggtttccattctcctggcagcatagccatgtgaacttgttaaatcttttaagtagctgtataggaggggagataagtgtgtgtgtgtttattcttatccccttaaatacaaaaacaaaacttccactttataaaatcaattcagagtgggaagaggtgcatggcacatggaaaatgtgtcggattaggttgagtcctaccccacgtttgggacacagctgtaagtttccatggtgggtggcttattatgcatttatgctgagctgaacctgctccaagctgctgcagataggaaagtctgtcttggagggggagctgcctctttctatcacactataaagacataaaaggtcctttgaaagactccagcagtcaccacttgggtaacagaattaggggctgctgagcaaagtgggtctgtttttttttttttttaaagacagagtttccctcttgttgttcaggagtggagtgcaatgtcacaatcttggctcactgcaacttccgcctcctgggttcaagtgattcttctgcttcagcctcccaagtagctgggattacaggtgccggccaccacgcctagctagttttttgtatttttagtagagacggggtttcatcatgttggccgggctggttgtgaactgctgacctcaggtgatccacccgcctcagcctcccaaagtgctgggattacgggtgtgagccactgcgcccggccacattttatagccaaccggcttcttgtgtaacatgagttggggcttcttgggccccagagtccagcactcaggtagaaatatgaccgccatggccagacagcagccctcgctgggcccctcttcagagcagagctctgtgccgagcctttaggggtatgagagaaaccggagacctggtccgtgctctcaaagagctcgcggtgtagctggggagagagcaaggccacatgagacctcagaaggacactaaacggcacaccgacaagctcacagcactctagctgtgtcccgggagaggaaaggggtgaatcagggcaggtggggtcagtcatggaaactttcataaaggaggtgagtgtgcaggaggggcgggcctttgcccccgctgcgggcaggttgccgagggcaagtattagggggtccggcgtgcaatcgaacatttcttagctgcctctttggagtagcgctaccagttcctgtccccatgagcatcgtcttcggggagctgctggtttgaaggatgaggtaccatgctcatcttggccatgtcttagaacctgtgatagccagacctgtcgttctgggtccgtatccattcatgcgtcctgtcactgtcacagatatcgtgagtgggccagactcttctccccaggtgggagggggtgccttctgaggcatatgttttcagcctgctgatggcctcttcagaattagcacaggtttcgacaaaaagaatggagagactcccttctcatgtccaagggtctccccaagccctgtgtctcagcccctcagggcgtgtggtgctgcacactgccgcccagatgaccacgcgcagccggaacggccgccctgtattgagaagtgggatcggctcccagtctgctggcgaggctgggttgccacagctcctctgttgccctgcaacgcgggtggcctaggagtgtgctgccttcagtttattcctgcctgccaagctacgcttccaggtgctattcttttctttaaataactgccttagtgctgcttgtggaacttagcgttcccatcccaggaaatactccagtgttgtgtttttttttttaaactcattcagatgctcatggccaaatgtgtgacttaaataccgcagtgtccttgatattgccttccccacaccgacaaaccgagttgcattctggtcccactgtgggataaggttagggtagcggcgcttgcctctttgtgtggtttcagatgtgtttctccccacttcagataacacatgacagctgtaatatagctcagttcgtgcaagtaaggtaggggcagaaatcatccaggagaactccagcctccatcctaaaggattagactgcctagcatcagtaggtttaccatagaaggattcagtggagatagcgagggtggtgagtgttgctggattgagcccgtccctgcagcctgggcacgggagcactgcagtgccatgaaggagagggctgggggatattagcacagccggttcctatttccttttccacctggttaagacttccggggaggccctgcccagcagtccttatgagatgctgccttcctcttttttgaaaggcatagatgataaggaggtggacatgttttgagaagagaacctagagctcattacttgtatttgaggcatgtattgcttcactcccactttgggagagttttttctggggaagttaaaggctattcaggatcagagagtttcctgcatggtcccaggggctgggaggagccacctgctcagctggtggttagctgatagcacccagcctacccaccaagataggaggcagctcagatgtcactgggattcgcagtaccacaggctgtccctgggcccaagcagttagctagctgcaccccgggagggggtgttgagagcactgaagctcctgtgggagagtgcctttgacatcccccactccccactgcccagaactaggaggtagtgaaaggtgtcagtggcaagaaggctgggccagagcatggagggaggccgacctgggctccacacccacctcctccaccaccggctggctgtgcgaccctgggcaggtggcgggggttaagcctcagtgtccttctttgaaaaggggcatcatcctatcctcagtttgaggattagacgtgatagtgcgcaggaagcactctggtgcctggtacattgtaagtgctcaataaatgcagcttcccaaaatgatttcaatggcacatggtcctgcatccaggtgggatctgctacttgagtctccccctcaaaggggcctgctgaaatacgcagctcagtgggaaaccaaaacatacacccctttcctccagtgctccccaggaagcgccaagtcctgagcccagccagcaacttcgaagaagtgccctccaacaagtggcagtgggcacttgagcaagtgacttaacgcagccctctccccagcccctgcatccatctgggcctcattatctgggaggtggcttcttgtttcagagttacaggccctgaacaattttgtgttgggatgtgccataggcagtgccaggaaggttctttcatgagtaatttaacttgttactaagtttgctatcagccggggggctctttccccgggttcccttctttccctgggtccccttccccgcaaagcaaagtccaactcaagttagaaacatcccacagcctggagtcaggctgccctctcttcagttggtgtgtgatgtagaagcaggaagggcttcccactgataaccctaaaaataactgcccagaaatgctgtcagatggggccaagaggtgcacaggagcctgtgcccagctgccgacctggaacgtgggactttctagagggcttggaggagccctgccccttccaggcctcttcccaacagtgcttctcacgcctgctgctccattcccttttcctccttcctcccgcgcccccccctttcctggggtcacttcctgatgccattcttcaacttcgcccctgtcccccccaaaagcaatcaaatccacaacctaataaggcaaaagaatgaggagaatgtccgcctcccagcctctcccctaacagggtgcaggcctgaagcaaatttggaaaatgttacaacggagtgacaaccgatgggggctgggggtggggcggtgcagccttgttcaggagctgcccattgttggcctgaggcaggaccctaagggaaggccacccggtttgcgctttcctgatcaggctgttgacacccttctagcacaagaaaatgtatggaaagtaactgcctgagtcagctgcatctccagttgtgggatccacgtgccaggagaacacgaagtacacacaggtccgcagtgggagcccgctcggagacacctccccgccatcacggctgggactgtgcatatccaaacacttcttgcctctgagatgagcagttttcttccccttgactgtgccagggttcaattagcctgggcattaattaaaacttgtcaacacttagagtggggcccccagaaatctgtcacccctcctagatcattatcccaggctaatcaaccctctctaaggcagtttccattcttgacttagtgggagggaggaacaagcccctcggtgctggggagctctgggggaggtagggactgactgggcccaacccactttgttttggaaggtcaagcttagtaattaacctgaatgcttgggggagggggtgaaggagaaagaactgagtctagggatgtgccaggtctttcaaattgctaattatcagcgagcatgaggtcatccgtaaatatatctaattctttagcttgtaattaaggtgctcattaaaagtgcagggaagtcttgttttcctaaaaggggaaaaaaacaacaacacaaaaagtctttgttttgacctgacacgatggctcagaacagggggaggactcaaggcacaggactagtttcctgccttaaagagcctttacaggaaattgactgcaaacagtattggtgaccctgccaaggaggcaaacctagggtgatgtcattgttcgaagctgtcaccgccaagcctctggccttggggcgaggagagttggtgggattaaaaaatgagtgtgtgtatgtgtgtgtgtgtttagcagtctctaaagaggcgagtcaagggaaaatcctagcgggagaaaaatcacaaggggtggggggtgtctcagaaatattcttagctgggttcaactttcctcgtttttctaagtttaaaaaatcctctcttactatttttgctcatcaaaatgctgctgctttttcagagacagccttttttgagccattccctatttagtgttttgggtaattggctgttacagtatggaatttgtggcccaaaggcagcgtggtaagttagacactaggtgcacggtgccccattgttatgaagtgtggaaactgagacgctggactagtctgatgtatctgtttcttccaccaaaaaaaaaaaaaaaccattttggagaactacccaatgccagtgacttggcatctctgagtcgctaatcttcccatgtgcctccaggaaccgtctggagcgtccctgaaaaaaggacaaggtttgtatcttgtcatttttcctctggctggaagtctaagaggtataaacacagtcttaaaatgaaagcaacaaaaataaactcaaagcagccctgcgtgaaggcattaatgcaaaatatgcaagctggcttcctatttatacggcggaaggcagtcagaagagccaggcctggttaaggaaggagttatgtctctggaggtgcctgttccttagaattacaaataaaccctgggtgattactcagatgaggttgtaatgtggtgtctcatttcatgctttgcacagtccagtttcttgatggaaccaacggcctctgaaatgctaatgcaggatcaggatacagttagagtgccccccttcctgtgcccctcctaacatcctaacagctttagaaggaagtttgaagattaaacaggagagccatgtaagtttcctgtgatcctagatcctgtgatttgttaatattctttctcttcaatccacctgacatttacccagataccatattaggcttggagatacaacaagaaagaaaaccaacccaaccctgtccttaaagaaaagatggacgatgaagggccaggcgcagtggctcactcctgtaatcccagcactttgggaggccaaggcgcacagatcacgaggtcgggagtttgagaccatcctggccaacatggtgataccccgtctctactaaaatacaaaacattagctgggcatggtggtgcgcgcctgtagtcccagctactcaggaggctgaggcaggggaattgcttgaacctgagaggcggaggttgcagtgagccgaggtcgtgccactgcactccagcctggcaagagagtgagactccatcgcaaaaaaagaaaaaagaaaaaaagaaaagatggacaatgaattgcatgatggaagtgaacagtgttagggcgatatgcagatgtaaatgtggtcttgttttactgctcactgacttactgaagtaaacccattgacttcgccttcatgggtttgaaaagggtttttccaatgtgctctgtgtgtctcggagctcaggtgttcagagctgcctcccttataaatcgacctccaggagagttgtgtgtttggttcttggtgtatggtttcgtaggctccccagggctgaggagtcaccttgggatccagctttttttcttttttcgagacagtctctccctgtcgcccaggctgaaatgcagtggtatgcacttggctcactgcaacctctgtctcctgggttcaagcgattctcctacctcagcctcccaactagctgggattacagacgcctgccaccgtgcccagctaatttttgtatttttagtagagacggggtttcaccatgttggccagattggtctcgaattcctgacctcaggtgatccactgccttggcctcccaaagtgctgggattacaggcgtgagtcaccgcgcccagccaaaatccagctttttcttagttcctggcttggggcatgttgctggaaaggaatgacagattgaggcaagaaggaggcaagaaggatgcatctcctggccaaggaaactagagtttggaggtgtcccctgtcaatggcatctgaagaatttctacattggaaaggcataggtgacccagtctggtttggagtagatgggactgggtaggggactagtcttgaagctgcaagcatgctgtttttacttagagcacaggtagctggggaggagatcactgtggtgtgggtggcagaagccatccctagccatcacctaggaagatggtggcccttgggttgcccgagctgctgcttgttttagtagctgcatttggtgccacatttttgtggtaactgccaggaagcggagcccagcgtggcctcaggaagttggtgaggtttgcaccactttttaacaggctggtaacagtgccggagctgacaccctcatggttgcagccctgggattttgttatttggggacactttggaatatgtcactcagaatgctggctcactagctccacaagcaaaagactccttgggtagctggaagcaagcgttgggggaaggagggagaggcaattgcagtccagccaagaatctcaaggctcagtcttcaatgtatggaaacttcagtccttttctgatctttagtggaaatagctgttcactcttagcgccaattggaaagtgttggcagctgaagggggtcgttcctcaggggtccccagagccagtgtatctggtatttctaacattttcctagccacccctttctcctccatatgcccctcccagccccaccattcagatagggtggctggaaagaacatctcctaggtcctctaggaaacttggtgtttccactcaagggagttggggatcacgtaacaccctccacttccacctgggatttcaggccatctgtgggagtgcaagagcatggtggggtggaggtcacaggaaggtggaagcaaagccagggcagctccacatgcagccccctttcaggaacagcaaggataggccggcctgtatcttgttgctcagagcaggtgatcctgtcatttggacccttgtgaggagaatggatgtgagtgtgcacctggttctcttctcctggggctgagggactgtggtcttggattatcacatggtaggtgaggtgacaaaatggagggaagtagcctgggtggggactggggtggccactgcagagctctagctgatggtggccaggtgggaatggggacctgggacttcacgaagctggaaatggagagttttatggggcatttcattcaacttaaaaacctggccgggtacagtggctcacgcctgtaatcccagcactttgggaggctgaggagggtggatcacgaggtcaggagattgagaccatcctggccaacatggtgaaaccccatctctactaaaaatacaaaaattagctgagcgtggtggcttgtgcttgtaatcccagctactcgggaggctgaggcaggagaatcccttgaaccagggcgtcggaggttgcagtgagctgagatgtcgccattgcactccagcctggtgacagagcaatactccaacttaaaaaaaaaaaaaaaaacctgcaggccatacaaaatagggcctattgggtgtgaagagctacccatttgtgacccctaaccttgcatggtcttgaccctgtctctgcctctcctctagtctcccctttcctcttgtctgaattgctgctgcttaatcctctcactaggagcgagaaaattgtactttgccccttagtgacagctctgataaaaggtggttgaagtggatggtagtaaaaagggtttgctttagctgtggttttccagcctccggactcctccccctttcccatcaccatagataattaagagttgactcctcaaaattcctcccaccatattgcatatttttaggcttcaggtttttgtgaaccaaaatagtggaaagtttttttgtttgtttgttttgggtagcccaaagcaacacttttctacagaggcagccattctgcacgcacaataacctggtgaacaatgccagctttctattaataaatgaactgccagttcagaatttgtacccatgtggcagatggacagaaatagtttctttaggattgatctcttaaatttgactttgggaagatactggcagtccaggttttgtgacagagatccatcctgagatctttgtaaatggaaaagcctgaatgcagcgtttcttattgataggagagttgatggatttcaggaaaatgggatatagtagatgtgcaatgaatttgttgacttggaaacaaatttggacacttatccctgaaaacttcaggccattttttcctaaactctaattgagtccctgtgattggagtactagccccacagtccttatcaaacttcgcatttggagcaggcagtctgtctgggaaaagccaggaagctcgccatgaaggcatcgccctctgcttttaacttttttaggctctgttacctctgcactggcttgagtatttcctggctcaattgtttctcaggctggccttgagtccttagatgttatttgtgtgcctagaaatagctggaagaaaaatggttgtaatgctttgcattgctcactgctctccatggatggaaattctgtgagggaaagagggctttccacccagaaaaagagctgggcagcgtagacttcattgtcctgctggcctgtcatgttattctgctatactacagcgattaggatgagagagtttctcgctctccctgggtgtgccacctaaggtacattagggtagggacgaacatggcgggagttctcatagtgggctttcctgccagacgtatggcccacacagcagtatttcttacatgtggttcttttttttttttttttttttgagacggagtctttctctgtcgcctaggctggagtacagtggcgtgatatcggcttactgcaacctccacctcccaggttcaagcaattctcctgcctcagcctcctgagtagctgggaccacagatgcatgccaccacacctggctaatttttgtatttttagtagagacgtggtttctccatgttggccaggctggtcttgaactcctgacctcaagtgacccactcgccttggcttcccaaagtgttgggattacaggtgtgagctaccacaccctgccaaggttctattatttgatctatgttctttgtttgtttgtttgtttgttttgagatggagtttcgctcttgttgcccaggctggagtgtaatggcacgatctcggctcaccgcaacctctgtctcccgggttcaagcaattctcctgcctcagcctcctgagtagctgggataacaggcatgtgccaccacacccggctaattttgtatttttagtagagacggggtttctccatgttggtcaggctggtctcaaactcctgaactcaagtgatccacctgccttggcctcccaaagtgttgggattacaggcgtgagccaccatgcccggcccctgtaaccatttttaagtgattgatcatctcagcatgattgatggagatgatggggttggccatccattcttttttttttttttttttggagacagtctcactctgtctccaaggctggagtgcagtggcacaatcttggctcactacaacctctgcctcctgggttcaagcgattcttctgcctcagcttcccaattagctgagattacatgcatgcaccaccatgcctggccagtttttgtgtttttaatagagacagggttttatcatgttggccaggctggtctcaagcccctgacctcaggtgatccccccacctcagcctcccaaagtgctaggattacaggcatgagccaccacacccggcctattcatcatttattgagcatttatttatacccactatgtgccgtaaacaaggtgctgagtaatgagatgtgaacagaatagtccttcttcttgtcctcatggagcacacagcctagtcggggacaataggcattaaaaaataccaacaatgaaaacccaagacatacatagagtgttccaaattgtggttttattttttatatatatatattcatatatatttatatatatttatatatatattcatatatatttatatatatgaatatatatttatatatattcatatatacttatatatatttatatatacttatatatatttatatatattcatatatatttatatatattcatatatattcatttatatttatatatattcatatatatttatatatatttatatatttatatatattatatatatttatatatttatatatattatatatatttatatatttatatatttatatatacttatatatatttatatatttatatatatttttatatatatatatttatatatgtataattttttttttttttttttttgtgatggagtctctatcacccaggctggagtgcagtagcgtgatctcagctcactgcaacctctgcctcccaggttcaagcaattctctgcctcagcctcctgagtagctgggattacaggtgcctgccaccacgtccggctaatttttgtatttttagtagagatgggatttcaccatcttggccaggctggtcttgaactcctgaccttgtgatctacccgcctcggcctcccaaagtgctgggattacaggcgtgagccactgcgcccggtgtgattatttttatgaaggaaaagaccagagtcctttaagaggggacagtgggggacttgcaatagattgtgtgggagctgtcaggggagactttccaagatgatgacagtgaagtgaggcctggagggagagttagagccaacctcagagaagggaacactgttctaggcaggaggacccagggttgtgggaagagagaaataaaatgagaccaagacagtggggagagcagtgtgagttgaagtcagaggggtgacagcagccagaatgtgccggtagcgaggatcttggattttattctagctgcaatgagagctttgattctacaaatatttattgcgtgctagtcactgttttaggtactgggtgtacaacagtgaaaaaagaacttcccagccgagtggaatgccgtggagcatatctgtttcgatgctgggacagatccctaacacagctcattaaagcagatagcaccattccgtctctttcttcagcttcactttacgtcagtcccagcatttttatccctacccttacagatgagagaactaaagttcagagaggtgacgtgacttgccccaggcccctcagtcagtaaaagacagaactgagaatccaaccagactcttccctttttaggttatttctctaacattagggccgagtatcgattctctttacctctgacttcgtgtccctggtattaagactcagggcccacagtgcctcttggaattcaggcatatggtgacatcagtgtgcctaccattcaggtcttggagaatagggtatggcgaaaggagagaactcgtgatatcgctgattcagtagcccagagttgtacgagtccttgggtgtttcaccttcatccaggcatctgagattggagacaagcatgtggctgaatgacgtatctgggggaagctgtctaaacagccgtgtggagttggagagttgaattagctctgtggccaaacctctgggctcagtctgcctatatatggcttgatctcaaagaacaggtgatagcagtaggagttgttttctgtgttgctggtgggagatgcccaggcacattcctttgtagacaagcacaaactagatatttttgaaatcggaggtctgaaaccagccgaagaattaatcctggcctggaaagcatatgggagagtacagccaacctggcttgggtgttgctttcttggttttgttgcatttttgaggcagggtcttgctctgtcacccaagtgggatcacagtggtacaatcatggctcattgcagccttaacctcctgggctcaagtgattctcctgccttattttttgattttttttgtagaggtgaggtctcaccatgttgcccaggctggtcttgagctcctgggctcaagtgatcctccaccttggtctcccaaagtgttaggattacaggcgtgagccgctgcccctggtgactttgttgctttttaataagcccagaaatttctttcaagagggaggatctttgtgaacatcttgagccgcgttcttgatcgctggctgtggaagcctccacctatcaggctcaagtccatgttgctatcatgtgcactttggctggtgaggtgctgagcagaggtttcagcctctaccacaaggtttcctgatgaaaggtcagctgggtgggcccagcttctccttacccaactgagaggcctcatagagcacaaggcctgggtacggaggttcctggggctcctgccatacccagccaggccaagcagagggccccagtgtgttgttgggtgctgagaggctgcccgcagctctcgcctgtgttggaaggctgtagacttggcttctcccaaacgtaagctgtgaagccatggactcagattctcagcctggccctgctacttactgtgggaccttgggcaaggaagtctccattttctcttttacaaaatggggccaataatctgactaccacagggctgtcaggatgcagcgggatggagcctttatagggtcttgttctgtgggatctggagtcccatatgggagttattagttgagggacgaggcatctgggaatctttattcaactaggaaacttcagccaaagaactaatgccatagagatgtcttatggtgtctgcatttgaagccagcggttctttgaaaatttatcctgagttccagaaagccaactgctagataagtaagcattgagcatttaaggggtcctggaagtaagattcctggaaagaagcagcaatctcttactcatccccgattatctcagacacagagtggtggatggaacctttgtggtttaggggctgactcttggtattgctggataaggaatatgagccagtagagacgagtgtgttgtatagcagtgtcctgcgactgggctggagacgtggctgagggaggccagggggcctcagagtgcacgggaggaggcttacagaggtcttttgcatcctgcagaacaccacatgtgtccttccctctgggaaacctcccacccgggcagggcctctggggccggatgtggaaggtaaacaggctgcctttctgctctctaccacagacaggcccggaaaggcctgagtaggagcttttcatctcaggaagccctgaggtcccacagcttctcctgaagcagcctcattgtccctttgtaagagcatgaccaggtgctctagctcctggagcaccagtggagaactagagtggcccaggtgctgatgccaagttcgagcaacagctcctggcgggtttccctgcatccccccactcactcccatctattcttcacataggggccaaagaacatcctgcttgacatcttgatcagtgtcccttgccctcaggatcaaacctgcaagtccccaaggccctgcaggatctgttttctcctctctgtgctccgggcgcatgccagctgcctctctgctccatgctcattcctgcctcctgagggacttcacacggggcccttgcctctgcccctttcgcctcagctcgccacctacctcctcctcattcttcagatggcagtttatgcttcactatttgtagggccgtcgcacctgacacctccagcctaggttaggagcatgtccatcacctctacttctccttttaactccaaccatccttggctctccctctcgagggtcacgagagcagagagagaatctattttgttcaccactgtgtccctaccatgtgggacattgtcaaggcaaatgtaagtgtgcactaaataaatatgtattgaatgaatagatagccaaacagacagaatggatctgccacaacacaaacaggatgcttttcaagtgggcagaagatggagacatcacttgtcgagacactcaaacaagtggctggatggatgagtggcagatccattctgtctttctgcttggctttaggagtagagggatcacccatggtccatcctctgaggacaagggtatcatgaccgcccaggccccactcacccctgccaggctcattgcatcccatctaaaagtgtgctctggaaggtcataagaagtcctcacctgggacacttctaggcccagtgttcagccagctgtcctgagttctgcatcagtccctgctagatatgaaacacaaacaggatgcgatgcttttcttttttttctttttcttttttgagacggagtctcgctgtgttgcccaggctggagtgcagtgggtgcaacccctacctcccgggttgaagtgattctcctgcctcagcctcccaagtagctgggattacaggtgcacaccaccatacccggctaatttttgtatttttggtagagacaatgtttcaccatgttggccaggctggtctcaaactcctggcctcaagtcatctgcctgtctcagcctcccaaagtgctgggattacaggtgtgagccaccgcgcctggccaaacaggatgctttgcaagtaggcagaagagggagacatcactgtcccatggagaggtgggaaaatcatcgttagcacaggataattcatcctattttgtgctcatgtttactgagctaggattgacctgtgtccgggcagcagggacacagaggtgagtaagacaaagagaaggcccttgcccttaaaaatgatacgtgtggctaaaacgctgtagacctttttgttttttcctttttgagacttcctttttatacagaaattgctacctgcaggtaaaattaacttacatcgtgaaagcgacagtaaagtgtttctagggatagctaaagacctaagaacacagccctgtggtttgactggctggccaccttcctgcagctgggtttactatggtgctgtgttctgggacagcccactcgtctccatttattgggctgagcctcgagacctgcaataccagggaaggaagggaagtctaggctgtctttggtggccattgttatttatggggcatcggcagagaagtcagtaccatggaaaatctagagaaagatagaggatacgcagtgtggttgagcagaatctgatagctccctggctctctccgggccatgggacccagggcgacacagccaccctttttctctctgctgtctggcttgggcttgggctttgtctcctgtgtccctccacaccttcttcgctgtcagtggtgaccaatcccgtggaatcagccactgtgtgttaccccaagtccttgcccctgggacctcgctctgttcggagacaaaacccgggactgtttctccttttaaatgcaaccttgttccacaggagaggagaaaagcaagaaagaggtggcttgtttatctgatggtagtggggtgtgctctgatatgcctttgaaaggggcccagctttgctttgcccagcggcctttgcaggataatgagagaaggaaaacacagggaacttagtgggaatttgaaactggagtgtgggagtgggaaagttcagcttttaccttggagcaatccagtctttctcctgtaggaaaacagaatggtgctgtatggcctccaagctgggttacatcctgggaaaaagacacgtgcttggctattggcctgggcgcagtttatgtgtaagcctttccttgtggattccattttcttatttcccgaatacttctcagccccacaagtccactgagtcttctgtctccagagactgcctggtttccatccccgagggcatctgcgcatcacttaccatggtgtaccatgcacctccagtgtgcccggcactgtgtcaggagctggggatacaggtgctggtccccacctcactcccctcaacctctgcaatatatgatacataacccacacacacagaccatatgcaaaagtggtgggactcctttgtacctgtcacctgcatcagtgattatcagcattttgccagacttgtttcatcagtgtctcccaacacactccccccagacattacccatacgtgctcaaatagatttgggtgtgcgtgtgtgtgtgtgtgtgtgtgtgtgtgtgtgtatttttttagagacagggtctcgccctgtcacccaggctggagtacagtggtgagatcatagctcactgcggcctctgaactcctgggcttgctttgttgcccaggctggtctcagaactcctggcctcaagcgattctgccaccttagcctcccaaaatgctgggattacaagtgtgagccaccgcacccggccaatgtatgtatttttaaacataaccacatactgttatatttaatgcttctgaccatgtcttaagaaaaaaacaaaaactccctttggcttccttgacatcacagtctctctgtttctctgactcttcttcctcatctcctatggctaaattctctccctctgtccactgcttacacatgggcatttcacaatgtcctttttccctgaaggaacttaccccctcccctcagccttaagtaccccatctgtggggatgatgcccatgcctgtagtcctgactcactcaccacgctctatcgcagttatttactgatgcatctctctcccctatcagacgctgaggtctttgatggagcaaccttgtatttgtccgtgtatccccagcaccacacctgtccatagctggagctcaggaagtttttttttttttttttttttttttttttttttaaagtcagagtctcactcagtcgcccaggctagagtgcagtggcacaatcttggctcactgcaacctccacctcctgggttcaagcaagcacgtctgggtaatttttgtatttttagtagagatggggtttcaccatttggccaggctggtctcgaagtcctgactgcaagtgatctggccgcctttggctcccagattgctgggattacagacaggcatgagccactgcgcccggcctcaggaagtagttgaatgagtgactgaatgaatgcccacgtgagcaaatgacctgtttgctgaactttagactgacgttgcctgatgcccactgcttgtgcagtacgtacttcagtctcagcgtgtctgagaccaaactcattttcaagtcccacttcttgggcttggcattgcccatttgtcagccatccgagtcagaaaccttggagtcagcttttgacttctcatcctgtaacaggcaccaagtttgatttctttcccttgaatatctcttagaaccctcaccttcctccttctctttattcctaccattgtccttactcaggaccatatagtgagggtttaaaagtgcagagtcttggccgggtgcggtggctcacacctgtaatcccagcactttgggaggccaaggcgggtagatcacctgaggtcaggagttcgagaccagcctggccaacatggtgaaaccccgtctctactaaaaatacaaaacttagctggatgtggtggtatgtgcctgtaatcccagctactcaggaggctgaggcaggagaattacttgaacccgggaggtggaggttgcagtgagctgagattgcgccactgtactctagcctgggtgacagagtgagactccaatctctagaaaaaaaaaaaaaaaaaaaaaaaagcagattctaaactcacagtgctgctgctggctgcctgagcttgtgtggctttggacagatgacttaaccactctgtgaagatggtatctgatgcacaggaaatgctccaacgttggctcttgtcgtcatctgtgcccatgtctccctcagcagcctcctgactggccttctccagtctcctggtttggattgaggctccctagaccctacctttctgagactggtatctagtcaggttactctgggagatctccaccccccactgcccagagagcaggttctgagctcttcagtctctccaccttctggccccggctgacaccatccctgccacttctcctggggtccccaaacatctgtggtacttttgtctttcttgcccttggtgttcccactctgcagaacaaccttctctccaggtcaccactgatcgcaatcgcgctctcctttcaaggcccagatcaggtgtcacctgacctttgctgtcctcagatcacacctccctgtagcgactggctcgccagtgtccctctctgaccgagctgtgcactcctccagggcagcactgtcagggtctcccccagacccttggttgtgattctctctccttgtcctgaatctcagttttcctgatacatgggatgctacctgaaggcaggtttcaactttcaatctttttttttgttttttgggtgagatggagtcttgctctgttggtcaggctggagtgcagtagcgccatctcggcttactgcagcctccgcctcctgggttcaagggattctcgtgcttcagcctcctgagtagctgggaccacaggggcctaccaccacacctggctaatttttgtatttttagtagagacggggttttgccatgttgaccaggctggtatcaagctcctggcctcaagtgatccacccacctcagcctcccaaagtgttgggattacaggcgtgagccaccgctcctggcctggaggatttcagatttaaagcaaagaggatattttccaacaaagcaactgcttttcttttttctttttaaattttgtttatttatttttaataaagatgggatcttgcatcttgcccaggctggtctcaaacttctggcctcaagtgatctgcctgcctcagcctcccgaagtgctgggattacgggtgtgagctaccatgccctgtctctttttttgtttgttttttttccaaattgaaacagggtctcactatgttgcccaggctggattgaactcctggcctcaagcagtcctctcgccttggcctcccaaagtgttgagattagaggtgtgagccaccatacctggccctgtagaggggaggcattgatgaaggtcaagaagtcctgttagctctgccttcagaatctaccccaggtccttttagttctctccagcctcactgctggaaccctcacccaagccaccaccttgcagtccacacacggccactgggattggggcggcgttctccgcgcgaaatctggctgtgctcctcccccatgaggccctccaaaggcttcctcttcttaggatgaaacccacactgccagccgaagctcctcaggctcccaccctctacaagctccttctgctccagccacactcaccaggcccgagttcccacctagcaccttccctgggaatgatctccccctggttggctctttctacttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagttgcatgagggcagggatgtctgtttaatcccagtgctcaggatagtgtatggctcgtgatagatgcctagtacattttaaaatgagaacgaatgaagtttgggagaggctcagagcagtgagtctcccccttgttgggggactggggagtgcctgggaggggctatctggtgccagcggtttggagtggctgggatgactctggaatcctgtgaggcccagtcagtttctttggttctcatgcagtgcagtgccctcagacctaaccattttgttccgtgctggcttgaaagggtctgcctccctcccagtgcagcccctgcctctcctctttctcgccccccgccctcctccagagaaagcaggtggtgagggctctctaacccagacaggacttgctgttcagccccagcttgaaattgatttcctccagccctccttgagccaggccccgtgaacagaggaggggtctgagccaggcctcctaggccattggtgggagggagaatgagacagccatttggcccacaggccaccaacttttcccccccttctctaaaagacacacaatggcagttgggctgcacctttgtgagtcaccggtgatagcccatcataaattgttatttcctatatttccagagcagctttatcgggcgttgcctgtgcagtccgggaaccgatttggtatggggtcagttaacatgctgtcttgttgaaatctgtcatcatgcccatataaggcaaactccttggattactttttaccttggcagaatcacaggaatgtcaaggtaaccaggccacctcagcatagctctgattctcacccggtcacctgacttgcccgccctcccccatgactcacccagtggctcagcatggggcctgctgcactgtggctgctggaatctgccaaggacctcctgggactgcccttggttttgtgtcttccttagagtagatcaaatgagaggaaccatgtgaagtagctcacacagggcctaacagagcaaacacaagacgtggaaagcagacttggtgaggcttgagtttagtttgggggttgcgggggtcccagctctgctgcttaacagccctgtggccatgggtatatcccccagcattcagagccttatctgtaaaattagagcacgcagaacaaaccctggtacacactaagtgctcaataaatgtgagtcatttgtgtaattatagtagggtaggccttatgccccacccagtcataaaaatgcctcttgctgttgttggttcaggctcagccccttagtggctttcatggggcaggttgacatggtacccagagtcctcctcggtcctcttcccatggtgtagtgagagcactcaggaccacctaggcctttcctagaaaactgaacccacaccttcccagtgctgccccaccctggtcccccaccccctgcaggacaaaccactcctcccttgttttggggccaggagtcagatctgcccctgagagcagcaggggcccctttgtcctttgacgtcatacccacaccgctcctggagacagccaccccttcatgccagccccaggaaggcttgtaggtggggcgagccagggtgagagtgtagccctgttcctcggccagggcagatgtttcaccatttttaatggagcaattatgagtcagaggtttcagtctctactggttcctcccgatcctataattactctttggctatagaatcctattttgatctcttcttttcttttctcttctttctctctctgtggtcatggtcaggtttttctttttttaaatcctcccaagacactgctaatgttgtctgtctcatgcatccaaggaatctgagatggactgaatattgtcaagggaaaaaaaaagagacccccaaatccagagtgatttcttaacccacccaaatggctttttgtttgtttgtttgtttgtttgagacggaatctcgctctttagccagggtggaaggcagtggcgtgatctcagctcactgcaacctctgcctcctgggttcaagcgattctcctgcctcagactcccaagtagctgtgattacaggcacatgccaccaagcccagctaatttttgtatttttagtagagatagggtttcaccatgttgaccgggatggtctcgaactcctgacctcgtgatccacccaccttggcctcccaaagtgctaggattacaggtgtgagccaccgtgcttggccaacccacccaaattgtgtaccctacaccatcctagtgcttgggagccaacacccactcacaggaggctaagggcaagtttaggtaactcttaacaccacgaattagttgcctgctggcaaacttcaaactccaagcctgaaatttctggttggagtcacctcccagatggactcagggattcattcaccccctcatccagtgctcacggagcctctgtgaggtgcaggcctggagaggagccctgtggcctcagcaaagggcaggcaggctggtgagcacccaacctctggatcgaggggactcaattatgcggataaaggcccctaatcctctcagtgctccaaactcactctgcttctgaaagggatcttcgtaccctgggttcagagagtaggaagcccgcagggaccgagtatgcatgaaacaagcccaagtctgtgggggctgtacatggtcaagatcacagatttccagaccaagccagctccaccctagctgggatgcccaccctgagacacccctctctgctttcactggaataggatggccctgacttggccgggtggactgttgaatcagagcctctcaaaacaggaaaaaggaaaaggatcaccaagcaggagtttcagttgtcaaagacaaaacccttaccacgattaaagattactccagggcctcgcatattcacccttccaccagcagggcccagtttacggatcatttgaatactagcaaaaaaacaagccatctgctggagagattgaacagagggagaaacaggagtgtttgccctgcttccagacacccctttcctgtggcagttcctgcacctggcaagatctactggggaattcccggggtcccactagctcaggacgggtgtgtagcacttgcctaaataacaatcccatcagtgccctgtctgaccttttctccccaaatgccaaaggcctcttgtctggatgaacaaatccctgggcggatttgtccagactaaaacgttaattctaaagactgggccccttaggcactcgctaagattccaggccacactgtctcaaggccagaattggcttacttggctatctttttgaaagatcaaagtttaaaccagatgatctgtagtcccccacccccaccctgaaacctgagcttagctgtaagcattgaaagtaaatggggtgtttgtagctcaccctccctgttctccaggtgaagggccccgtgtgcctgatcatttcatagcaaaatgctagatggggccagaggaggccccagcctctgctgctgccctaattttaaaactgccttttgggagtgtaagtttcctctgttaaaggtagttatttcaaggtaggcctcaccatctcctcctcctggtgagaagctctgcctggagggctgagcactgcctcccgctctgtgggccccacctgccttgggttgagacctatctcttcctggactctgtgtggggagtgcaggctcttccccttggggagaacccagttctttgacgtataatctgagtggtttgggttggttggttggttggttggttggtttcccatgtgtgggatggctccggaagtctgtttgagaacagaggcaggctcagatgggagcagctcctaccccgggccgcctatccccctttaccctggggtttcttttagctccaagcatccattccagtctaacaaatctggtggcagagtctcttttttttttttttttgagacagagtctcactctgttgcccaggctggagtacagtggcacaatctcggctcactgcagcctccgcctcctgggctcaagcgattctcttgcctcagcctcctgagtatctgggattacaggcgtgtgccaccacgtctggctaatttttctgtattattagtagagacggctggtctctactaatagttcaagacggctggtcttgaactcctgacctcaaatgatccacctgcctcagcccccccaaagtgctgggattacaggcgtgagcccctgcacccagcccctctggttctactgagacctcagatctttcatttatggaacaagggggttggattagattgttcgctctcagccctcacttcatgttagactcactaggtggactttgtcaaatgtcattgcccagggcccaccttgagggaatctgtctcattttgcctgtggtgaaattcaggtatttttaaaaagctcccaggtcccatacatctattgtcaattgattttcaacaagggtgcaggaccattcaatgggggaaagaatagtgttttcaacaaatagtgcaggaacaactattaatagatacccatctgcaaagaatgaagttgaacctttacctcacaccatatacaaaaattaactccaaacggatcagatacctaaatgtaagagctaaaactgtaaaactcttagaagaaaacacaagtgtaaatctcatgaccttgggttaggcaatggttattagatatgacagcagaaacacaaccgaagaaaaatagataaatcagactgtttcaaaactggaaactttttgcttcaaaggacactattaaagtaaaaggacaacccgcagaatatttacaaattgtatatctgataagggtctactgtccaaaatgtataaaggactcttaaattcaacagtaaaaagacacaccagttaaaaatgggcaaaggattcaaatagacacttctccaaagaagatctacaaatggtcaataagcacatgaaaaggtgttcgatgtcattactaattagggcaaatcaaaaccataaccactacaaatggtcaataagcacatgaaaaggtgttcaatgtcattactaattagggcaaatcaaaaccataacgtggttgggcctggtggctcatgtccataattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctaccaaaaaaaaaaaaaaaaaaaaacccacaaaaattagctggacatggtggtgggcgcctgttgtcccagctagtggggaggctgaggtgggagaatcgcttgaacctgggtgggagaggttgcattgagccgagatcacgccattgcactccagcctgggcaacagggtgagaccctgtctctaaataataataaaaatgagaaattggccaggtgtagtagcatattcctgggaggctgaggtgggcagattgcttgagcccaggagttcaaggctgcagtgagctatgatgacaccactgtactccagcctgggcaacagagtaagaccccaaccctaaaacaaaaaaaaacagaaaaccacaatgagataccactgcacacccaccatgatggctataatcagaaagtcagataataagtattgactaggatgggagaaatcagaaccctcacattgctggtcaaagtgtaatgtggtgcagcttcttgggaaaacagtctggcagttcctcaaaatttaaacatgttttgtatttttagtagagacggggtttcaccatgtcacccaggctggtcttgtctcagcctcccaaagtgttggaattacaggcatgagccaccacgcccagccaagttcctcaaatttttaaatataagaggtatcatatgactcagcaattttactcctaggtatatgcccaaggcagttgaaaacatgtccacataaaacttgtacatgaatattcacggtggtgctaatatccaaaagatagaagcaacacaaataatgcccatcagccaatgaattgataaataaaatgtggtatatccatacaatggaatgttattcagacaggaacgaagtactggtacatgctacaacatggctgaaccttgaaaacatgctaaggagaagccaaactcaaagatcatataccatatggttccacttatatgaaatgcccagaataggtaaattgcaagagacgaaagaaaggtaggttagtggttgccaggggctgggggctgggtaggagggaagtggggttggagagtaactgtaccagttttgcggtggtagacatgttccttgtatttttggttttttgttttgttttgttgttttgagataaggtctcactgtcgcccaggctagagtgcagtggcgctgtcatagctcactgtagcctcgaattcccaggcttaagtgttcctcccacctcagccttctgagtagctgggactacaggcaagagtcaccatacccagttaatttttaattttttttttctttttctttgagatggagtctcgctctgttgcccaggctggagtgcagtggcgcgatcttggctcattgcaacctttgcctcccgggttcaagcgattctcctgcctcagtctcctgagtagctggaactacaggcgtgcgccaccatgcccggctactttttgtattattagttagagacgaggtttcaccatgttggccatgagagacaggactagctggatttcctaggccgactaagaattgctaagcctagctggggaaggtgatcgcacccacctttaaacaccgggcttgtaactcagctcacacctgaccaatcaggcagtaaagagggctcattaaaataccaattaggttaaaagcaggaggtaaagaaatagtcaaatcatctatcatctgagagcacaggaggagggacaatgattgggatataaaccccaggcatttgaggcgggagtgggccaccccctttggttcccctcccactgtatggaagctctgttttcactctattaaatcttgcaactgcacactcttctggtccacgtttgttttggcttgagctgagctttcgctcaccatccttcactgctgttcaccgccatcacagacccactgttgacttccacccctccggatccagcagggtgtctgctgcatttctgatccagcgaggcgcccattgctgctcattcgggctagaggctcgccattgttcctgtgcggctcagtgctcgagtttgtcctaatcgagctaaacactagtcgctgggttccatggttctcttccatgacccacggcttctaatagagctataacactcactgcatggcccaaggttcaattccttggaatccgtgaggccaagaatgttaggtcagagaacaaaaggcttgctgccatcttgggagcagccactaccaacttgggagctctaagaacaaagacccaccggtaacagccaggctggtcttgaactcctgacctcgtgatctgcccgccttggcctcccaaagtgctgggattacaggcgtgagccaccttgcctagccttgttctggaattagtggtgattgttgcacgatcttgtgaatatactaaaactccctgaattttatgtaaaagggtgaattttttggtatgttatgtgaattacatttcaatttttaaaaattgattctccaaattatgtacatatttaaagagtacatgaaagagagggagagaaagaaaagctggatgcgagatgccgcaacctgattccactcactcctagatttgttgagtacctgctatgtgaaaggtaccagtccaggcagtgggttcccacagcaaacagaaccctcctctggggagcttatgctgcacttgggagggagactggttatgaacaaagaacatagtttttgatgatgaaaagtgcagtgagtaaaacaatgcagtgtgaggccgggtgtgttggctcacgcctgtaattccagcactttgggaggccgaggtgggcggatcacctgaggttgggagttcgagactagcctgaccaacatggagaaactccgtctctactaaaaataaaaaattagccaggcctgtaatcccagctactcgggaggctgaggccagagaatagcttgaactcaggaggcagaagttgcgttgagctgagatcatgccattgcactccagcctgggcaacaaaagtgaaactccgtctcaaaaaaaaaaaaacaaaaaaaacaaaaaaaaaaacccaacaacgcagagtggagtgatagcctaggggagatgacagagtccaggaaggcctcctgggttgctgacatttgaggcaagtcctgagtgatgagacaaaaccagctctataaagagctagacgaaagtcttagaccagtatttctcatgaggaggagacagcactccaaaatccatcctttggcctggcgcggtggctcacgcctgtaatcccagcactttgggaggctgaggcgggtggattacctgagatcaggagttcgagaccagcctggccaacatggcagaaacccgtctctactgaaaatataaaaattagccgggtgtgatggtgggtgcctgtaatgccagctactcgggaggctgaggcaggagaatcacttgaacccgggaggtggaggctgcagtgagccgagatcatgccaccgcactccaacctggcgacacagcgagactctgtctcaaaacaaacaaacaaacaaaatccgtcctttgcagcagcaacacgcacgctttctggcacctcaaaggggattgtccaagactggaacactggctgcagggagggggccgggtgcaaagagctggtttctgggtggacacgcaggacctttggaatgctcgctaccccactcagcagtatttatacctcttctccaactgcgaagtcagagctttttcatgcaggctgagaaaactccgaataaggcaacttcaggccaggacataagacgcattccatatttcactgtaattgctttcaaattaggttatgtcgtcatgtaacaggcacacacagtgcacttgctttgcccctggctggggttgggtcctggacaggctgccccgtgtgtcgctgaactgccgcagtgctagccctgattgcctgggcagtagggctgtctgcgtcccacgttgctgcacccatctaatttgtggctgtgttattgtgacctgctcgttttctgttctttcaacctgcttcctggcttttatctccttcagaatctggtggcagtggatcttcaaaaagtgctcaggtgtgcagtctcacaggccagaggctccacgggcccccttgccagggcgagcatctctgcctgtgccgctggtaacccagattccagaaggcttagccgtctggccctgaaagcgcctttatagttggtgatgaagcccatgggctggggagccgtttctgctttcaggaactgaaaagatgccccagtggggctaggccttgcctgaggtctggcaatagcctgccagatgggtgataagaaggcctacccaggtgataagcctacccaggaataaatagctgtacctcccctgtgtccaagccctggacacccttccctaggacccatggaagcaggaaccatgggcagcgtcagaggccacagcaggcaaggtggaagttcaggaggtgggacggcgccctccccctcaaagcaactgatgccccagcggagcgacaaaccctacacggtatttcagagccaaggtttgaaaactcccagggtgctagggagctccgtctggcctccgggtacctggggttggggctggctgtggccagttgcagtcaaccctgagcctgggcaaaatgcatgcaggctggtcctcctgggtgatatcctgctaggcgggtgggcagtgtacacggcagaagagggttgcggcatgaggcagcaaacgtttttttctaaaatcttgtcaagcgtggggtccgtggaatccacatgtgagcatcagcctggtgggtggggagagtgaagcctgcgatccagtctggatcatgtgctacacagtgcagagccggcatgctcacccctcctgagggatcgctcgagcctatttctaggcccaaagcgactttgcaagagactccctttattctgggcttagtggaattccagcttccaacagccatttccctccacccccttcagttctgagaacatgttttgtaacaggaaggcaggaagaaaagagaaggcgagtttgttcagctgggtcagccgcatcccaccaaggccctttcttccctccagctcaccatcgctctgcccactggaaccactcggttgccctgtgtctgccgaatgtttgtttcttaatcagcgccccagagtagagagggctttgcctcttcgggttgagggagggaatcattgatgaatggctcattaaagcccactgctgccacattcctgggtgcttaggtcacctcctgaacaatatccatcattcattcacctaccgccccacatcctggcggctgggaggggtccctgtgacgcaggaaggactttatgaccagagatgctaggtctccgtctccctcctgcagcccacagtgacaaagcagaaactgctcttggggccccctgaagcccgccttagctgggtcaccatgggccttggcacacggaggggtgacagtggatcccaactcaactgacaagcttgcctttctctgttcttccaccccccttccccgcactcacaccctgtgctattttagcaaccagagaagcctctttaataggctgcccgtgtgcaggggcaagctctgaagcctcctctctgtggtttggttcacatgtgttctcaaagacagatgagtccacatccttccttcctccctagataggtcaagggctgggtgcaggctgccttcacaggagggccagggacaggctgggaggagcggggccaccttttgcgaagcgggtgatctgctggggcgttgctctgcctgcctgccttgttctctgagtttacctctagcttggggaccaagggtgggctggggccttctttttttttttttgaaaccgagtcttactctgtctcccaggctggagtgcagtggcgcgatcttggctcactgcaacctctacctcccaggttcaagcgattctcctgtctcagcttcccgagtagctgggtttataggagcccgccaccacgcccaggtaatttttgtatttttagtagagacgaggtttcaccatgttggccaggctggtcttgaactcctgacctcaagtgatccgcccgcctcggcctcccaaagtgctgggattacaggtgcgagccactgcgcccggccctggctgggggcttcttgacctgactctgctgtctctccctcactggccagcacctcccattctactcagacatcgtggaatgaatgcccaccccgtgtttgtatgtatcatctgtgtctgtgtgacattaagcaagtcactgaacctctccctgcctcagtttcctcatcaaatggagatatatcgcatgtgatcatggggttggaggttttaaagagttgctaatgtgtaaatagtaagaactagcaattagccgttatagcataattacctttaatatgtcatgccccccgcacccccgtgctgaatgtaattttgcgggggggcgggttgagacagggtctggctctgtcaccgaggctggagtgcactaacacaatctcagcttactgcaacctctgcctctcaggcacaagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctcggcctcctaaagtgctgggattacatggtgtgtgccaccatgcctggctggccagaatgtaaatgataactgttttgcttcctcctgtgtccagtacataatagggctccaagtcagtatttgtgaggcaggtgcatgcctcttagttgcggtcctgagggcatggccactgccacgttctggacagtcagagtcgctgctgcccctggaagatgaccgcgatcatgaagcccaggagagctcgatgctttttgcctttccctcctcccacagagggctggcagctctggttcctcccaaatgaaatagaaaccttgagtttgcatttcttctttggcgtgccggcagggcacctctgccttcctcttcctgccagggggaggaagtttctctcaggggctcttcaccctgctttattcctggccatcacacattgacccttgtccccttcggctctttccctgcatggcagggacagcatgaccgtttaatggctttgtgaggccagcatgccagcctcacttctttactcccttccttctcggagtgggctctgtcccttctgcaggagggctttggcacatgctcttcccagtatctggaaggtctccctcatttttatcttattaactcctcatccttcagctcagagtttgagaatgacttcttcaaggacacctttctgtgtctgcctcaccagtcgcttggtgcccccccaccccgccaccatgctgaccgcactcttcagctcccatcccaggggaggtgacacaaactcggccccaggagcccagcacctggctttaaacccagctctgtaactttctaggtgtgtgactgatgggagcaagccacttcacctctcaggccctccgtttcctcatctgcaaaatggaggcagtactagcacctccctccagagatgattacgagggtgacagaattagtaagtgaccaagtgcctcgagcagtgcccgcccctagtagactctatggaagtgtctgctgcagttattgctgttattattaccacttttcctaagggcgttatttctggagtggactgatcgcttgattaatgagatcagacctggagcctcatgagagtgtctgcttttgctcactgttatggattcagcacagggcctggccctctgctgacccccagcatatgcttgtccagagaatgaatatgtacggacccatggtggcctggggcatcatgaggtcggctgcccacattctgagaattttgcatggtggagggcggcgtggtgggcgcatagggcccccatctatagaaaccacctctccacaccatccaccccacgcagcgtagtctaaaccgggtagggagaggaaggatggaagcagagtgttatttttgtaaccaagtagaagaagcgatgaatttttaatgtcccattcgaactccagctcctactcaccagtctctccgcatggagaagtggccgtcatggtcgacctgttcccaagggtggccttgtgagtgcaggctctcctcaccagagctgagggctttgtgaacctctgatgtcaatagatgcccctcatcttccaggaggacaaaacagggcaaagcaagacatggggtgagaacaggagtgcatcagtggggttccccaagcctgtgtcaggtccggatctgggtgggagttcccttctgcgtcatccaggccaggcgagtgggcatcctccctgagcacctgtgcttggggctttgcctgtgtcagtcaggaagacagagtacacggaagagttaccattgctttcagagcaaaccttcctttgacatgcatttaacacagcacggagtgattgacatgtgtccttgtgtttaatccctatcttaacctctcggttactgtcctgtttatcagtgaggaaactgaggcttattgcttgcctgaggcctcagtggcagaagcaagatgtgaatccgcacctgtgtgatgcccaagccagagctcttgtttactacccagagaagatgagcacaggtgggatgtacgtatggagggcgggtagggcagcagcccctctgaggacaggtggccagaacccaagcggcgaggtttgttcacagcctccacagggtggggtggggccatccgcagagggtctcctgccatcccattttccctgcataccagtgggtggtctgagagcctttgcagagaagagactggatctcagcacgtgcttatgtgcgtgtgtacatgcacacacatgcgtgtgattcatctggctcttactttatgccaaggagcctgtcacatgctttaaatgtattttccctagtttaattcttagagcacactgcaggaggtagattctgataaatccatcttacagggaaggaaacagacttaagtaggtaaagtcacttggttgaaaacatggaatgagtaagccaaggggcaggtattcaaacccaaacccaggtctgtgcccctgcagagcctgcaggagcagcccacacaggccaaggctgtgaggggtgctgtttgcacgcgtgcgtggccctccctgcagcccaggtgcctaggtctgggcctggcaacaccagagcacggggccttgccctcggggaacagccctcttttgtcctcaggctgtgggatgtgtcttggctactttgctgcccagcagtgcctgctctcaggcacatgtgagagtagaggcctagcatccgtggccacttccttcccagcccatttgctgctgccctttgctctgcagggctgctgggctcctgggctccacgcctgcttgctgcctgccatcaaggctggcagtgctctggggctgtaaaggtgcaggcgccgtacttcccaacccctggagctcgcacatggtaggagagaaagctcatgtgcatgcaacatccaataagactaaaagtgactgggggttgctacgggagaggtgctgagggtgggccggggacagagcaggcacactgtggagggggtgggcaggactcctgagaccagggcagggagggaggagatgctgggaggcacagggccatccagagagctgccacttcctgagcattgccatgcacgctgcaggcatggccatcttgagtcctcacactgcccgtggcctaggtggggtcttcatccccacgttgcagaggaggaaatggaagttaggaaggttaggtgacgtgcccacatgagtggtgtaagcatggttcccgccctgggctctctgaattcagtattgtatgggggaggctgggaaggtgagttagtactctccgcagtgagaacctgccttggctcccctcccctcaaggagttcatagccgtgggagggagggagacaagaactgttggagacaagaactgttagagaccagagagcaagggcgtgatgtggtctgcagggaggaggctgtctgaggcagaaccgggtcagggaggccatggtgcgggtaccctccaggcacggcatttggcctgacttttgaggggtgcccagggttggctacatggcggggcggaggtatctttagtgggggaacagcgttgtgccaccaggaggggtctctgtctcccaggtagaggaattctccatggtgagaggtggtggtgggggatggtctagctgtccactcttgccccctttcggatttggaaggaagccccatgctgggtccacactggtatggcgtattaattaggcagctgctttgtctgggagggggctttgtgtcgagtctccctgaatgagcagggctggcgacagttgtcaaaacacatggtgcttggtcagagcccccgtagaagccccttgtcctccgcatggcctccgcctgcacccggggcgtggaatgtgctcttgtgtgtccctggctgtctgcttgcttctacactggcccctgcagatggagggggtggggtacaggggttcctataagaagcagacacttggggtttttcccaggtcctgttgcaggagggtgcgtgggctggtttccctgaaggcgcctgggcgtgttggtgttaactgatctgagatcttctgtggccctgatgtctatgagcatgccccagcttgcagggggctgagtagccgggcaccaccaggaggctgcgtgccctgtgcttgggtgtacccatgccctgtcagcatcgttggtctgttagggtcagggacttcggcttcttgtttagtaccctccatcccttccagttgatcatcagaaacattctccttagatgcggctgcctgaccccggtgagggggcctgcctcccacttgccttccagcctcctctaagctgcactgagtcttaaaaataggaaggatagggctgggtgtggtggctcacgcctgtaatcccagcagtttgggagaccgaggcgggtagatcacttgaggccaggagttcaagaccagcctggccaacatggtaaaaccccatctctactaaaaagacaaaaattagatgggcatgttggcatacacccgtagtcccagctactcaggaggctgaggcatgagaatcgcttgaacccaggaggtagagattgcagtgagctgagattgcgccacagcactccagcctgggtgacagagcgagactccttctcaaaaaaaaaaaaaggaaaaaaaagaataggaaggatagggcatggcatgttctccaggagacagagggacgggggcatcttgcttgcaggaagccaggcgacacaggcgtgtgtgcagggctcagagggtctgtgttcctggcctttcctgggagggcttgctcttgggctgcccaaagctcaaagagagactcgaggaaatcctgcatttatgggagcttttcttttcctgccactttcctgttctgggttgtatctgtgcacgtgattggaacgtagcagcctgagctcctgcctgaggagagcagccacgggtcacggaagccagggtccagctggggcctttgggtctagctggcagatgaagggctggccttcatcaagaaaacaagccccatgagggcaggagcccgacctgttcattccacaccaccgagcctggtgctcagtcatgtttgtgtgactgagtgagccggcggcgggctgaggcgcttttgtctggtgtgcgtactggtctcccttgaggcagcttgggggtgtggaaaaagcacatgttgccaaaattgacagacctgggttcaaatccaagctctgccacttaccgcctggatggtcttgtgatgggtcattaaccaccccgagcctcagtttcctcacatctgcctcccggggtcactgtaaggatcagaaacaatgtgtgtatcggccatgtacggtgtgtgtcggcgagtgctccgtggcagctgcggttctcctgaggtcagagctgcggccctgcaggtgtgtggagagagccccgacagccaggctgactctgcgcactgtcctttgttctgcttccccagaccttcacggcatggtgcaactcccacctgcggaaggcaggcacacagatcgagaacattgatgaggacttccgagacgggctcaagctcatgctgctcctggaggtcatatcaggtgagactcccagccacgcagtgcggccgagccctggcacaggtgctctgccacagcggtccccagagaccctgcccacccagctgtcccattgctcctggggaggagagggcaccccttaatagctgcacggtggtctgatgggtggggccagagtggcctggtgggccagcagaggaacctgcttttggagaacagaggagactctaaagcctctctccctctcgccctctctccctttctctctctctgtctcgccccctcttttctctttgtgcacttctcaggggagcggttacctaagccggagcgggggaagatgagagtgcacaaaatcaacaatgtgaacaaagcgctggactttattgccagcaaaggcgtcaagctggtctccatcggggcagaaggtgagctggaggtggggcagcgagggtcctgctcggtttctgacctttaggctctgaagcacaacatctgcatcctgaagagaagttttgttggtggcagggcgcttggggcactcagagccccagtacatactcagcagtgatcacaacaactgctcttgatatgatgctgggcccacaagctcccccaaacccttggaaaaatccggtgggcgcagtccaaatctaggaagtgcaacccacccaaccacgggggcgacggcttctgcagggggaggaatggttttgactcggactcaggtcgccctcactggttctccttgtgccaggctcagcagacagtgacaaacatgtgccatggcctctctctgtaccaggaacacctttctcattatgccctgcccggtatcagagaaggactggaggccccatgtcaggcattgggacagggagtgcacggccaaaggtcagtgcctagactttgccctgtgtgcatgggcttggagaattttgcctctgaccaccccaggatcctcctgggccccacgtagataaccaggaccacagtccactacctgcaggccctcactagagcagcaggctctcagcaggggcccctgggttgagctcccaggcgcttttagagacaggcgaggcctgatggagccccagcagcatgagctcgcagtccactcattagtcagagtaagatttcttcaccctgacatccatgttgtcccagcttctagaaaaacaaagtaaactaattgccgttaatgacagggctctgagagtttggccaagactccgggccagaatgtgtgtgctgagttccaaggctctgccccggcccaggacctctgcgatgaggggtgccaagccttgcatgccacagtcgaggtggttggtgtttgtttaaaaaaatcacaacccaaaaattcagtcaggccctgagattttctgtccttgcatgggtctttcctccaggctctgttccagccttctgcttctcacagctgcatttattttgctcaaatgctagtctgtaaatacagaaggggttagaggagagacccatgtcagtcatcagttttcatttggagaaaaacttggtctaaaaatgttctctgttcatgcccaaattggttcactcccaatccctgtgactgtggggccttggaacaaagcctaatggaggcgttcctggggctcaaggcacctgagaaccccgccccaccctgtccccctgtccttccacatgattgggcattcgcgggagcattggcttcccgtgggggtgatgagaggggccggaggcacagctgcaggtcagagaagcagctggtggatgtgtcatgagaaacgccatcctcctctcctcaccggaactccataagccctccgttaccagctgcacctgtacttgctgagccggggagctgcggccttgcccagctctgcaggcccggccctcaggaggtgcacagaatagatttcctgaggctcgagctgcctcgctgcactaaggggcaggtggtgctgctcagtttctgggtctggggctctgaaccctaggacagggtggacactgggtccctcccctgtctctgggcagcagaatgagcatatttcctcctctcaaaacccgaaagctgtggctcatggacacccccttcctctgggtgtgtccccgggggaaggtgagccccatcttctctgtgacctctccacctgcttccaagcaagcctgccctggagtattctgctcagaggtcagtgagcagggtctcctgtggtgtcctgggcctccagctctgcagttagctttggaactcacccctgtgcccagcccttccccgagagtgcttgcagcagtggcgcccctctgtcttctttggaagccactccatcatgccccttgcatatggcgtgttgacaagttgggaggactgccctaggcacggctggctgatggactctgggatgaggcactgccttctctcacccagccgcagacacacagctgtcctgggccttgcagagatgatttttctcttaagttactgaggctgaagaaggtgtggtccaagcccttcttttgagaagtttcagcaatttttttttttttttttttgagatggaatctcactcttgtcacctaggctggagtgcaatggtgcaatctcagctcactgcaacctctgcctcccgggctcaagcaattctcctgcctcagcctccagagtagctgggattacaagcacccgccaccacgccaggctaattttgtgtttttagtagagacggggcttcaccatcttggccgggctggtctcgaactcctgacctcaggcgatccacacctgcctcagcctcccaaattgctgggactaaacaggcgtgagccaccacagccggccgcaaatgtttgtttttaggttagttcagaaagcgtgcagtctggcctcaggcccgtgctctccccttcctgacaacacagcagccatgcttgttcctcactggccttccaggcactggatccagtggtggtcagagcagccccgccctcacgagggcaggcagacagtgaacaagtaaacagcccgaccaacatgtgatttcactagtgatgccttggggcagcacaggggccagggagaggaactgggtggcgggttggggagctccttgggacgggcagtcagggaagccaccacgagaggtgacacaagcagaagcttacacgatgagaaggaccagccagttgagggtcgcaggctaggggcgtgctttgtgagtggacagagcgtatcaaagcaagaaagagcctggcttgcccagaggatgcagctagagaattccagcaggatggcagggcctgggccttcagggcaagccctttccctgtgggccaggcatggtggctcacacctgcaatcccagcactttgggaggccaaggcaggaagatcacttgagcaggagtttgagaccagcttgggtaacataataagacccagcctctacaaaaagtttaaaaactagcaagatgttgtggcatgcgtctgtggtcccagctactcgggagactgaggcagaaggattgcttgagcccaggcagtcaaggctgcagtgagctatgactacaccattgcactccagccagccagaccctgtctcaaaagaaggaaaccaaccatgctcgctgctgtgtcgatgtggattatgggcgggaagggtacataggaggcagccgcattgagctctggagatgacagtggcttggtggagagtgtcggcagtaggattggaaggaagtggacagattcacaataaacaataatgtagtgcacatttgctgactgcgagatgaaaaagaccacctttgccctgagagtgggggcccggggtgcccccctgtagtcaggaggtacgcagattacggcagaaatgtacagagcactgagagttgagagaggtgtgaacagaggccacacgcctgggaccagcctcttggaggagcggttttttgagttgggtcaggagaaggagctggctgcggggccagggacccttgtggccagaagcctgcaggcgctcagcagcaggaggctctgggacagtgctgcctagagactgttccctgcattttctcctgagggaggtggaggaggacaggcctgggagatgcaaccagggggtggtttggagcctttctctagatggggctggaaggccaccttcaggttgggcggaggagcctcactctggttttaacgaccttctgccctctgcccccttccctgtgtgcagagattgtggacggcaacgcaaagatgaccctgggaatgatctggaccatcatccttaggttcgccatccaggacatctccgtggaaggtgacagccacctgtactgcccccgcttcccacctgagtcagggcgggttagaggagagctgaagtgtgatcttcatgcttcaagcctcttcctgtttccttggggtcactcacagggcctggcccttgcaggggtagtcagtgggtggcaggtgaagggaggctcctcccagctgcctgcctcttggctccagtgccttccgagtgcctttgctctcacagcctcatctcagtggaccctcacgccaccctcatgagatgggctaggatggctgggcccgttttacagtccaggaacccaagtcccagaacagactagtgagagagttgggcctgggcctggttctctgtctgcttgacatccccatccttgaaacttggcccccatggacccgttatgagctcaggccgtccaggaatggacaatttcgcttccctgcaagcacctgtgtgcacacaggatgggcagagccacctgggctagcgtgcaggggctcccaggtgccaggtcgcagtgatgactgggagagatgtgcttcctgccctcgaagggctcccggtctgtgaggacagccgagctatccacggggaacagaagggccccctaggcctctctacagctggtatttcaccttgttcaaaagaggccaaggccggtatcaagggcctgtctgcagtgtgttctggtggtgaaaggcacaggcttggtggccaggcacatggcacagattcaggccctgacaccaccacctcctggggcagccctggtcaagcgactctcctcggggccgtgaggattaagcagggccgtgtgtcctggcagttgggcctggcagcatccgtctgcatccggaatgggagtggctgtcccgctgctatcactgctgctgttgttaggacagatatcctctccccttgggtttcgtttgaccccaggcctgagccgaaagtcccatccaacttgggctgagttctgagggtttatttttgagccagtgctcactgtctttgtgtgttttgcagagacctcggccaaggaagggctccttctctggtgccagagaaagacagccccgtataagaacgtcaatgtgcagaacttccacatcaggtaagcgccagtcctggtcatcctctcctttcctctaggaacctgagatccttcctcccacctgccctgtttgctgtgtttttgtcgtggtctgtgagatgccagccctcagtcagcccctccctggccacgggccctacaagcccatgggaaggtcacctggtcctctctgaggaagaggaggcagtttcccagccatcctggctgaaggcagtaaggtcagccctctcgccggcctaatagaacgttcttcgtccccaggcaaggtgactctcagaagcaacaataaagcttttcatttttgagacagggtcttgtgctgtcacccagactggagggcagtggtgtgatcactcatccctgctgccttggcctaggctcaagtgatcctcctgtctcagcctcccaagtagctgggactgcaggtgcatgcagccacacctggctaatttttaatttttatttttagtaggaacagggtctccctatgttgcccaggctggacttgaactcctgagctcaagcagtcctcctaccccggcctcccaaagtgctgggactacagatgtgagccactgcctgcctctggcctcttcctttattttgacagctcaggagtgaattgtttttagaattgctagtaaatttagtgttggggaaaaatgtactctgtggctgctaagatgaacaagcctcagctccaccatgaacctgcttccctcagggtgagcgggagatgagacatgtccaccatccccgtagctgaggcgagcatgggcactgccgcatgaggtccagggggcggcaagaggcaggcctgcctggtggttgggagcactggctctgggggcggtcctgaggtcagatccggtttgccttgtggctccaccctctgagtctcctggatggcccgcacaggaatgaagagcagggcctcatggggtttgcagcggcctcaggctctctgggacccttgctgggtacagagggcttttcccatcgtgctcaccctgatagcatgtggtccctcccttggtcactcttctctgtgtgtcttcttttttttcctgccactaactgactgaatctttctatagtttccattcattttcttcaactagtaagtatctagcatgcccgctgcatgccgttagtggagatacagtggcacccaaacaaagttcccatttgtgggaagtttacaccacagcgcggggaccagctgttagcacagcggccagtaatcctgcagcataacttcagtgagaagtgctgcacaaagacagggaagtcagatgaagaaagttccctgggtggcctttctgaggaggtgacatcgagcttgacctcagagggaaccaacccttagagggtctcagggaggagaatgtgacccatatagcttgtaactgaccaacttgtggccttggggaaggtctctttcctccagagaccagcatgccaagtgaaatcctggcatttagccagcccacggactggccttcctgtaagtcaggtccgccagggtgtggaggccacacagcacaaacaccagcatcctgcagtggccacctcccccgaagcggcctgtctggttcagggcggcctcccatggaaggtgctagcagttataaagcagttgtcaggagtcaggcactgatccaagcatttactcatttaatccgcacaacagccctatgtagcaggtatgtcactatccccatcatacagatgtggaaaccgagatagcctggcttacccgaggtcacactgtcagtaggcagaagagtcaggatttgatcacagactgcctggccccagaggtcatgcttgcagcctctctgccacactgtctccatgcagtgcctggcacaggccagactgcagtgaatgggaattagtcactgctgtgggtgcacagggccatacggcactctcatgacagtgagcgggccctcctataacctttgcctttccttccccagctggaaggatggtcttgccttcaatgccctgatccaccggcacagaccagagctgattgagtatgacaagctgaggaaggtgagtgtctccagctccccttgatggcccacagacgtgccctgtctgaccccctaactccgggtcaccatccccatgcccttccatcgccagcctccagatctgggttctgcacgcagatgggcagcctgggagagccttgtgcaggctctccgcaacccctggctcggtggctgactctcacctcccttattcccctcgtggactgtccagtctccctccatggcactgcaaccaacccggggttatttaagggcctggccagccatgctttataactccccttcctcaatcttctggattctagaacctcctctgcccaaaggggcagagggcaaggaattccaaaccatcaccacaagcccatgttgcccatgcagggtcctgctgtcatttgcctgtacaaagcctgtatggatccaggccctggccaccagaagctgccagcctcgtgggggaaggcaggacaaaaattgtgtccaaagcaaagcaccacaccaggccgtgtacatgtgctcaggctgaatggggtggcagggcatggggtcagatcagtgctgcggaggaggctagtgtaccccgagcgagcaggagccaggaaaggtcccggaagaagaggcagcttagagccagaggagggcttcctgggggaggcaccagatggcacccagcccgttccagccacagtgagcaagagagctgggccccggccagggagagttggagtgcagtgggctttagtcctgtaagcagtggggagcctgtgagggggctgggggacactttagggtggttgggacctgggacctctcggtttgctccccttacccagtccccagtgctctctcaggcctggcccacatcttccagtcaatgtgaaaaccaggttttagggcaaggggcttaagctagggtctgtgggtggctggaaattgtatgaaaagagtacacctgcatttttctggagaaaaagccctggtttgccccacaaagatttcacgaggcactcctgtgagtgggaattgaatttatccaggcggtgccctcccgctcacacatcacacgtggctgagaactgcctgaagaaacccccaaccctcgccctcccgggtctctccctctgggccagccctgcctccctcctgctcctgcaccctgccctgacggagttcttgttgtccccacttgcctccttctaggacgaccctgtcaccaacctgaacaatgccttcgaagtggctgagaaatacctcgacatccccaagatgctggatgcagagggtaagtcatctcttctgttcagccaccactgtgcttcctgatggccttttctgtccagggctggcctcgggcaaggggctgtgggcacatcagagctttgggtcaccttggggagctggcagagccagcaagaagggctgaatgattctgggtgaactggggacagccatgtcgccctgggagacagagcaagggtagcctgggctggccagatgccttcagggatgaagaagcgtatggggagggggagctgaaggatcaactctcctgagggtgcatctcctcagggcccaggaagggcaaggtggctgaggaggggtgcttcaggcttcctgcgagcaaccctggcctctccctccctacctgcagcaggcatggagtatggagcccgacaaagtggagtgttttgttttttccttttccggctttgctccatttcccagccatgcactgccccatttcctagccatgcactgccccagctgggacctgtgtctctggcctctggtggcccttggagttgactgtcctgctgctccttgaggccattctcagagagaggaagtggcctcattttaatccgcttcccacagccttgtcctttccagacccatgggagagggaggggctgagggtgtggctgagcccacccaagtcacgcgtcactctgcaggtccctctcccccaaggccgtggccttgggagcccgtggatcccagtgagtgacgcctccaccccccgccctactcgggcagtttaacccttgttgttcacttgcagacatcgtgaacacggcccggcccgacgagaaggccataatgacctatgtgtccagcttctaccatgccttttcaggagcgcagaaggtaccgagcagggccaggcaggccctcctcgccgccaccgcgcaatgccgccgctgcctctcgcctcccgtgctcacctcatttctcttgcagacggcagtggcctctctccaactggaagccacccccagctccctggcgttgctgccccctcagccttagctcacacacctattgggtacctcatctgtgccaggcttttccaggcattgaggatgccctggtgactgagtcagacaaggtccctgttctcagggcacttccatgctagtgggagaaacatacagcaggcctgtcacaggagtggaatagagaaaatggggccagatgggggacagagatggctggggtgaccttcagctggtgctgtcaatgtggaggggtgaagtgagcaggtacttgcagcaggagctgctagatgcaggctggggcacaggtgttccaggcagagggtgaagcactacgaaggccctgagacaggaagaagcttggcgtattcagggaccagctagagaggagtgagtgacacgcagtgatgggtcaggcccaacaagacccttgtggtgtgggataagaaattcatgttccactctgagggccatgggagccccttagggtcttactccgtggtgggagctgctcactcacattttcagacagatcatttagcaactgactcctccaacccaaaacaaagctgcctttatagggcccacagctagtctgtctccagcccaggccggttagaaaaggaatgcaccctattcggactccacaaaaccccgcaaggcatgtccacgcaggcctggggctggcttccagtccagagcaagtgctcttcctcctgcatgagcctcaggccggcccggccgccctccctgcgtctttcactctctcctgcctctctctctctttctctctctctctgtgcagatattgtgggcactctgaggccagatgagaaggccatcatgacttacgtgtcctgcttctaccacgctttctcgggggctcagaaggtgagctgggccaggcacacctcgctgctggggctgcagacctgccttcaccaccgcccttgcatcaccgctggccatctgtggttggagccctggccaggccgtgggccgccacaccacacagactgaccctgccggcctctgactcggaaggtcccctggggcaggtttcccgcctggccggtgctgggcctgtgctgaggagtcacagacctctgtttgaacacagcccaccctgggaggtgggtggtggcatcctaggctctcaggcggggaaactgaagccctgcattacagtcaatggcagagctgggatttgactgcccggcgttcccactcgccctgtccatcatctgcaccagggctgcctgcctgcccctgccaagcccttcgtggggagcactgggctttacccgttttgcagctccttcctgccaggaaaggctcagcatgtgcagcccaacctgcactcacggtcccagccctccagaggccaggcagagcccacagagcttgcgtggcagtggccgccctcctgggcccagctgacctcatgctgcctcacagctcctgccgggccctcagcgttcacgcagaggcccaagcactgctccccccgcttgccttgtggtctctgaagtatctcaggcagcattcccgatgcctgctttgaagtgtcagcagttggcacaggttcagaggaggaggcagaatcgattcttgtttactgaacatgtactacacgctaggcaccctccaaggccttcacatgcacaggcttccagagggtccctgtgcacacccccaggagggctaggcgcagttagccccatttgagagaggaggaattgaagtttagggaaacagctattcctaaaactagaaggggggggccgtaccttctgtggacccctgctttgagcctcccaactagcaggtgcattacctaccgtcagtctggcctggccccactctgccacctcttggtactgtgaccttgggtgggtcacttgacctcagcttccccacctgtgaaatgggcatcgctgtagttcggtctcacaggattgttctgggcgtgaaacgagctcctgcaggcaaagggcttagcacagtgcctggcacggcagctgccatttaggcagctgccagggagccacagtggtggggagtgtggttcttcccagcctcgggccagaaaggcctcttcacctcctcagcatgcgattggagcttgtgtttggagtgttctgctagagggcacgggccaggagggtggagggaggacccctgacccacactcccgcgggagggtgggcagggaccagcagcaatggacgattcgtcaccacagaccccaactaacagcatgtttgccattggactcacccctacgggccccgaaccagccccctgcccaccacatggcctcaccagattgcttttctttctacccacactgctcccctgtgcttagggctgaactccagtctggaggctctgagggattttgggggagcagggactggcaggcaagcccaggacagtatgggtgggtgctgaggcactgggcctggaggcttgtcactggcccctctctgagggggtagtggaggcccggctgcagggcgctggctggtcagaaaggaaagtgctgggtccctgtgtgctcctcaggacagccccgtggtgctgctcctgctgcctcgtttccccagagacccagtccaagctcttgcaagagtgctctctggggttcatgttttataaacgcagagtgaaccccaggtctagcgccagtgtgcccattctgtcctgagatcatttatttctagtcaccgaagcgttcccgcctcgttcctttattcactcactcattcagcaaccctgaacaccgccagtgcactgagccccaagctggatgcgggaactcagcggtgaaacatgattcccttgccttgcggcagccccgtgctcacagagaggacttgagtttcgggtgccagttgtctctgccaagttaggagtcagggactgacctctgtgacccccacaagctgcagccctggctgtgttttccacactggcctggggcccatgttcattggctgaggaacctcttggacctcatctctgaggagcaccgcctggggccctgggtgtgtgtcccgcagcatggcgcggggtgtgcacgtgcgtgtgtgcgctcacacgagcaccggctgccgcctccccgcctgtctccaggtgccatgtgtggaggggagaggctgggcgtcgctgcctgcagcactggctctgagccgttggccaagcctctccattttccttccccatcactctgtagaccctcctcactctttctgttcctgttctgttgccgtttcaactcctcctcttggaccctttctgtgcttcctgaaaggtacctggtctctctctccccgtgtgcaccccctgcctcctctacactgttcactgccccctagcaggacagggcaggacgctctcctgtagttcaggcccagggactatgtccaccactctcaccctccaaagccccagcacttttctgccccacggatggtgacttctgtcctctggagctcctattaacattgcctccaaggcaggagagtggacaggcctgagtgtgctcctgtgcacggaccactaggctcctccgggacccgggcgcccctgctctgttgcccccagctctccagctctcggcttcccatcctttcaccttcccaccgggagagactcctccgcagtcttaggtccaacgcagccgacccgtccagcctcaccctcctctgtgtggggcactagagggtttgcgagcagcagtgggagggctccccaaccctcctcggtgcctccagggtctgggctttctggacccaggggcattttgcagtcagcagtgaggatgccaacaaggcctattgggacagggcaccatctcactggagctgtgcttcctctccttcccctctgtgaggagttccgtgggccatggaccagctgctttcaagggacgtgcccgtcaggagggagggtggccagcccccaggcagccctgactgtgtgctcccctccaggctgaaactgccgccaaccggatctgtaaggtgctggctgtcaaccaagagaacgagcacctgatggaggactacgagaagctggccagcgacgtgagtgttcccccagtgaaagtcagggccacctcattatcctcagccagaggtcactgtgactcttgcagggggaaagcaggtgtggcagcgagatgacctagaaaaggctgcgtggtcacagaccatggcatttagccagctggtgtgtacacgacctctccgtttgcttccacaaggctaagggtcagaccggcagccaccttgccagccagcccctgggctcccgagcttgggttcctacagagatgctcagggacagtgtttcctgggcacctcagtgctttagaatcacctggggagctttgtgaaagcccctcttcccgtgccctggccctggagagagtgattcagaaggatggagaggggcctgggaaccaataggatagcaggccctgtgcaggtgcttaacgagcagcccagcaagacgggaactcggattatcctcctttccaagtgaggaaactgaggcccagggagggtcaggcacgtgcctgctgttacatgactagtgggacagagagctgggcttcacccaggcagccctgctctagagtccaaacccaatgcttcagttggaaataagggtggttagtacaactcttctggaggctcttcatttttgaaatctccatatttaaaaaataaacgtaggctgggcgcagtggctcacacctgtaatcgcagcattttgggaggccaaggcaggtggatcacttgaggtctggagttcaaaaccagcctggccaacatggtgaaaccttgtctctactgaaaatacaaaaattagccgggtgttgtggcacacacctgtagtcccagctacttgggaggctgaggcaggaggatcgcttgagcctgggaggcagaggttgcagtgagccaagattgcgccactgtactctagcctagcgacagagcaagactccattaaaataaaaataaaataaaataaaatttcccaaagagcagtggtttgactgctcatctagaaccagtggttcccagattttgcaatctcatagaccaggaaaatttgaaaaactattggatgtccaacctaagagggccagctttttattttgccaagttacggatgttttaaaaagaaacactaccatctgttaccaccagcacttctaacaccaagataaggtaaaaaggttattcttagaaccccagccattgccaagaaagggcagctggcagcacgcctcacaatgtatccacacagaggtatttctgtctttgaatttctcactttgccagaagttggcatttgggaaccacttctccagcttgtccgtgctggcagataactgattttgtacttctagaattgttttattatttttttgagatggagtttcactcttgtcacccaggctggagtgcaatggcacgaccttggctcactgcaacctctgcctcccaggttcaagcagttctcctgcctcagcctcccaagtagctgggattacaggcgcgcaccaccacgcccagctaatttttgtattttttttagtagagatggggtttcaccatgttggtcaggctgatcttgaactcctgacctcaggtgatccactcacctcagcctcccaaagtgctgggattacaggtgtgaaccagcgtgcctggcctagaattgttttagaatgtccaactgtttgttaccctttctcactccattaaagatctgagtagttcctaaaagaatatgtttgtttctttttcaattttattttctaatttatgtcccaggcccagtgcacatactggcctagccagactgagccaggtgggcttgtcggccttgcccttgaggcacttagtgagcccagaagcagtcaggctctcagcatggagctcagtgaagacagcggcagtggggcatgtgacagcatggaaagggacctttttggcgggggcatgggagtggaggtttcccctcttagacctgagggaaaagactaagagcaaaggcatgggccaggcatggtggctcacccctgtcatcccaccactttgggaggctaaagtgggattgcttgaagttcaggagctcaagaccagcctgggcagtatactgagacccccttctctataaaaacttaaaataaaaatcagccaggctcggaggtaggcacctgtagtcccaactacttgggagactgaggtggaaggatggcttcagcccgggaggttgctatgatcatgccacttcactccagcctgggtgacaaagcgtgaacctgtctttaaaaagaaaagcacaggcaggaacaggaagtaacaagagaacagtacagtgatgcagggacagggagggagcccacgctcccagagttccaggttgggggttctagcaggaatcgtggagaagttgggctggggagcaggggtaaccccctaaggtggggccctcaaagatccagatcccatgtgcccataagctggggggcagcccgtcagcactctgagggtcccccacaaaggccacgctggcttctgtggcccacagctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggtgagcaccaggattcacatgggagcagctgtgaggggcagaggcagccctagaactgcctgtgggcagtttggccagcgtaatctttcctaagttgttgatgtcctgtgggacatggcatggcctttcggatgcagtggtcggggaggggtgcacttcactcggcattgtgctcccctttggccctcactcactgtattttacacccagggttttatacgcatcccaaatccttgccacgggttgtgtgggtgtggagtggtgtgaatttggagccgtggtctgccatgatggcatgaccgccatgtgcttgaggcccttcatcagcggaggggcagtgcgccctggacggtaccacctccccatctatggtattcatccattcattcatgcactcacccgttcacgcattcattttgttaatccagaattgattgtacctgctgagtgctggggggccctgtgtaggcatccaggtataatagcaaagcatgacacagacatgaccccagccaagttctgccaccttcccatcagcatcccttggagacatccccctgggtgcctccacttccttgtgatagccctgcctgctcctgccctgccccaggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacggtacggcccagctctgccccactctgcccagccccgctcccgtgctcccctcctgtctctcaggcatgcatgggtgtgcacacacagccccctgccacgttgggtctgtttctcaggtgccctttcttgctgcttgggagcatgtgtgtgtgtcagaaatgctgctttagagccaggttcagtggctcacacctgtaatcccagcactttggcaggccaaggcaggaggatcacttgagcccaagagtttgagaccagcctgggcaacatagcgagaccctgcctatacaaaaaaattttagaataataaaattagccaggcatagtggtgcacacctgtggtcccagctactttggaggctgaggtgggaggattgattgagccagggaggtcaaggctgcagtgagccgtgattgtaccactgcactccagcctgggtgacagagcaagaccctgtctcaaaaaaaaaggaaagaaatgctgctttggattccttcagccccagaaagcagggaccattcaggggccaggtcctctttgttgcccagtctgccctcgcctcagaggtgggaccctgtcagtcatccaggaacacagccaagccccctccagcacttcagggaagtgaccttacacccatctgtttgtcccctctgcgtgtcttccccatccagggcgagtgtgtggggcaggcctcttccatcccccgcaccctgtgttcagagtcggcttccctctcccacacctctgtgagcgtggacggaaggctggggagcccatgttcactggcacgtccctcaggctagaggagggcctgcctcctgggcctgctgccggaccacagccagtgctcaccctcagacagtgctcacccactgccttcggcccacccttcagcatggcccacctgtgagctcctcccacctcccatcccttcccagagcctccttcccgggcctggctccccctgcaggagcgccactgtgctttctgttctcggcagccctgcagctgcctggccgttggctccagatgtgggatttcatcacgtccctggccctcttttgggtcatgccaaggttgagatttcagatcccaggggtctggaagccttcagaaagctgccagtgcctgggagagccacaagagccactcacaggactcctctcccactctggccaccaccttcccaacacagtctccctggccctccggccgccactccgcccagctgagcccttccttgcattcctgagtgcattttctcacccctccccaccctggcccgcatgcgagtgtgcagctccacacggcctgcagccctggccacggcccagcttgtgccctcctcacatgagctcagctcgccattcccgcggcagctgccagcctcagagcagcccagcccctttgctaccaggaaagagtgcgagtgagagagtggatagtgagggaggaagggcctggccaggccgggtgccgcacttccctcttgcctggcagaaaggcacccatgtgaggagagcgtgttagcaccgatgccatcttgtgtggttggtggcctccatccattcccggattcactcattcgttcaacagacagctcaggtggctccagccgtccttatccatggaggcctgggcgtcgccctgtggctgaaccttctgggggtctttctgcccacccatcagctcttcagtccctctacagggctccatgaggccctgcagatggtttcctgaggccaaggggctgggtgtggtggccccactggcattcctcccctgggaagggctctggggcagccttcacctgaggtgtttagaagccagctcagtctccggccagggcccagctggttcagcggcctccacacgtccctgccccacccctacctgactgggcatccacgcgggtctgcccatggcgtctgccagagcccccaggcaggctggcctactaattcccaagactcagagcctctgtcctctcaagtagcagttacgtgaaacaggacaggcaggccctccacaccccagggtctggtcgtagcggcctcctccgccctggggtgggtgggccaccttcactccacacccctcaccatcccccacagcccgcagcgggagggtcgtcgtggatgcttctctgagggacttgatttcctgggaatacgaccaaccccgaacgaccccttgtccccactccagttgtcccttggcctggatcccagatagctgtggcaatggtccgctgcccacatcctctcggtgcacccttgccaggactctgcggaggcagagggagatgtcacctgctgtttctggttcctgcccctgggagaaagcagttggagaagggaattgcaaggccgccttgtggctgagcctcctgccccagggctgcgcagcagggccggtggagccagagtctcccaggcctcccacttcttggccatcagtgccagagccgatcctgtggggagtctggtaggtgcctgacagttgagactgggagaggctgaggtgaggctggtactggctccatgcctgctgtgctcgaacaccacctcactgaaacttgagaatagttccatgccacacaggtactggggctggccccattttacagatgaaggcacaggcccagagaggcctcggtggctgcactgggcgggcagctgtcaggtgctgggacagagctgaggggatctccgctaccacttgggggaagcccaaggtggtgtgcctgaggcagggcccctgtaggagctggggtgcagccaccttcccaggctggcattttccctgcggttccctaaagaccttcacttgcttgcagggcttccttgagctttggttctgggatgtgtaattagccaggatcagggactaataacagcgttcctcctttcctttaaagggcctgatggtgggcccgccccaatgcacacaggacaccttaggacagcgtggggcacttagacgtggagaggaccaccacctgtgcgggtgcagggtcagggtcctagaagaagctggctctgatgcttccccttccccaagcctgctgggacatgggctttgaccccgggtgcttctccggatcaaagccctccagaaacaggtgctacctttctaagccgtgctaccacggcccgatttgtatggtttcctactaacaaaagttgctaagtttaggacacacaggttgagatggaatctctctctcaggctgagcaaccctgaagtgtccatccaggtccatccaggttacagttgggcttagagatccctggagggtacggaagaagattctggaagtttccatgccactgtcattggcatggaaggatgtggggtccacagtctctctttccctccctctgcttggacagcccctccagactcctgccccacagctgccgtgctgtggtctaagcgtctctctgctcctaccagggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaagtacgtgcgggctcaggacactatcatcacctggctctcaccacagcctgcccagactggtggcggcagcacgccgaggcccagcctgcctcaaggcctggaatagggtccccagtgccccaactgcacctccttccagaagccagggaagggccttatgggatgaggccttttgcccatcctgtctcagccccaggtgggacacctgaaggatttggattctctagcaggagggaggtgtctggccccttgtcttgattcttcaggctttaggggtccctgggggtgtcacctctcctggccaccccaagtaggccctggtcccctgatgggatgggccccagcctccgttgctcccagccataggtccctgagggaaccaggctgcacagtgagcctattgttctgctcggccccttccctttcttgctcagaatacacttattgtaagagcttccaggcagccgggctccttcccctccccacccagtcagataaacttgtgtacacaattagtacgctgagggtcgcgctggtgaatggggccttattccaccagtgcagcggccagcagcagggcgggcccaggcagcaggaggcccaggccattacttcatggaaaatccacaggccctcgaggggcagcagggctcccaaaatagccatctgctcaaaaataggatccttggctataactgctctttccaccgacacccccaccccaccacagtcacccccaaaggtctgcttattcctatgagtccaaggcccgtttattcctgagtccaaggcccagccctgatgccccagtggagccccatgctgggcagagctggtttcctccccgactcactacccactactgtccgggtgctttgagggttccccattggctcagccagaggcaagagtcccgtggggccatcacagcatttggcacagttggggcactccaggggtcctgccaccaccacgtccaggccaaggagagcaaggtcacagatgcagcaccctcgggggtgtgggggtgggacacaggcagcttccccagtgacggaagagcccctggaagctggtaggaaacagacttgaaataaaccctaggcttgcccccttctcaggccctgggcaaagctatgtgaaacccattactctgctcaggaacaggcggtccccgaagcagctctctggacggtagccctgaaggaacggaagggagggctgtccgggtcctgtcttttctgctgagggggaattacagaggcctgtggaccgtccaggatgagccggatgggcagccctgctgagcactgattaatggcgatagcaaaaactcactgagctctcagggctttatgtgtaccagctcatttaatccccacagcaactgtgtaactgagggaaccgaggcacagagaggccaagaggtttgcccagggtcacacagcaagggagtggttgagatgggaatggagcccaggcccccagccctactgtggagcacagcctcagcccctgtccgctgtctgtggctggctcgcctgctccccatgtcctgttcctccccagagtcgttccctgccccctacccctcctcaggccccaaggcctggttgaagggccacactcttagctgatagtggcagaatgagtcagggatgggtgagcaggaggaagccgcttcccttctcacccctggttatcacctgttaaccagctctgttatcaccccttcccttctaccctgggggtcccatgggccagaaccaagctgtgatttgattgaccaattagtgattggttgctgatatcctggaatgttgactgccccaacaccctggcctgggaaccttgggggtagatgggtccaatccatctagccacttgcccttgccgagtctcattgctctctgcccggcccgcagcgagctggattactacgactcccacaatgtcaacacccggtgccagaagatctgtgaccagtgggacgccctcggctctctgacacatagtcgcagggaagccctggaggtgaggagggggtgacatcacccacggagctctgtgcccctgctgccccggggctggtggtgtggatagtgtccagacctgtgagctccccccacctcccacggagaggatgttctctgactcctcagggccctctggacccctccccacccctcctgctcacatactgacctgccttccctctgtccctgcccccttccctcccacacactagaaaacagagaagcagctggaggccatcgaccagctgcacctggaatacgccaagcgcgcggcccccttcaacaactggatggagagcgccatggaggacctccaggacatgttcatcgtccataccatcgaggagattgaggttcgcaccccccggccccccatcttcccaagagcctctgtggggctgggccgccccctcactccagctcctcccctagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgggccggggccatccgtaggggctggggcaggacggcggggctgggggccacctccctgaccgctcccacaccgcgtctcctctgccaggtgcagcagctggtgccaaaacgggaccatgccctcctggaggagcagagcaagcagcagtccaacgagcacctgcgccgccagttcgccagccaggccaatgttgtggggccctggatccagaccaagatggaggtgaggcacggctgagccccacagagctgagaaggttccaagagagctcccgtagtgagggggtccccggccagcccagggcctgcagactgaggcgcctggcagagcaggtcccaattctcaccacccaggggccgtgatcaccctgcggggttaggagagtccacagagcttgcgcctggaatcccggcacctggggaggctgaggcgggcggatcgcttgagcccaggagttcgagaccagcctgggcaacatagtgagaccccaactctacaaaaaatacaaaaattagctgggcatgatggtgcgcagcccaaggaggtcgaggctgccgtgagctacgatcatgccactgcacttcagcctgacagcgagaccctgtggtctctagtgggctacctatgggaggtgggtttgatccctgaatgccctggtctgatgattgtgagactcaggcactattgaacctctgatcctgtcctcccagctctaaaatggggatgaaaacagttaccttattacttcaacaaatgctttttgcaccaactaaccagccacatgagtgctgtcattcttacagcagttctgaccaccactcactgagcactcactacataccaggcaaccaggctggcagcaggcaacctcgtttaaacccagcaagcctgagagggggtccgggtgccaggcaggtcagccctgaggttcatgccagccacgcagcatgtggacttgtgggtgccgagacatggagtgcccgaggtcaggagctgcagccaggccagggttcagatcccaactctgcctctaacagcactgagctgtcctccgtgagcctcggtttctacctctgcagtcagggcctgccacagccctggcctcacagagaggtcaagggtaaaatgaagttgggcacagggagcgcttggcagagaaaacctccctgtcattgtcatagctgctttaacatgagagggcaggaccggaggggacagttgtgagcagtgggccttccctcccagggacccatgggccaaggccccaggccaaaggggccccggggaagatgcaggccagcagcgcgagtgggctcctccaggtggtcagtgggggcaggcccaccagcctcaccccaccgcctgcacccacccccgtaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggaggtgcgcggctgccccgcccgctggcctttccaccagcatggccggcttcctcactggaaatggttcgggccagtgagaagatagctgtctgctgtctgttgtttttcactctgtttaaaaattattgaagagaccagcactttgggaggccaagtgggaggatggcttgagcccaggagttcaagaccagcctgggcaacatagcaagaccctgtctctacaaaaaatgaaaatattagccaggcatggtggtgcatgcctatagtcccagctccccaggaggttgaggtgggcagattgcttgagccagggaggcagaggttgaggtgagccgaggtcatgccaccacacttcggtctgggtgacagagccagactctgtctcaaaaaaaaaaaaaaaaaagattgaaaagactagatcaaaatgtttagacatttttaaaaattacactttccctagcactgctctcatcaccatgacaatgcccctcacaggacaagctgttctaggggcccacagagggcaccgtttgccctgtggccttagcagtatcagccttgctcagggccagagccagccagcgggtgccgggtcagggcagcagctcccactggctaacactccggggacattacaagctggtcgccgtcatattggtagcttgagaaaccaaaagactggacactcttgatccaacccatacaggtccacagatgcttcaaaccagagttggcttttttgtttttttcccctgagagccagtggtgagacactgaccagagtttgtccaaacagtctccacagggatcccggcacaagattcatgggtccttgcccttctgctgcccctgtagctgggaaacacacttactgtggagacagacattggcagaggcagcagggaggcaccatggcccgtgtcccctgtgaggtgtacaggagagcaggggctttccccagggcgggaggacagttcacagtcctccacgtgtgaaccacggtgaggacagttcacagcacccggcccacgatcacgcccccgtctttccgcagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggtgagcagcctgccacctcctcggcctctcccctcccgccgttgccgtaccagcccacaccttcgtctctgcatctgttcgtccattcccatcacagttgctgagcgtcggccgccactcccagggccagcagggccctgccactgtcagggtgtaggtgtgcggcaccaagaccccagcctgggccacttcacacgcacaggcagggggccggaggtcccaagtcctgccttctggggtggcatcctcaccacccccagggcagatgaagtctcagcacacccaggctttgcgacccggtctgtgaacctggacacagacaccccgcacagtgcttttagaattcagatttggtccggcagcctcatcagaggggccctgagcgccagagtttgctgccatccccagcccacccctgccgggctgacggactgagaagtgtgcagcctcagctctgcacctggcgcccccaggacaggatacagtcccctctgtcccactccaaatcccaaaggcaaggagaaccccccccccgaccctccaccagtcctgggacttgtcctcagttctgtagcatccagctgccacccctgctgtgggcagagaggtcggggaggcctctgccttcctttgagcttccgaggttggggaaaggatgaaaggggcccgtgccgcccccgaccccacgtgtccctggccatctccttgtccatgttgcctctaactctgtgtttccctcccctacgtgtcccttccccctgccctctgcatgtgaccccgatccctcatcctggtctccacgccgcccctcccgcacacctgccttcggatggccccggcaggatcatggcggggcgctggggcccgaggagttcaaggcctgcctcatcagcctgggctacgacgtggagaacgaccggcaggtactgcaccctgggccccagcggaccatggcattaactgctctctctctctctctccttctctctttctcccctcgccatcccacccctgccatcctgtgtgccatctcatggctctcttgcctccctgcccacatctccctggaccccttcccttttacctggtctcttggggccgctgtctccctgctccccgccactgtcctgtctgcctgctgtgcacatggggcggcccctcttgcctactctgggcccggcctcctctgctatgcctgcgtcctcggagcagaagcagacaggcagcatggactccgatgacttcagggctctgcttatctccacaggatacagcctggtatgcagctctgtctccccagccacccgctcctcctcctcctcctcctcctcctcctcctcctcctcccccccacctctccccctcaccgcctccagagcttcctcgtcctcggggacactcctccgcccgagcagcgcagccgtgcctgcctcttcctctgctgcatctgccggggtggggtccctccgatgacttcccgagccccccttcttccctagaagtctccagaaagagggggcagctctcccactctctcccctttttctttctctttctctctttcttccccatcctccagagcttactcgtgagcctgggctgagggcagtagaccccagttccctgctgtgggagaccacgagaggggagggtgcagagaggccctgcttcccggcctggggcactgggggcttggaggcctgggtcagctggagcagtggcaggctctgcccggggccaaggctgctggagcaggcggggaacagggcgcacgcacacgtgggttgggccctactctctcggctgtttccctggagaccccaccagtgtgggcctggctgcccctgccccactaaatgtcgggtgtcccccaccccaccctctccttgcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaaggtgagcgagacccctacgaggtgcatgggggctggcgagaggggtccctgcagtgggaggggctgagggggccagtgtgtgggtggggatggctcagagtcccatcctgcctgccccagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtgaggccccagagacctgacccaacacccccgacggcctccaggaggggcctgggcagccccacagtcccattcctccactctgtatctatgcaaagcactctctgcagtcctccggggtgggtgggtgggcagggaggggctggggcaggctctctcctctctctctttgtgggttggccaggaggttcccccgaccaggttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtcccttcaaggcctccccaatccaggccaaagccccatgtgccttgtccaggaactgcctgggccatgcgaggggccagcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaagaaccaaaaaaaaaaaaggaaaaaaaacacaaaacaacaaaaaccaaaaaaaaaaaaaatcacaaaaacaaaaaaactataaaaaagaaagaattaaaaactttcagagaattactatttactttattaacttacggatttattatataaatatatattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgctccccctaccttttttttttgagtttattctgattgattttttttcttggtttctggataaaccaccctctggggacaggataataaaacatgtaatatttttaagaagga

SEQ ID NO: 2305 - DNA, 40647 bp, Homo sapiens
  source 1..40647: mol_type = genomic DNA
ggcaagactattgctggttcattttgccaaatcagagatcacagcaagtccaggccagaggctgtttgcgtctgcctgtgttggaggtcccctgcgcagttgggacctaaaagatcttcagggattgggtaaggcactgaatcacctgcagagttagacaggaccctagaggttgtcttcttccatccaggcacagcttatggttgctgttttttcccagttccaggaaccaaatggtgataaactaggaatggagagagggcttgctgctgtctgagagctcaggtacaggtcatggaagatggatgagaggacattcgcctggggcttttgaggaattctttgattccctgccatccttgagttgggtgaggacagaggtggcttcttgcatccttcttccaaggccaggtgaggagctggactctgatcacatgaggtcttttatttggggcggctctgctctactcccctctgccttggcagctggctgaacagacacagtgacagccactcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggacgctcagagagcccagcgcggtgaggaaagcgacgaacttaggagccctggtctgggtccagccaccccttactacctatttgaccttcatcaagctctttgacctttccaggctttagtttcgacatcaataagatgaattaatagctgggcatggctcgcgtctgtaatcctagtactttgggaggccgacgtgggtgtatttgcctgagctcaggagttccagaccagcctgggcaatatggtaaaaccccatctcgccaggcgcggtggctcacgcctgtaatcccagcactttgggatgccaaggtgggtggatcacttgaggtcgtgagttcgaaaccagcctggccaatatggtgaaatctcatctcttctaaaaatacaaaaattagctgagtgcggtggtgtacacctgtaatcccagctactcgggaggctgaggcaggagaatcacttgaatccgggaggcggaggttacaatgcgccaagatcacgccactttactccagcctgggcaacacagaatgtctcaaaaacaacaaacaaacaaacacaagaatcacctgctctgggaagtgcagtttcttccagcctacctaggccaggagcaaagtcagctcatcaatttttgccagcgcctcccttttcagaaattcttttctcaataaaagatgagaccctctcttttcttttaaaaggatgatttgtgtcctgtgtcttgtctgtctgctctgtccacaaaactgatgaaagctccactgcaaggcaaagttaatgttcccctcccacttctcaagaactcagaaatggaaatataactctgcactcagagagttaaaatagaaaacaagcaacagatccaagtggagacatgcagatcacacaagagatcggactctccaggatccagccttgccgctaaactcaccaagggtattaacatatctaaggaaaaggccgggcatggtggctcgtaatctttgggaggccgaggtgggtggatcacctgaggtcaggagtgcaagaccagcctagccaacatggtaaaaccctgtctctactaataatacaaaaattagctgggtgtggtggtgcacgcctgtaatcccagctattccagaggctgaggcaggaggttcccttgaacccaggaggcggaggttgcagtaaaccaagatggtgccattgcactccagcctgggcaacaagagcgaaactctgcctcaaaaaaaaaaaaaacatatctaaggaaaaaggtgggtcagtccaggatgccaagcaaagggagagttgagacccacaaactggaataacttgaataacgagtggatcagctgaggtcaggagttcaagactaacctggccaacatggtgaaaccccatttactgaaaatacaaaaaattagccaggcatggtggtgtgcatctgtagtcccagctactcgggaggctgaggcacgagaatcgcttgaacctgggaggtggaggttgcagtgaggcaagatcataccactacactccagcctgggcgacagaaattctgtcaaaaaaaaaaaagaagaagaagaaagaaaagaaaagaggagaatttcctgatgaagcataagtgtctggtccgaatgataacagcattctgactttcttgtttacacatctatcccttatgaatttgttcagtgtgtattgatcctgcggagtcctatcacttctgggtctacaaacagtaaacttcggagcgtataaaagcctacagaatatgctaacaaaactaaaatactgccaccatgtgggcctttccacaagcttaactgtcagtccccaaggcatttgtgtatccgatcaatatgtaaatgaacgagcagactctcttggatacaatgtggagaagactctaccaaaggtcactttccccaagccactgataacctttaaccagctcaaacccgtctgagctcaccacataaaacacccaaggatcctgcccactcccacaataccccatctccctcagcccaacaaaaacatcctcaggaaagttctctccaataaactcactgaaataaaactctagcagtatttgagcacctagggctgctctcctcgaaagatccctcccctaccaacacggagcctggtgtcagtccatctcagagtacctaacctcagttatcctttgcttctggccaaaatgcaagacccaaaaatcagatttttttgatgatgctcccttcttttggactctttctactcctttccatttcactctctccaaacttccttccttaaaatcaaatttttttttcttttttcttttttttttttttttttttttgagacggagtctcgctctgtcatccaggctgaagagcaatggcggtatctctgctcactgcaagctcctccccctgggttcaagtgattctcccgcctcagcctcccgagtagctgattacaggtgcgcaccaccatgccagctaattttttttttttttgagacagtctcactctgtcactcaggctagagtgcaatgacacaatctctgctcactgcaacctccacctcccaggttcaagcaattctcctgcctcagcctcccaagtagctagaagtacaggcatgcgccatcgcgcccagctaatttttgtatttttagtagagacagggtttcaccatgttggccaggatggtctcgatctcgacctcgtgatccgcctgcctcagcctcccgagtgctgagattacaggcatgagccacctcgcccggccaacagctaatttttgtatttttagtagagatggaatttcgccatgttgaccaggctggtttcaaactcctggcctcaagtgatccaccagccttagcctcccaaagtgctgggattataggcatgagccaatgcacctggcctcccctctctttttaacctctccacacttcttccttctgtgtgcaaaacaagtctctccatcctaaaaagaaacctgtggcccctgtggttccctccagctatctcgatgttctttttctcaaatcacactcagagcctttaatcagccaaacctggctccaattcatcacctgtatttcatttttctttctcttttcctttctttctttttttttttgtgtgtgtgtgttttttgagacaacatctaactctgtcacccaggctggagtgcagtggtgcgatcttggctcagtgcaatctctgcttcccaggttcaagtgttctcctgcctcagcctcccgagtagctgggactacaggctcatgcccggctaattttttgtatttttagtagagacagtgtttcaccatattggccaggctggtctcaaactcttgaccttgtgatctgcctgcctcggcctcccaaagtgctgggattacaggtgtgagccaccatgcccggccgtctatttcatttttctactcccagaaatggggtttctcttctcagcatgttactgaaactgctcaaaggtgaccttgtaatttccaaatcccatggacgattatgcatctgcatgtctcttgccctcaccctgccatgtggctccttttatttttcaaaccccttgttttggcccctaagatggctctatcccaattctccttctcagcttatgtcacgaggccctgagtatcatggcagaggggagaacggggaaccatgagaaacaggggggcaaagggcagcacggaatgtgttcccagttttgctggaggctgcccagtccatttcaggtttccttgctcatgttggcccctggaaaggcacatgatcccttgcaccagagacctgagtggtcaattcatgagcattcagtcttctaccagctaagatctgagtcaggccagagcaaaggaggtgggaggaacagagaggagagctgggctcaccggcagcagcctggctctgatctccatgtagagcacgttgtcctcgtagaactcctgcatgctccggaagacatagtctctgaacactggtgcgtaatggatgagaccagagatggtgaagaagatggtttcaaatttcgaccagacaacattttggtttgtgtaaatcacctccgggtgctgggtcaccagagtgaaattcctcagcaagctgtccaagacacgaagtggggagtggcagaggcatgatccaggacactgcccccgggcgcccataggactgctacccaccttgcatatcccagctagcagctcacaggattcaccctagagtggagataaggaaggggcaaaggggagcattcccacgctcacgatataagcatgggtcctgtggccaggcagcccactgcctgcttaaacccaaaccccaaacgcaggagactgcttaagatgagagctcaccagtcagtctctcctggctcctgtcctccctctgtatgcttggccagtctgaccccactgtactttctagaccaaaaagctctctctctctctctttttttcttcctatacccactgacaggaaactagaccaagctctttttggggaatgttatggactaacttgtgtccccaaacccccaaattcaaatattgaagccctagccctcatttggagaagggaattttaaagagatgattaagactaaatgaggttgtaaggatggggctctaccctaataagatgggtgtccttgtaagaagaggaggccaggcgtggtggctcacgcctgtaatcccaacactttgggaggccaagatgggtggatcatttgaggtcaggagttcgagatcagcctggccaacatagtgaaaccccatctctactaaaatacaaaaatcagccaggcgtggtggtttgtccctgtaatcccagttactagggaggcaagagaattgtttgaaccctggaagtggaggttgtagtgagctgagatcgcaccactgtactccagcctgggcgacacagcaagactcatctcaaaaaaaaaaaaagaagaagaagaagagaccgcaggagtgcacatacagaggaaaggccatgtgagtacacagccagaggcgccttctgcacgccaaggacagaggtctcaggaggaaccacccctgccctggcaccttgatcttagacttccagcctccagaaccatgagaaaatcaattccttcttttttttttttttttttgaaacagggtctcactctgttgcccaggctggagtgcagtgtcacaatcacagctcgctgcagcctcaatctcccaggctcaagcaatcctcttatgtcagccccctggggtagctgagactataggtgtacaccaccacatctggttaattttttattttttgttgagatggggatctcactatgttgcccagactggtctttctttctttctttttttttttaaacagaatcttgctctgtcgcccaggctggagtgcagtagcatgatctcagctctctgcaacctccgcctcccaggttcaagtgattctcctgccttggcctcccgagtagctgggattacaggtggctgccagcatgcacggctaatttttttgtatttttagtagagacagggtttcaccatgttggcctggctggttttgaactcctgacctcaagtgatccgcccacctcggtctcccaaagtgttaggattacaagcatgagccaccacacccggccaccaggctggtcttgaactcctgggtgcaagtgatcctcccacctcagcctcccgaagtgctaggattacaggcatgacccagtgtgcccggcttgagaaaatcagttcctattgtttaagctccccagcctgtggtattctgttatggcagctcgagcaggttaatgaagggagtggaatggaaataactcgaatcagcacccaggtttgtatccccaactggccatttaccagctgtgtgtccttgcataagctaattaaccttgctcagcttcacgtttctcatttcataaagggaagtaacctcaggggggcactctgtagacatttctgtgaccaaattaattgtcacttataatattactatacaatgccaggcacaatggctcggctcatgcctgtagtcctagcactttgggaggccaaggtgagaggacggcttgagccgcagagttcaagaccagcctgggcaacacggcaaaaccccatctcacaaaaaatacaaaaattagctgggcatgatggtgcacacctctagtgtgctgacacaggaggattgcttcagctgacacaggaggctgacacaggaggattgcttcagcctgggaggttgagtctgaagtgagccgagattgtgccactgcactccagcctagatgatagaatgagaccctgtcttaaatagtaataataataatgatactatacaagtctgttaggaagttgctgcatcagattttcaagaagatttatcttccagctagattgtcatcacttcagagctaggaacttttattctctctggttttattgagcatcagacaaatctcatttgctacagcaatagtgttgctgactaggcatggtcactcatgcctgtaatctcagcactttgggaggccaagatgggcagatctcctgaggtcaggagttcaagaccagcctggccaacatggtgaaaccctgtctctactaaaaatacaaaaattagccaggcatggtggcacatgtctgtaatcccagctactcagaaagctgaggcaggaaaatcacttgaacccgggaggcagaggctgctgtgagccaagatcaggctgctgtgagccaagatcacgccactacactccaacctgggtgacagagcaagaccctgtctcaaataataataataataaataacaataataataacaaacaaaaatagtgttgctgataatgctttttgtagattttaaatgcaccagaaaaactactatggatagaaaaggtgttgaatgcttttgtggagcaaagtatcctgcaaggttaaaagaaaaaggtgctcatgctttttttttgagatagggttttattttgtcactcaggctggagtacagtggctccatctcagttcactgtggcctcaacctcctgggttaaagtgatcctcctgggttaaagtgatcctcctgcctcagcctcccaagtacctgggactacaggtgcagcaccacacctggctaattttttgtatttttggtagagatgggctttcaccatgttgaccagactggcaactcctgggctcaagtgatccgctcgccttggcctcccaaagtgctgggattataggcgtgaaccaccgcactcagccttgcctcatgttttattaaagccagatttttatctataggtttgtaccaagggagacacctacccactgccaccccatgacaggcctgggacatgtgctttctgaactactactcacctgtcatcaaactcagtgacgttctgcacccgcttccgataatcctccagcagaatccacttggaacatttttctgatggacggggagttgggtgagcaaatctgaactgcatgatcccccttggggtgaaacagatgtggcagtgaggcctgtaggtgacattcctcaccagccagtccatagtcacgatgccaatgtcatggaggtgcaaggcagcccctggagagggaagaagaatggtgaagacaaaggggtgaagtcccatcccaggactccagggcttggggacaaaggagggggtgaagtcccatcccaggactctggggctgtggggacaaaggggtgaagtcccatcccagggctccggggcttggggacaaaggggtgaagtcccatcccagggctccggggcttggggacagtgtggatcacaagaagacgtgcaagcagaaggatttctgtccagacatgtttctcggaacttgtttaaggctctagtttaaggatggggcttccatgtctcactaatcaggagccaggggtgatcttgtccaagaggggcagcatgggagagtgagagggcatcaggcttggaaccagagaactgaggttcaagtcagggctccattggcttctagctctccaatgggagcccaggcctttcaatgaggccacccaacactgcatgacgggatacactgggatgagccccagggccacggtccttttcacacacttgtcctccatcctctcatcctgcccctcaactcctctcccactggcttttcatcccctgcgctgggcctgtgtctgtacagcttctggcctgcaggctttgccagttgaatccccatgcttgtcctccccaccagacaccagctgtgccccttgctcccctaggcacagtgcatgctgtccctctgcgcttcttgtgcccatccagcccctggccctgacacgagcccccagacaccctcttatgcctcccagcaactggggatgctactttactgacctcacgattattattattttttaaatctctatttataacattaaaagaaaaaaaaacagctgggcacagtggctcactcctgtaaccccagcactttgggaggccgaggcaggcagatcacgaggtcaggagttcgagaccagcctgactaacatggtgaaaccccatctctactaaaaatacaaaaattagccaggcatggtggcatgtgcctgtaatcccagctactcgggaggctgaggcaggagaattgcttgaacctggaagaaggatgttgcagtgagctgagatcacgccaccgcactccagcctgggcgacagaacaagactccgtctcaaaaaaaaaaagaaaaaaaaagaaaaaaaaaaaacaggtgttaagtctttgtaaactgcaagctgctattatttttacattttaaattaacatttttggccaggtgcagtggctcacacctgtaatcccagcactttgggaggccgaggagtgtggattgcctgagctcaggtgttcgagatcagcctggccaacatggtgaaaccccgtctctactaaaagtacaaaaattatccaggtgtggtggttcatgcatgtaatcccagctactcaggaggctgaggcaggagaatcacttgaacctgggaggcagaggttgcagtgagccaagatcacaccagtgcacttcagcctgggcaacagagtgagactctgtctcaaaaaaaattttttttaataaaaaaaaaaattaacattttttggggaacagggtcttgctctgtcgcccaggctggagtgcagaggtgccatcatagctccctgcaaactccacctcctgggctcaagcgatactctccactcagcctccagagtagctcggattacaggtgcaccaccacccctggctatttatatgtgcgggatgctaattatttcatgtttcatggaggtgtgtttatactactccaggatgctatatcacattgtatcctatgtggtagcttagcccctgggaaaactaaaaagggaatagcaaagtctcagggctggatgcttttccaatcctgactgtctgcgagtcccccaggaagcaggggttttggttttcaacacccttttcctagtctacccataaggacagaggagcagaacagctgagtgaggctttctctgctccatctagaatagcaacagccacaagcacagtaatagccccaagatgagtccctctaccttcccagcaccccaagccacccctttccaaaccttaccttttggcatcatccttagaatattaaacacttgacttctctcaatgagatgcttggcctggaaaaagtgcatgctgggtgggaatatcagggtcctcatggcctccttcatctcagcgattttgagcgtcatgagcctctcattggccagctcctccttggtgttcagcaccagccgcccccccagccgcatcatcttttctttcaacaacagatgcgcccgtgtttcatctatggatagagctgagccgaagaaagacattgccacagccaacagcaagaagcacagggctggccgctcagatgggccatccaccaacatcgggatgcctggactaggaaagggctcagatggagactccacgggactgcaaaggagagtgggggagtgaaaacctacagatttaagggtggaactctgatcttccttttctcgccctgctctcagattaccagaaggcaagatattgaaggattcttcttccagaccccagagaaaagacctacaggtacagacaggtaggggtttcccaatttttttttttttttttttgagacggagtctcgctctgctgcccaggctggagcacggtggtgcaatctcggctcactgcgagctccgcctcctgggttcacaccattctcctgcctcagcctcccgagtagctgggactacaggtgcccgccaccatgcccggctaattttttgtatttttagtagagacggggtttcactgtgttagacaggatggtcacgatctcctgacctcgtgatctgcccgcctgggcctcccaaagtgctgggattacaggcgtgagccactgcaccacctggcatttttttttttttttgagatggagtttcactcttgttgcctaggctggagtgtaatggtgtgatctcggctcactgcaacctccgcctcccgggttcaagtgcttctcctgcctcagcctcccaaatagctgggattacaggcatgcatcaccacgcccggctaattttgtatttttagtagagacggggtttctccatgttggtcaggctggtctcgaactcctgacctcaggtgatccgccagcctcagtctcccaaagtgctgggattacaggcatgagtcaccgcgcccggcaggttttcccaaattaaaggtcaccatgaggtcaaacaagccctggctcatgcataaagacactgcaatctgatttttagtggttcacttttattttattttatttattttaatttttgttttttttaagacagagtcttgctctgtcacccaggctggactgcagtgacgtgatcttggccctctacaacctccgcctccagggtttaagcgattctcgtgcctcagcctcccaagtggctgggactacaggcacgcgtcaccatacccagctaatttttgtatttttaatagagaccatattggccaggctggtcttgaactcctagcctcaagtgatccactcatctcagcctcccaaagtgctgggactacaggcatgagccaacatgtccagccagtgttttacttttaaatataaccagcatgcctgtggtcccagctattcaggaggctgaagcgggagcatcacttgagcccagtactttgaggctgcaatgagctttgacctcaccactgcactccagccttggcaacagatcaagaccttgtctctaaaaaaaatatttttttattaaaaaataaaaatacggctgggcgcggtggctcacgcctgtaatcccaacacttcaggaggccgaggcgggtggatcacgaggtcaggagtttgagaccagcctggccaatatgatgaaaacccgtcctactaaaaatacaaaaattagctgggcatggtgacgcatgcctgtagtcccagctgtttgggaggctgagacaggagaatcacttgaacccaggaggcagaggttagaataagctgagttcgcgccactgcactccagcctgggcgacagagcaagactcaatctcaaaataaataaataaaattaaaataagaccaggtgctggcacagcaggtggattgctcaagcccaggaattcaagaccattctcagcaacatgttgaaactccatctctacaaaagatacaaaaattagctgggcgtggttgtgcacacctatagtcccagctactggggaggctgaggtgggaagttcacctgagcctgggaaatcgaggatgcaatgagccaaaattgcgccactgcaatccaacctgggtaacaatgtcatatcctctctaataaataaatgaattggccaggcgcagtggctcacccctgtaatcccagcactttgggaggctgaggtggacggatcacgaggtcaagagatcgagagcatcctggccaacatggtgaaaccccgtctctactgaaaatacaaaaattagctgggcgtggtggcatgcacctgtagtcccagctactcaggagcctgaggcaggagaattgcttgaatccgggaggcggaggttgcagtgagccaagatcgtgccactgcactccagcctgccaacagagtgagactccgtctcaaaaaaagaggaaaaaaaaattaattaattaattaattaaatagcaaagaaacaattaacagaatgaagagacaacctatttttttcttttcttttcttttcttttcttttgtgggggacggagtttcgctcttgtcaaccaggctggagtacaatggcgcgatctcggctcaccgtaacctcctcctcccaggttcaagcgattctcctgcctcagcctccagactagctgggattacagacacgtgccaccacgcccggctaatttttttatatttttaatagagatggggtttcaccacgttggttaggctggtctcgaactcctgacctcaggtgatccaccagactcggactcctaaagtactggcattacagacatgagccaccgtgcccagccttttcttggctcactgcaatctccgtctccctggtccaagtagttcttctgcctgagcctcccagctcctgagtagctgggactacaggcatgtgccaccaggcccggctaatttttttgtatttgtagtagagacggagtttcactatgttgcccaggctggtcttgaactcctgacctcaggtgatcctcctgccttggcctcccaaagtgctgggattacaggcgtgagtcaccatgcccggccaatctcttgaataggagaaaatatttacaaattagttatctgatggagagctaatatccagactatataaggaaatcaaacaactcaacagtaaaaggacaaataatctcacttaaaaaatggccaaagacccaaagacatacaaaatggccaatacgtatacgaataaatgcccaaatttttttctttgctttgctttctttctttcttttttttttttccttgagacagggtcttactctgttgcccaggctggaatgcagtagcgtgagtccacttggttggactccaaagctcgctgcagcggcaacctcccggcttcaaggaatcctcccaccctagcctcctgagtagctgagtgtagtaccactacactcagctaattttttttttttctttagagacagggtctcactatgttgccatggctggtctcaaactcctgggctcaagcgatcctcctgcctctacctcccgacattctgggattatagatctgagccaccaggcccagccaacattttttctaatcactgggggagtgcaaatcaaaactacaatgagatcgtctcaccccatctcaaaaaatggctattacttaaaaggcaaaaaataacagatgctggtgaggatgtagagaaaagggagctccttacaccactggtgggagtgtaaactagtacagccactatggagaacagtatggatatttcttgaaaaactaaaaatagaactaccatacgatccagcaatcccattactgggtatctatccaaagggaaggaaatcagtatgtcaaagggatacctgtactcggatgcttattgcagcactattcacaatagcaaagttatggaaacaacccaagtgtccaccaacagatcaacggataaagaaaacgtggcaagtccatctaccgaagcaccggggagtgtcgtggatgcctacgagcaggtacaaaaaggacttctaaagctgaaaggcgtcgcagagctcagagtgaccaagcggaagaagaaaaagaaggacaaagacaaagctaaactcccggaatcaatgggaatgaacaaaaagaatgaggaggagaagcagcacggcctggacaagtggaccccggcccgcgcagcctttgagaaaatgcaggagaagcggcaatggaaaggatcctcaagaaagcatccaggccaggcttggtgactcacgcctgtaatcccagcacttcaggaggctgaggcgggtggatcacctgaagtcaggagttcaagaccagtctggccaacacggtgaaaccccgtctctattaaaaatacaaaaaattagctgggcgtggtggtgtgtgcctgtaattccagctactcaggaggctgaggcaggagaatcgcttgaacccggtagggagaggttgcagtgagccaagattgttccattgcactccagcctgagcaacaagagcgaaactctgtctcaaaaaaaaaaaaaaaaaaaaatagcatccaaaacccacaagcagagagtggaggacttcaacagacacctggacacactcacggagcattacattcccagagtcagctggacgaaatagccgcctgcccccagtagggagcagcatcgagggttggcaaaaggccatgctggggttgtgtgtgtttcctttggtatattctagaaacatggctttacacacaccctcgcatcttctgctacaaactgcttttcgaagctgtgtaccctcattctgtaacttgattaaagtaaaattgtccttgtactcagtttaggtttcttggcaacatatagaagatacacccttttagttcggatggaaagtttctaagtttattcagaggtaaagcccatttctgtgtccgtaccatgtaaaaatgtttttatccccgagttgcatctaacgctctgaggccagccagctgtcttctccaggatcagatggactccagaggataaggagctaatgccagggtggcctgtagtatgcagagctccgcaggacccagcatgggtgcccctccaagcttcctctagcttggggcctatgctggtcctgcaggccccagggaagccatttgcaactctgtggccttcagacttcctcctcagccactggccactgagacagcacagcctgggtggcagaacagccacctaaggcaagaatggaaggaaacactttgttcctttctgagcccattccccaaaaccctccttccaggtactcctaatgggtattgccatggcagacattgctaatggatcacagcattctttgaaatggagcccagatatagcctgcctgtcaatcctcagctgggggctcctagcagcctcttgtatttattcagagttgacacatcacacggagcctgtctggcattcctaccctaaggacacctcaggggtgacaggaccagggcagagccccagtacaaacagacatgggtgcagtcaaatgggagggcccaggcatccgtcttggagggctgggattttgtagggcctgtgtgtcctggttgaggatcaaaccgcatatgctattgggagaaacaatctctgtggacatacatactgaaagaataacaaaggcagaagagaaaaacaaagtgtggaatttggggttctcctgtgtaaattacacaagaaagcagaagccagttatttaaaaaagaaagaaaatgtggcatatatacacaatggaatactactcagccattaaaaaatgaaatcacgggctgggcacggtggcttacgcctgtaatcccagcactttgggaggccgaggcaggaggcaggtggatcacgaggtcaggggtttgagaccagcctgaccaacatggtgaaaccccgtctctactaaaaatacaaaaattagctgagcgtggtggcggatgcctgtaatcccagctactcaggaggctgaggcaggagaattgcttgaacccaggaggcggaggttgcagtgagccgagatcatgccattgcactccagcctgggcgacagagcaagactccgtctcaaaaaaaaaaaaagaaaaaagaaatcacgtcatttgcaccaacatgcacggaactagaagacataatgttaaatgaaataagccagacacagaaggacaaacaccgtatgttcccactcatgtgtgagagctaaggaagttgatctcatagatatagagaatagaaagatagacaccagagactatgaagggttggggtagacatgggggatgaagagaagttggttatgggtacaaatagacaagcacttcaagaggctgaggcaggagaatcacttgagcctagaagttgaagactggcctgggcaacaaagcgagacccccatctctacaaaaaatttaaaaattatcggcaggcagatcacgaggtcaggagttcgagaccagcctgaccaacatggtgaaaccccatctctactaaaaatacaaaaattagtcaggcgtggtggcgtgcacctgtaatcccaactacacaggaggctgaggcaggagaatcgcttgaacctgagaggcggaggttgcagtgagccgatatcgcaccactgcactccagcctggggaagaagcaagacttcatctcaaaataaataaataaatataataataaaaattatccatgtgtagtggtacacacctgtactcccagctactcagcaggctgaggtgggaggatcacttgagtctgggaggtcaaggctgcagtgagccatgatggtgccattgcactcctgcctgggtgacagagtgaaaccctatctgccccactcccaggaaaaaaaaaaacctacagttagatagaagaaataagttctaatgtttcatagtagactagggtgactatacttagcaataatattatgtatatttcagagtaactaagaccgggcatggtggctcatgcctgtaatcccagcacttagggaggccgaggcaggtggatcacaaggtcaggagttcaagaccagcctggccaacatggcaaaaccctgtctctactaaaaatacaaaaactagccatgtggcgtgtgcctgtaatcccagctacttgggaggctgaggcaggaaacttgcttgaacccagagggcagaggttgcagtgagccgagttcgtgccactgcactccagcccggcaacagagcaagactccacctcaaaaaaaaaaaaaacacacacacacacacacatatatatagagagagagactcaaataaaatggattaaagttaaaataaataaataaataacaaatataaccagagcacaagatcataagacatgcttcaaactgagaaagaaaccaaaacaaaacacacagagataaggaactgagaggaaacaaagcaacacaggaaataaaagaaaaacctgaaagaactgtaattaacatccttaaagacataaaacattgtgtgtgtaaaacaggaacaggaggtgattaaaaaaatgagaattagaaagaactttcagaaattaaaaacagcaaagccgaatgtttaaaaatttactagcaatattaaaaatgaagttaaagaaaatatttttaaaagtaaagcaaaataggagaaaagaaaatgagatgattattggttgaagaaatccaacacccaaataacagacatttcagaaggaaaaagaaaaaaaaaacaggtgaaggaaataagccaataaggaatacaagaaattgccccagaactgacagtctttagattgagtaccttgcacagcacagtcaatcattctgtggccacaccaaggtacagcatcttggtatttcagagcattagcattagaaaggattatcaaaacttgcagagagcagccagttcagggtggcaacgagcagggactgaaggaaggaaatgtattcagcatctcctcacacaaggctctatgctgctcctttacctgggttatctatttgaattacatttaagaaggggcagtggctcatgcctataatcccagcactttgggaggctgaggtgggcagatcactggtgcccaggagttcgataccagcctgggcaacatagcaaaaccaaaatacaaaaattagccaggcgtggtgtattgaacctgtagtcccagctattcatgaggctgaggcatgagaagttcttgaacctgggaggcggaggtttcagtgagcctagattgcaccactgcactccagcctgggtgacagagcaagactctgtctcaaaaataaatacgtaaataaaatttttaaaatgaaaataaaacgattgtttctctacacttgaaagtatgatacagcatactggaacatgtcaagactgtaaattaggagaccttaggaacagcctcaaattagtatcattctaactgtgcaaccttgggcaaatcactaacgtctccagatctcagtgtcctcacctacaaaaaaggtaacttggacaagatcagtggttttccaagtgcagcatgaatatcatcagtggcataaatacaatcttaggtggctcacaaatggataggggttatgttgacagataggtaattttaaaacatgtattagcacatcaaacccatgatatcgtaactattattgtttttgttgaaaaatttttaagttaaagaaaaatattaagtaaatagaggtgcaaggatatgacaaaaatggaaagtttgctactcattaaatcattttaatatccaagattcttcccagctcagttattctgtagtacatcagatagcaaagaaaattttaagaaggaactagtatcagcaatatgcagttatggcagaagctgtacccccaaaatcagagtgctggacgtcagcagaacccctttaacttcattaagtccttgactctcttttttgaccacggtgtttgcctgctactaaaatctctagggcaggagcacggtgacttctatgtcaccatcccacctaccccatgccacattctccatcaacagccccgccccttgtccctgtctccctggtgacacataacaaaggccatcaagctcccaaatcttcaactccatcctctccaagaaggaccccaaaagcatttgtgtcccagcaactgtgaacttttccaggctgccagacagaagtttatctaatggtggtcaagacctgcctggttgaatactagtaaaaacaatccttattcacaatttattgctatatctacttcatcttctctcctccacaagattttccttttacttttaaaagaggatgcatgaaaacttcataaagtagtttgcttccagactaagaagaaaggaggctgggtgtggtggctctgcctgtgatcccagccctttggaaggccgaggcaggcagatcacctgacgtcagtcgttcaagaccagcctggccaacacggtgaaaccccgtctctactaaaaatacaaaaattagccgggcgtggtggtgggtgcctgtaatcacagctattagggaggctgaggcacaagaatggcttgaactcgagaggcagaagttgcagagagccgagatcgtgccaccacactccagcctggtgacagtggagtaggccacatgcatctgtggtcctgagtaaatgcccttgggcccattttcaaaagcctgttgggagaaagcctgttactcctccactgagagtctcagacccagctcagatggagacagggagaggtgcaggtggatcaagcccaagctccggacttcccagctacctcctgaacctcatcatcccacagctcccaaaggaccccagttacctcggaacagctccagaaactgagggctgtttgctcagcgccccagcatctgtgcagagcaccggaaaagctcaccaact

SEQ ID NO: 2306 - DNA, 40797 bp, Homo sapiens
  source 1..40797: mol_type = genomic DNA
ggcaagactattgctggttcattttgccaaatcagagatcacagcaagtccaggccagaggctgtttgcgtctgcctgtgttggaggtcccctgcgcagttgggacctaaaagatcttcagggattgggtaaggcactgaatcacctgcagagttagacaggaccctagaggttgtcttcttccatccaggcacagcttatggttgctgttttttcccagttccaggaaccaaatggtgataaactaggaatggagagagggcttgctgctgtctgagagctcaggtacaggtcatggaagatggatgagaggacattcgcctggggcttttgaggaattctttgattccctgccatccttgagttgggtgaggacagaggtggcttcttgcatccttcttccaaggccaggtgaggagctggactctgatcacatgaggtcttttatttggggcggctctgctctactcccctctgccttggcagctggctgaacagacacagtgacagccactcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggacgctcagagagcccagcgcggtgaggaaagcgacgaacttaggagccctggtctgggtccagccaccccttactacctatttgaccttcatcaagctctttgacctttccaggctttagtttcgacatcaataagatgaattaatagctgggcatggctcgcgtctgtaatcctagtactttgggaggccgacgtgggtgtatttgcctgagctcaggagttccagaccagcctgggcaatatggtaaaaccccatctcgccaggcgcggtggctcacgcctgtaatcccagcactttgggatgccaaggtgggtggatcacttgaggtcgtgagttcgaaaccagcctggccaatatggtgaaatctcatctcttctaaaaatacaaaaattagctgagtgcggtggtgtacacctgtaatcccagctactcgggaggctgaggcaggagaatcacttgaatccgggaggcggaggttacaatgcgccaagatcacgccactttactccagcctgggcaacacagaatgtctcaaaaacaacaaacaaacaaacacaagaatcacctgctctgggaagtgcagtttcttccagcctacctaggccaggagcaaagtcagctcatcaatttttgccagcgcctcccttttcagaaattcttttctcaataaaagatgagaccctctcttttcttttaaaaggatgatttgtgtcctgtgtcttgtctgtctgctctgtccacaaaactgatgaaagctccactgcaaggcaaagttaatgttcccctcccacttctcaagaactcagaaatggaaatataactctgcactcagagagttaaaatagaaaacaagcaacagatccaagtggagacatgcagatcacacaagagatcggactctccaggatccagccttgccgctaaactcaccaagggtattaacatatctaaggaaaaggccgggcatggtggctcgtaatctttgggaggccgaggtgggtggatcacctgaggtcaggagtgcaagaccagcctagccaacatggtaaaaccctgtctctactaataatacaaaaattagctgggtgtggtggtgcacgcctgtaatcccagctattccagaggctgaggcaggaggttcccttgaacccaggaggcggaggttgcagtaaaccaagatggtgccattgcactccagcctgggcaacaagagcgaaactctgcctcaaaaaaaaaaaaaacatatctaaggaaaaaggtgggtcagtccaggatgccaagcaaagggagagttgagacccacaaactggaataacttgaataacgagtggatcagctgaggtcaggagttcaagactaacctggccaacatggtgaaaccccatttactgaaaatacaaaaaattagccaggcatggtggtgtgcatctgtagtcccagctactcgggaggctgaggcacgagaatcgcttgaacctgggaggtggaggttgcagtgaggcaagatcataccactacactccagcctgggcgacagaaattctgtcaaaaaaaaaaaagaagaagaagaaagaaaagaaaagaggagaatttcctgatgaagcataagtgtctggtccgaatgataacagcattctgactttcttgtttacacatctatcccttatgaatttgttcagtgtgtattgatcctgcggagtcctatcacttctgggtctacaaacagtaaacttcggagcgtataaaagcctacagaatatgctaacaaaactaaaatactgccaccatgtgggcctttccacaagcttaactgtcagtccccaaggcatttgtgtatccgatcaatatgtaaatgaacgagcagactctcttggatacaatgtggagaagactctaccaaaggtcactttccccaagccactgataacctttaaccagctcaaacccgtctgagctcaccacataaaacacccaaggatcctgcccactcccacaataccccatctccctcagcccaacaaaaacatcctcaggaaagttctctccaataaactcactgaaataaaactctagcagtatttgagcacctagggctgctctcctcgaaagatccctcccctaccaacacggagcctggtgtcagtccatctcagagtacctaacctcagttatcctttgcttctggccaaaatgcaagacccaaaaatcagatttttttgatgatgctcccttcttttggactctttctactcctttccatttcactctctccaaacttccttccttaaaatcaaatttttttttcttttttcttttttttttttttttttttttgagacggagtctcgctctgtcatccaggctgaagagcaatggcggtatctctgctcactgcaagctcctccccctgggttcaagtgattctcccgcctcagcctcccgagtagctgattacaggtgcgcaccaccatgccagctaattttttttttttttgagacagtctcactctgtcactcaggctagagtgcaatgacacaatctctgctcactgcaacctccacctcccaggttcaagcaattctcctgcctcagcctcccaagtagctagaagtacaggcatgcgccatcgcgcccagctaatttttgtatttttagtagagacagggtttcaccatgttggccaggatggtctcgatctcgacctcgtgatccgcctgcctcagcctcccgagtgctgagattacaggcatgagccacctcgcccggccaacagctaatttttgtatttttagtagagatggaatttcgccatgttgaccaggctggtttcaaactcctggcctcaagtgatccaccagccttagcctcccaaagtgctgggattataggcatgagccaatgcacctggcctcccctctctttttaacctctccacacttcttccttctgtgtgcaaaacaagtctctccatcctaaaaagaaacctgtggcccctgtggttccctccagctatctcgatgttctttttctcaaatcacactcagagcctttaatcagccaaacctggctccaattcatcacctgtatttcatttttctttctcttttcctttctttctttttttttttgtgtgtgtgtgttttttgagacaacatctaactctgtcacccaggctggagtgcagtggtgcgatcttggctcagtgcaatctctgcttcccaggttcaagtgttctcctgcctcagcctcccgagtagctgggactacaggctcatgcccggctaattttttgtatttttagtagagacagtgtttcaccatattggccaggctggtctcaaactcttgaccttgtgatctgcctgcctcggcctcccaaagtgctgggattacaggtgtgagccaccatgcccggccgtctatttcatttttctactcccagaaatggggtttctcttctcagcatgttactgaaactgctcaaaggtgaccttgtaatttccaaatcccatggacgattatgcatctgcatgtctcttgccctcaccctgccatgtggctccttttatttttcaaaccccttgttttggcccctaagatggctctatcccaattctccttctcagcttatgtcacgaggccctgagtatcatggcagaggggagaacggggaaccatgagaaacaggggggcaaagggcagcacggaatgtgttcccagttttgctggaggctgcccagtccatttcaggtttccttgctcatgttggcccctggaaaggcacatgatcccttgcaccagagacctgagtggtcaattcatgagcattcagtcttctaccagctaagatctgagtcaggccagagcaaaggaggtgggaggaacagagaggagagctgggctcaccggcagcagcctggctctgatctccatgtagagcacgttgtcctcgtagaactcctgcatgctccggaagacatagtctctgaacactggtgcgtaatggatgagaccagagatggtgaagaagatggtttcaaatttcgaccagacaacattttggtttgtgtaaatcacctccgggtgctgggtcaccagagtgaaattcctcagcaagctgtccaagacacgaagtggggagtggcagaggcatgatccaggacactgcccccgggcgcccataggactgctacccaccttgcatatcccagctagcagctcacaggattcaccctagagtggagataaggaaggggcaaaggggagcattcccacgctcacgatataagcatgggtcctgtggccaggcagcccactgcctgcttaaacccaaaccccaaacgcaggagactgcttaagatgagagctcaccagtcagtctctcctggctcctgtcctccctctgtatgcttggccagtctgaccccactgtactttctagaccaaaaagctctctctctctctctttttttcttcctatacccactgacaggaaactagaccaagctctttttggggaatgttatggactaacttgtgtccccaaacccccaaattcaaatattgaagccctagccctcatttggagaagggaattttaaagagatgattaagactaaatgaggttgtaaggatggggctctaccctaataagatgggtgtccttgtaagaagaggaggccaggcgtggtggctcacgcctgtaatcccaacactttgggaggccaagatgggtggatcatttgaggtcaggagttcgagatcagcctggccaacatagtgaaaccccatctctactaaaatacaaaaatcagccaggcgtggtggtttgtccctgtaatcccagttactagggaggcaagagaattgtttgaaccctggaagtggaggttgtagtgagctgagatcgcaccactgtactccagcctgggcgacacagcaagactcatctcaaaaaaaaaaaaagaagaagaagaagagaccgcaggagtgcacatacagaggaaaggccatgtgagtacacagccagaggcgccttctgcacgccaaggacagaggtctcaggaggaaccacccctgccctggcaccttgatcttagacttccagcctccagaaccatgagaaaatcaattccttcttttttttttttttttttgaaacagggtctcactctgttgcccaggctggagtgcagtgtcacaatcacagctcgctgcagcctcaatctcccaggctcaagcaatcctcttatgtcagccccctggggtagctgagactataggtgtacaccaccacatctggttaattttttattttttgttgagatggggatctcactatgttgcccagactggtctttctttctttctttttttttttaaacagaatcttgctctgtcgcccaggctggagtgcagtagcatgatctcagctctctgcaacctccgcctcccaggttcaagtgattctcctgccttggcctcccgagtagctgggattacaggtggctgccagcatgcacggctaatttttttgtatttttagtagagacagggtttcaccatgttggcctggctggttttgaactcctgacctcaagtgatccgcccacctcggtctcccaaagtgttaggattacaagcatgagccaccacacccggccaccaggctggtcttgaactcctgggtgcaagtgatcctcccacctcagcctcccgaagtgctaggattacaggcatgacccagtgtgcccggcttgagaaaatcagttcctattgtttaagctccccagcctgtggtattctgttatggcagctcgagcaggttaatgaagggagtggaatggaaataactcgaatcagcacccaggtttgtatccccaactggccatttaccagctgtgtgtccttgcataagctaattaaccttgctcagcttcacgtttctcatttcataaagggaagtaacctcaggggggcactctgtagacatttctgtgaccaaattaattgtcacttataatattactatacaatgccaggcacaatggctcggctcatgcctgtagtcctagcactttgggaggccaaggtgagaggacggcttgagccgcagagttcaagaccagcctgggcaacacggcaaaaccccatctcacaaaaaatacaaaaattagctgggcatgatggtgcacacctctagtgtgctgacacaggaggattgcttcagctgacacaggaggctgacacaggaggattgcttcagcctgggaggttgagtctgaagtgagccgagattgtgccactgcactccagcctagatgatagaatgagaccctgtcttaaatagtaataataataatgatactatacaagtctgttaggaagttgctgcatcagattttcaagaagatttatcttccagctagattgtcatcacttcagagctaggaacttttattctctctggttttattgagcatcagacaaatctcatttgctacagcaatagtgttgctgactaggcatggtcactcatgcctgtaatctcagcactttgggaggccaagatgggcagatctcctgaggtcaggagttcaagaccagcctggccaacatggtgaaaccctgtctctactaaaaatacaaaaattagccaggcatggtggcacatgtctgtaatcccagctactcagaaagctgaggcaggaaaatcacttgaacccgggaggcagaggctgctgtgagccaagatcaggctgctgtgagccaagatcacgccactacactccaacctgggtgacagagcaagaccctgtctcaaataataataataataaataacaataataataacaaacaaaaatagtgttgctgataatgctttttgtagattttaaatgcaccagaaaaactactatggatagaaaaggtgttgaatgcttttgtggagcaaagtatcctgcaaggttaaaagaaaaaggtgctcatgctttttttttgagatagggttttattttgtcactcaggctggagtacagtggctccatctcagttcactgtggcctcaacctcctgggttaaagtgatcctcctgggttaaagtgatcctcctgcctcagcctcccaagtacctgggactacaggtgcagcaccacacctggctaattttttgtatttttggtagagatgggctttcaccatgttgaccagactggcaactcctgggctcaagtgatccgctcgccttggcctcccaaagtgctgggattataggcgtgaaccaccgcactcagccttgcctcatgttttattaaagccagatttttatctataggtttgtaccaagggagacacctacccactgccaccccatgacaggcctgggacatgtgctttctgaactactactcacctgtcatcaaactcagtgacgttctgcacccgcttccgataatcctccagcagaatccacttggaacatttttctgatggacggggagttgggtgagcaaatctgaactgcatgatcccccttggggtgaaacagatgtggcagtgaggcctgtaggtgacattcctcaccagccagtccatagtcacgatgccaatgtcatggaggtgcaaggcagcccctggagagggaagaagaatggtgaagacaaaggggtgaagtcccatcccaggactccagggcttggggacaaaggagggggtgaagtcccatcccaggactctggggctgtggggacaaaggggtgaagtcccatcccagggctccggggcttggggacaaaggggtgaagtcccatcccagggctccggggcttggggacagtgtggatcacaagaagacgtgcaagcagaaggatttctgtccagacatgtttctcggaacttgtttaaggctctagtttaaggatggggcttccatgtctcactaatcaggagccaggggtgatcttgtccaagaggggcagcatgggagagtgagagggcatcaggcttggaaccagagaactgaggttcaagtcagggctccattggcttctagctctccaatgggagcccaggcctttcaatgaggccacccaacactgcatgacgggatacactgggatgagccccagggccacggtccttttcacacacttgtcctccatcctctcatcctgcccctcaactcctctcccactggcttttcatcccctgcgctgggcctgtgtctgtacagcttctggcctgcaggctttgccagttgaatccccatgcttgtcctccccaccagacaccagctgtgccccttgctcccctaggcacagtgcatgctgtccctctgcgcttcttgtgcccatccagcccctggccctgacacgagcccccagacaccctcttatgcctcccagcaactggggatgctactttactgacctcacgattattattattttttaaatctctatttataacattaaaagaaaaaaaaacagctgggcacagtggctcactcctgtaaccccagcactttgggaggccgaggcaggcagatcacgaggtcaggagttcgagaccagcctgactaacatggtgaaaccccatctctactaaaaatacaaaaattagccaggcatggtggcatgtgcctgtaatcccagctactcgggaggctgaggcaggagaattgcttgaacctggaagaaggatgttgcagtgagctgagatcacgccaccgcactccagcctgggcgacagaacaagactccgtctcaaaaaaaaaaagaaaaaaaaagaaaaaaaaaaaacaggtgttaagtctttgtaaactgcaagctgctattatttttacattttaaattaacatttttggccaggtgcagtggctcacacctgtaatcccagcactttgggaggccgaggagtgtggattgcctgagctcaggtgttcgagatcagcctggccaacatggtgaaaccccgtctctactaaaagtacaaaaattatccaggtgtggtggttcatgcatgtaatcccagctactcaggaggctgaggcaggagaatcacttgaacctgggaggcagaggttgcagtgagccaagatcacaccagtgcacttcagcctgggcaacagagtgagactctgtctcaaaaaaaattttttttaataaaaaaaaaaattaacattttttggggaacagggtcttgctctgtcgcccaggctggagtgcagaggtgccatcatagctccctgcaaactccacctcctgggctcaagcgatactctccactcagcctccagagtagctcggattacaggtgcaccaccacccctggctatttatatgtgcgggatgctaattatttcatgtttcatggaggtgtgtttatactactccaggatgctatatcacattgtatcctatgtggtagcttagcccctgggaaaactaaaaagggaatagcaaagtctcagggctggatgcttttccaatcctgactgtctgcgagtcccccaggaagcaggggttttggttttcaacacccttttcctagtctacccataaggacagaggagcagaacagctgagtgaggctttctctgctccatctagaatagcaacagccacaagcacagtaatagccccaagatgagtccctctaccttcccagcaccccaagccacccctttccaaaccttaccttttggcatcatccttagaatattaaacacttgacttctctcaatgagatgcttggcctggaaaaagtgcatgctgggtgggaatatcagggtcctcatggcctccttcatctcagcgattttgagcgtcatgagcctctcattggccagctcctccttggtgttcagcaccagccgcccccccagccgcatcatcttttctttcaacaacagatgcgcccgtgtttcatctatggatagagctgagccgaagaaagacattgccacagccaacagcaagaagcacagggctggccgctcagatgggccatccaccaacatcgggatgcctggactaggaaagggctcagatggagactccacgggactgcaaaggagagtgggggagtgaaaacctacagatttaagggtggaactctgatcttccttttctcgccctgctctcagattaccagaaggcaagatattgaaggattcttcttccagaccccagagaaaagacctacaggtacagacaggtaggggtttcccaatttttttttttttttttttgagacggagtctcgctctgctgcccaggctggagcacggtggtgcaatctcggctcactgcgagctccgcctcctgggttcacaccattctcctgcctcagcctcccgagtagctgggactacaggtgcccgccaccatgcccggctaattttttgtatttttagtagagacggggtttcactgtgttagacaggatggtcacgatctcctgacctcgtgatctgcccgcctgggcctcccaaagtgctgggattacaggcgtgagccactgcaccacctggcatttttttttttttttgagatggagtttcactcttgttgcctaggctggagtgtaatggtgtgatctcggctcactgcaacctccgcctcccgggttcaagtgcttctcctgcctcagcctcccaaatagctgggattacaggcatgcatcaccacgcccggctaattttgtatttttagtagagacggggtttctccatgttggtcaggctggtctcgaactcctgacctcaggtgatccgccagcctcagtctcccaaagtgctgggattacaggcatgagtcaccgcgcccggcaggttttcccaaattaaaggtcaccatgaggtcaaacaagccctggctcatgcataaagacactgcaatctgatttttagtggttcacttttattttattttatttattttaatttttgttttttttaagacagagtcttgctctgtcacccaggctggactgcagtgacgtgatcttggccctctacaacctccgcctccagggtttaagcgattctcgtgcctcagcctcccaagtggctgggactacaggcacgcgtcaccatacccagctaatttttgtatttttaatagagaccatattggccaggctggtcttgaactcctagcctcaagtgatccactcatctcagcctcccaaagtgctgggactacaggcatgagccaacatgtccagccagtgttttacttttaaatataaccagcatgcctgtggtcccagctattcaggaggctgaagcgggagcatcacttgagcccagtactttgaggctgcaatgagctttgacctcaccactgcactccagccttggcaacagatcaagaccttgtctctaaaaaaaatatttttttattaaaaaataaaaatacggctgggcgcggtggctcacgcctgtaatcccaacacttcaggaggccgaggcgggtggatcacgaggtcaggagtttgagaccagcctggccaatatgatgaaaacccgtcctactaaaaatacaaaaattagctgggcatggtgacgcatgcctgtagtcccagctgtttgggaggctgagacaggagaatcacttgaacccaggaggcagaggttagaataagctgagttcgcgccactgcactccagcctgggcgacagagcaagactcaatctcaaaataaataaataaaattaaaataagaccaggtgctggcacagcaggtggattgctcaagcccaggaattcaagaccattctcagcaacatgttgaaactccatctctacaaaagatacaaaaattagctgggcgtggttgtgcacacctatagtcccagctactggggaggctgaggtgggaagttcacctgagcctgggaaatcgaggatgcaatgagccaaaattgcgccactgcaatccaacctgggtaacaatgtcatatcctctctaataaataaatgaattggccaggcgcagtggctcacccctgtaatcccagcactttgggaggctgaggtggacggatcacgaggtcaagagatcgagagcatcctggccaacatggtgaaaccccgtctctactgaaaatacaaaaattagctgggcgtggtggcatgcacctgtagtcccagctactcaggagcctgaggcaggagaattgcttgaatccgggaggcggaggttgcagtgagccaagatcgtgccactgcactccagcctgccaacagagtgagactccgtctcaaaaaaagaggaaaaaaaaattaattaattaattaattaaatagcaaagaaacaattaacagaatgaagagacaacctatttttttcttttcttttcttttcttttcttttgtgggggacggagtttcgctcttgtcaaccaggctggagtacaatggcgcgatctcggctcaccgtaacctcctcctcccaggttcaagcgattctcctgcctcagcctccagactagctgggattacagacacgtgccaccacgcccggctaatttttttatatttttaatagagatggggtttcaccacgttggttaggctggtctcgaactcctgacctcaggtgatccaccagactcggactcctaaagtactggcattacagacatgagccaccgtgcccagccttttcttggctcactgcaatctccgtctccctggtccaagtagttcttctgcctgagcctcccagctcctgagtagctgggactacaggcatgtgccaccaggcccggctaatttttttgtatttgtagtagagacggagtttcactatgttgcccaggctggtcttgaactcctgacctcaggtgatcctcctgccttggcctcccaaagtgctgggattacaggcgtgagtcaccatgcccggccaatctcttgaataggagaaaatatttacaaattagttatctgatggagagctaatatccagactatataaggaaatcaaacaactcaacagtaaaaggacaaataatctcacttaaaaaatggccaaagacccaaagacatacaaaatggccaatacgtatacgaataaatgcccaaatttttttctttgctttgctttctttctttcttttttttttttccttgagacagggtcttactctgttgcccaggctggaatgcagtagcgtgagtccacttggttggactccaaagctcgctgcagcggcaacctcccggcttcaaggaatcctcccaccctagcctcctgagtagctgagtgtagtaccactacactcagctaattttttttttttctttagagacagggtctcactatgttgccatggctggtctcaaactcctgggctcaagcgatcctcctgcctctacctcccgacattctgggattatagatctgagccaccaggcccagccaacattttttctaatcactgggggagtgcaaatcaaaactacaatgagatcgtctcaccccatctcaaaaaatggctattacttaaaaggcaaaaaataacagatgctggtgaggatgtagagaaaagggagctccttacaccactggtgggagtgtaaactagtacagccactatggagaacagtatggatatttcttgaaaaactaaaaatagaactaccatacgatccagcaatcccattactgggtatctatccaaagggaaggaaatcagtatgtcaaagggatacctgtactcggatgcttattgcagcactattcacaatagcaaagttatggaaacaacccaagtgtccaccaacagatcaacggataaagaaaacgtggcaagtccatctaccgaagcaccggggagtgtcgtggatgcctacgagcaggtacaaaaaggacttctaaagctgaaaggcgtcgcagagctcagagtgaccaagcggaagaagaaaaagaaggacaaagacaaagctaaactcccggaatcaatgggaatgaacaaaaagaatgaggaggagaagcagcacggcctggacaagtggaccccggcccgcgcagcctttgagaaaatgcaggagaagcggcaatggaaaggatcctcaagaaagcatccaggccaggcttggtgactcacgcctgtaatcccagcacttcaggaggctgaggcgggtggatcacctgaagtcaggagttcaagaccagtctggccaacacggtgaaaccccgtctctattaaaaatacaaaaaattagctgggcgtggtggtgtgtgcctgtaattccagctactcaggaggctgaggcaggagaatcgcttgaacccggtagggagaggttgcagtgagccaagattgttccattgcactccagcctgagcaacaagagcgaaactctgtctcaaaaaaaaaaaaaaaaaaaaatagcatccaaaacccacaagcagagagtggaggacttcaacagacacctggacacactcacggagcattacattcccagagtcagctggacgaaatagccgcctgcccccagtagggagcagcatcgagggttggcaaaaggccatgctggggttgtgtgtgtttcctttggtatattctagaaacatggctttacacacaccctcgcatcttctgctacaaactgcttttcgaagctgtgtaccctcattctgtaacttgattaaagtaaaattgtccttgtactcagtttaggtttcttggcaacatatagaagatacacccttttagttcggatggaaagtttctaagtttattcagaggtaaagcccatttctgtgtccgtaccatgtaaaaatgtttttatccccgagttgcatctaacgctctgaggccagccagctgtcttctccaggatcagatggactccagaggataaggagctaatgccagggtggcctgtagtatgcagagctccgcaggacccagcatgggtgcccctccaagcttcctctagcttggggcctatgctggtcctgcaggccccagggaagccatttgcaactctgtggccttcagacttcctcctcagccactggccactgagacagcacagcctgggtggcagaacagccacctaaggcaagaatggaaggaaacactttgttcctttctgagcccattccccaaaaccctccttccaggtactcctaatgggtattgccatggcagacattgctaatggatcacagcattctttgaaatggagcccagatatagcctgcctgtcaatcctcagctgggggctcctagcagcctcttgtatttattcagagttgacacatcacacggagcctgtctggcattcctaccctaaggacacctcaggggtgacaggaccagggcagagccccagtacaaacagacatgggtgcagtcaaatgggagggcccaggcatccgtcttggagggctgggattttgtagggcctgtgtgtcctggttgaggatcaaaccgcatatgctattgggagaaacaatctctgtggacatacatactgaaagaataacaaaggcagaagagaaaaacaaagtgtggaatttggggttctcctgtgtaaattacacaagaaagcagaagccagttatttaaaaaagaaagaaaatgtggcatatatacacaatggaatactactcagccattaaaaaatgaaatcacgggctgggcacggtggcttacgcctgtaatcccagcactttgggaggccgaggcaggaggcaggtggatcacgaggtcaggggtttgagaccagcctgaccaacatggtgaaaccccgtctctactaaaaatacaaaaattagctgagcgtggtggcggatgcctgtaatcccagctactcaggaggctgaggcaggagaattgcttgaacccaggaggcggaggttgcagtgagccgagatcatgccattgcactccagcctgggcgacagagcaagactccgtctcaaaaaaaaaaaaagaaaaaagaaatcacgtcatttgcaccaacatgcacggaactagaagacataatgttaaatgaaataagccagacacagaaggacaaacaccgtatgttcccactcatgtgtgagagctaaggaagttgatctcatagatatagagaatagaaagatagacaccagagactatgaagggttggggtagacatgggggatgaagagaagttggttatgggtacaaatagacaagcacttcaagaggctgaggcaggagaatcacttgagcctagaagttgaagactggcctgggcaacaaagcgagacccccatctctacaaaaaatttaaaaattatcggcaggcagatcacgaggtcaggagttcgagaccagcctgaccaacatggtgaaaccccatctctactaaaaatacaaaaattagtcaggcgtggtggcgtgcacctgtaatcccaactacacaggaggctgaggcaggagaatcgcttgaacctgagaggcggaggttgcagtgagccgatatcgcaccactgcactccagcctggggaagaagcaagacttcatctcaaaataaataaataaatataataataaaaattatccatgtgtagtggtacacacctgtactcccagctactcagcaggctgaggtgggaggatcacttgagtctgggaggtcaaggctgcagtgagccatgatggtgccattgcactcctgcctgggtgacagagtgaaaccctatctgccccactcccaggaaaaaaaaaaacctacagttagatagaagaaataagttctaatgtttcatagtagactagggtgactatacttagcaataatattatgtatatttcagagtaactaagaccgggcatggtggctcatgcctgtaatcccagcacttagggaggccgaggcaggtggatcacaaggtcaggagttcaagaccagcctggccaacatggcaaaaccctgtctctactaaaaatacaaaaactagccatgtggcgtgtgcctgtaatcccagctacttgggaggctgaggcaggaaacttgcttgaacccagagggcagaggttgcagtgagccgagttcgtgccactgcactccagcccggcaacagagcaagactccacctcaaaaaaaaaaaaaacacacacacacacacacatatatatagagagagagactcaaataaaatggattaaagttaaaataaataaataaataacaaatataaccagagcacaagatcataagacatgcttcaaactgagaaagaaaccaaaacaaaacacacagagataaggaactgagaggaaacaaagcaacacaggaaataaaagaaaaacctgaaagaactgtaattaacatccttaaagacataaaacattgtgtgtgtaaaacaggaacaggaggtgattaaaaaaatgagaattagaaagaactttcagaaattaaaaacagcaaagccgaatgtttaaaaatttactagcaatattaaaaatgaagttaaagaaaatatttttaaaagtaaagcaaaataggagaaaagaaaatgagatgattattggttgaagaaatccaacacccaaataacagacatttcagaaggaaaaagaaaaaaaaaacaggtgaaggaaataagccaataaggaatacaagaaattgccccagaactgacagtctttagattgagtaccttgcacagcacagtcaatcattctgtggccacaccaaggtacagcatcttggtatttcagagcattagcattagaaaggattatcaaaacttgcagagagcagccagttcagggtggcaacgagcagggactgaaggaaggaaatgtattcagcatctcctcacacaaggctctatgctgctcctttacctgggttatctatttgaattacatttaagaaggggcagtggctcatgcctataatcccagcactttgggaggctgaggtgggcagatcactggtgcccaggagttcgataccagcctgggcaacatagcaaaaccaaaatacaaaaattagccaggcgtggtgtattgaacctgtagtcccagctattcatgaggctgaggcatgagaagttcttgaacctgggaggcggaggtttcagtgagcctagattgcaccactgcactccagcctgggtgacagagcaagactctgtctcaaaaataaatacgtaaataaaatttttaaaatgaaaataaaacgattgtttctctacacttgaaagtatgatacagcatactggaacatgtcaagactgtaaattaggagaccttaggaacagcctcaaattagtatcattctaactgtgcaaccttgggcaaatcactaacgtctccagatctcagtgtcctcacctacaaaaaaggtaacttggacaagatcagtggttttccaagtgcagcatgaatatcatcagtggcataaatacaatcttaggtggctcacaaatggataggggttatgttgacagataggtaattttaaaacatgtattagcacatcaaacccatgatatcgtaactattattgtttttgttgaaaaatttttaagttaaagaaaaatattaagtaaatagaggtgcaaggatatgacaaaaatggaaagtttgctactcattaaatcattttaatatccaagattcttcccagctcagttattctgtagtacatcagatagcaaagaaaattttaagaaggaactagtatcagcaatatgcagttatggcagaagctgtacccccaaaatcagagtgctggacgtcagcagaacccctttaacttcattaagtccttgactctcttttttgaccacggtgtttgcctgctactaaaatctctagggcaggagcacggtgacttctatgtcaccatcccacctaccccatgccacattctccatcaacagccccgccccttgtccctgtctccctggtgacacataacaaaggccatcaagctcccaaatcttcaactccatcctctccaagaaggaccccaaaagcatttgtgtcccagcaactgtgaacttttccaggctgccagacagaagtttatctaatggtggtcaagacctgcctggttgaatactagtaaaaacaatccttattcacaatttattgctatatctacttcatcttctctcctccacaagattttccttttacttttaaaagaggatgcatgaaaacttcataaagtagtttgcttccagactaagaagaaaggaggctgggtgtggtggctctgcctgtgatcccagccctttggaaggccgaggcaggcagatcacctgacgtcagtcgttcaagaccagcctggccaacacggtgaaaccccgtctctactaaaaatacaaaaattagccgggcgtggtggtgggtgcctgtaatcacagctattagggaggctgaggcacaagaatggcttgaactcgagaggcagaagttgcagagagccgagatcgtgccaccacactccagcctggtgacagtggagtaggccacatgcatctgtggtcctgagtaaatgcccttgggcccattttcaaaagcctgttgggagaaagcctgttactcctccactgagagtctcagacccagctcagatggagacagggagaggtgcaggtggatcaagcccaagctccggacttcccagctacctcctgaacctcatcatcccacagctcccaaaggaccccagttacctcggaacagctccagaaactgagggctgtttgctcagcgccccagcatctgtgcagagcaccggaaaagctcaccaactgtttcacttcctgttggggtaggttttatttccctccagtgtgcaccagggatccaactagaggccggggagaggggctctgcagtgctgaggcagccagagtggcaagtgtgtggcttacatgcatgcttgctgtgtgcatctgagttt

SEQ ID NO: 2307 - DNA, 43066 bp, Homo sapiens
  source 1..43066: mol_type = genomic DNA
ggcaagactattgctggttcattttgccaaatcagagatcacagcaagtccaggccagaggctgtttgcgtctgcctgtgttggaggtcccctgcgcagttgggacctaaaagatcttcagggattgggtaaggcactgaatcacctgcagagttagacaggaccctagaggttgtcttcttccatccaggcacagcttatggttgctgttttttcccagttccaggaaccaaatggtgataaactaggaatggagagagggcttgctgctgtctgagagctcaggtacaggtcatggaagatggatgagaggacattcgcctggggcttttgaggaattctttgattccctgccatccttgagttgggtgaggacagaggtggcttcttgcatccttcttccaaggccaggtgaggagctggactctgatcacatgaggtcttttatttggggcggctctgctctactcccctctgccttggcagctggctgaacagacacagtgacagccactcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggacgctcagagagcccagcgcggtgaggaaagcgacgaacttaggagccctggtctgggtccagccaccccttactacctatttgaccttcatcaagctctttgacctttccaggctttagtttcgacatcaataagatgaattaatagctgggcatggctcgcgtctgtaatcctagtactttgggaggccgacgtgggtgtatttgcctgagctcaggagttccagaccagcctgggcaatatggtaaaaccccatctcgccaggcgcggtggctcacgcctgtaatcccagcactttgggatgccaaggtgggtggatcacttgaggtcgtgagttcgaaaccagcctggccaatatggtgaaatctcatctcttctaaaaatacaaaaattagctgagtgcggtggtgtacacctgtaatcccagctactcgggaggctgaggcaggagaatcacttgaatccgggaggcggaggttacaatgcgccaagatcacgccactttactccagcctgggcaacacagaatgtctcaaaaacaacaaacaaacaaacacaagaatcacctgctctgggaagtgcagtttcttccagcctacctaggccaggagcaaagtcagctcatcaatttttgccagcgcctcccttttcagaaattcttttctcaataaaagatgagaccctctcttttcttttaaaaggatgatttgtgtcctgtgtcttgtctgtctgctctgtccacaaaactgatgaaagctccactgcaaggcaaagttaatgttcccctcccacttctcaagaactcagaaatggaaatataactctgcactcagagagttaaaatagaaaacaagcaacagatccaagtggagacatgcagatcacacaagagatcggactctccaggatccagccttgccgctaaactcaccaagggtattaacatatctaaggaaaaggccgggcatggtggctcgtaatctttgggaggccgaggtgggtggatcacctgaggtcaggagtgcaagaccagcctagccaacatggtaaaaccctgtctctactaataatacaaaaattagctgggtgtggtggtgcacgcctgtaatcccagctattccagaggctgaggcaggaggttcccttgaacccaggaggcggaggttgcagtaaaccaagatggtgccattgcactccagcctgggcaacaagagcgaaactctgcctcaaaaaaaaaaaaaacatatctaaggaaaaaggtgggtcagtccaggatgccaagcaaagggagagttgagacccacaaactggaataacttgaataacgagtggatcagctgaggtcaggagttcaagactaacctggccaacatggtgaaaccccatttactgaaaatacaaaaaattagccaggcatggtggtgtgcatctgtagtcccagctactcgggaggctgaggcacgagaatcgcttgaacctgggaggtggaggttgcagtgaggcaagatcataccactacactccagcctgggcgacagaaattctgtcaaaaaaaaaaaagaagaagaagaaagaaaagaaaagaggagaatttcctgatgaagcataagtgtctggtccgaatgataacagcattctgactttcttgtttacacatctatcccttatgaatttgttcagtgtgtattgatcctgcggagtcctatcacttctgggtctacaaacagtaaacttcggagcgtataaaagcctacagaatatgctaacaaaactaaaatactgccaccatgtgggcctttccacaagcttaactgtcagtccccaaggcatttgtgtatccgatcaatatgtaaatgaacgagcagactctcttggatacaatgtggagaagactctaccaaaggtcactttccccaagccactgataacctttaaccagctcaaacccgtctgagctcaccacataaaacacccaaggatcctgcccactcccacaataccccatctccctcagcccaacaaaaacatcctcaggaaagttctctccaataaactcactgaaataaaactctagcagtatttgagcacctagggctgctctcctcgaaagatccctcccctaccaacacggagcctggtgtcagtccatctcagagtacctaacctcagttatcctttgcttctggccaaaatgcaagacccaaaaatcagatttttttgatgatgctcccttcttttggactctttctactcctttccatttcactctctccaaacttccttccttaaaatcaaatttttttttcttttttcttttttttttttttttttttttgagacggagtctcgctctgtcatccaggctgaagagcaatggcggtatctctgctcactgcaagctcctccccctgggttcaagtgattctcccgcctcagcctcccgagtagctgattacaggtgcgcaccaccatgccagctaattttttttttttttgagacagtctcactctgtcactcaggctagagtgcaatgacacaatctctgctcactgcaacctccacctcccaggttcaagcaattctcctgcctcagcctcccaagtagctagaagtacaggcatgcgccatcgcgcccagctaatttttgtatttttagtagagacagggtttcaccatgttggccaggatggtctcgatctcgacctcgtgatccgcctgcctcagcctcccgagtgctgagattacaggcatgagccacctcgcccggccaacagctaatttttgtatttttagtagagatggaatttcgccatgttgaccaggctggtttcaaactcctggcctcaagtgatccaccagccttagcctcccaaagtgctgggattataggcatgagccaatgcacctggcctcccctctctttttaacctctccacacttcttccttctgtgtgcaaaacaagtctctccatcctaaaaagaaacctgtggcccctgtggttccctccagctatctcgatgttctttttctcaaatcacactcagagcctttaatcagccaaacctggctccaattcatcacctgtatttcatttttctttctcttttcctttctttctttttttttttgtgtgtgtgtgttttttgagacaacatctaactctgtcacccaggctggagtgcagtggtgcgatcttggctcagtgcaatctctgcttcccaggttcaagtgttctcctgcctcagcctcccgagtagctgggactacaggctcatgcccggctaattttttgtatttttagtagagacagtgtttcaccatattggccaggctggtctcaaactcttgaccttgtgatctgcctgcctcggcctcccaaagtgctgggattacaggtgtgagccaccatgcccggccgtctatttcatttttctactcccagaaatggggtttctcttctcagcatgttactgaaactgctcaaaggtgaccttgtaatttccaaatcccatggacgattatgcatctgcatgtctcttgccctcaccctgccatgtggctccttttatttttcaaaccccttgttttggcccctaagatggctctatcccaattctccttctcagcttatgtcacgaggccctgagtatcatggcagaggggagaacggggaaccatgagaaacaggggggcaaagggcagcacggaatgtgttcccagttttgctggaggctgcccagtccatttcaggtttccttgctcatgttggcccctggaaaggcacatgatcccttgcaccagagacctgagtggtcaattcatgagcattcagtcttctaccagctaagatctgagtcaggccagagcaaaggaggtgggaggaacagagaggagagctgggctcaccggcagcagcctggctctgatctccatgtagagcacgttgtcctcgtagaactcctgcatgctccggaagacatagtctctgaacactggtgcgtaatggatgagaccagagatggtgaagaagatggtttcaaatttcgaccagacaacattttggtttgtgtaaatcacctccgggtgctgggtcaccagagtgaaattcctcagcaagctgtccaagacacgaagtggggagtggcagaggcatgatccaggacactgcccccgggcgcccataggactgctacccaccttgcatatcccagctagcagctcacaggattcaccctagagtggagataaggaaggggcaaaggggagcattcccacgctcacgatataagcatgggtcctgtggccaggcagcccactgcctgcttaaacccaaaccccaaacgcaggagactgcttaagatgagagctcaccagtcagtctctcctggctcctgtcctccctctgtatgcttggccagtctgaccccactgtactttctagaccaaaaagctctctctctctctctttttttcttcctatacccactgacaggaaactagaccaagctctttttggggaatgttatggactaacttgtgtccccaaacccccaaattcaaatattgaagccctagccctcatttggagaagggaattttaaagagatgattaagactaaatgaggttgtaaggatggggctctaccctaataagatgggtgtccttgtaagaagaggaggccaggcgtggtggctcacgcctgtaatcccaacactttgggaggccaagatgggtggatcatttgaggtcaggagttcgagatcagcctggccaacatagtgaaaccccatctctactaaaatacaaaaatcagccaggcgtggtggtttgtccctgtaatcccagttactagggaggcaagagaattgtttgaaccctggaagtggaggttgtagtgagctgagatcgcaccactgtactccagcctgggcgacacagcaagactcatctcaaaaaaaaaaaaagaagaagaagaagagaccgcaggagtgcacatacagaggaaaggccatgtgagtacacagccagaggcgccttctgcacgccaaggacagaggtctcaggaggaaccacccctgccctggcaccttgatcttagacttccagcctccagaaccatgagaaaatcaattccttcttttttttttttttttttgaaacagggtctcactctgttgcccaggctggagtgcagtgtcacaatcacagctcgctgcagcctcaatctcccaggctcaagcaatcctcttatgtcagccccctggggtagctgagactataggtgtacaccaccacatctggttaattttttattttttgttgagatggggatctcactatgttgcccagactggtctttctttctttctttttttttttaaacagaatcttgctctgtcgcccaggctggagtgcagtagcatgatctcagctctctgcaacctccgcctcccaggttcaagtgattctcctgccttggcctcccgagtagctgggattacaggtggctgccagcatgcacggctaatttttttgtatttttagtagagacagggtttcaccatgttggcctggctggttttgaactcctgacctcaagtgatccgcccacctcggtctcccaaagtgttaggattacaagcatgagccaccacacccggccaccaggctggtcttgaactcctgggtgcaagtgatcctcccacctcagcctcccgaagtgctaggattacaggcatgacccagtgtgcccggcttgagaaaatcagttcctattgtttaagctccccagcctgtggtattctgttatggcagctcgagcaggttaatgaagggagtggaatggaaataactcgaatcagcacccaggtttgtatccccaactggccatttaccagctgtgtgtccttgcataagctaattaaccttgctcagcttcacgtttctcatttcataaagggaagtaacctcaggggggcactctgtagacatttctgtgaccaaattaattgtcacttataatattactatacaatgccaggcacaatggctcggctcatgcctgtagtcctagcactttgggaggccaaggtgagaggacggcttgagccgcagagttcaagaccagcctgggcaacacggcaaaaccccatctcacaaaaaatacaaaaattagctgggcatgatggtgcacacctctagtgtgctgacacaggaggattgcttcagctgacacaggaggctgacacaggaggattgcttcagcctgggaggttgagtctgaagtgagccgagattgtgccactgcactccagcctagatgatagaatgagaccctgtcttaaatagtaataataataatgatactatacaagtctgttaggaagttgctgcatcagattttcaagaagatttatcttccagctagattgtcatcacttcagagctaggaacttttattctctctggttttattgagcatcagacaaatctcatttgctacagcaatagtgttgctgactaggcatggtcactcatgcctgtaatctcagcactttgggaggccaagatgggcagatctcctgaggtcaggagttcaagaccagcctggccaacatggtgaaaccctgtctctactaaaaatacaaaaattagccaggcatggtggcacatgtctgtaatcccagctactcagaaagctgaggcaggaaaatcacttgaacccgggaggcagaggctgctgtgagccaagatcaggctgctgtgagccaagatcacgccactacactccaacctgggtgacagagcaagaccctgtctcaaataataataataataaataacaataataataacaaacaaaaatagtgttgctgataatgctttttgtagattttaaatgcaccagaaaaactactatggatagaaaaggtgttgaatgcttttgtggagcaaagtatcctgcaaggttaaaagaaaaaggtgctcatgctttttttttgagatagggttttattttgtcactcaggctggagtacagtggctccatctcagttcactgtggcctcaacctcctgggttaaagtgatcctcctgggttaaagtgatcctcctgcctcagcctcccaagtacctgggactacaggtgcagcaccacacctggctaattttttgtatttttggtagagatgggctttcaccatgttgaccagactggcaactcctgggctcaagtgatccgctcgccttggcctcccaaagtgctgggattataggcgtgaaccaccgcactcagccttgcctcatgttttattaaagccagatttttatctataggtttgtaccaagggagacacctacccactgccaccccatgacaggcctgggacatgtgctttctgaactactactcacctgtcatcaaactcagtgacgttctgcacccgcttccgataatcctccagcagaatccacttggaacatttttctgatggacggggagttgggtgagcaaatctgaactgcatgatcccccttggggtgaaacagatgtggcagtgaggcctgtaggtgacattcctcaccagccagtccatagtcacgatgccaatgtcatggaggtgcaaggcagcccctggagagggaagaagaatggtgaagacaaaggggtgaagtcccatcccaggactccagggcttggggacaaaggagggggtgaagtcccatcccaggactctggggctgtggggacaaaggggtgaagtcccatcccagggctccggggcttggggacaaaggggtgaagtcccatcccagggctccggggcttggggacagtgtggatcacaagaagacgtgcaagcagaaggatttctgtccagacatgtttctcggaacttgtttaaggctctagtttaaggatggggcttccatgtctcactaatcaggagccaggggtgatcttgtccaagaggggcagcatgggagagtgagagggcatcaggcttggaaccagagaactgaggttcaagtcagggctccattggcttctagctctccaatgggagcccaggcctttcaatgaggccacccaacactgcatgacgggatacactgggatgagccccagggccacggtccttttcacacacttgtcctccatcctctcatcctgcccctcaactcctctcccactggcttttcatcccctgcgctgggcctgtgtctgtacagcttctggcctgcaggctttgccagttgaatccccatgcttgtcctccccaccagacaccagctgtgccccttgctcccctaggcacagtgcatgctgtccctctgcgcttcttgtgcccatccagcccctggccctgacacgagcccccagacaccctcttatgcctcccagcaactggggatgctactttactgacctcacgattattattattttttaaatctctatttataacattaaaagaaaaaaaaacagctgggcacagtggctcactcctgtaaccccagcactttgggaggccgaggcaggcagatcacgaggtcaggagttcgagaccagcctgactaacatggtgaaaccccatctctactaaaaatacaaaaattagccaggcatggtggcatgtgcctgtaatcccagctactcgggaggctgaggcaggagaattgcttgaacctggaagaaggatgttgcagtgagctgagatcacgccaccgcactccagcctgggcgacagaacaagactccgtctcaaaaaaaaaaagaaaaaaaaagaaaaaaaaaaaacaggtgttaagtctttgtaaactgcaagctgctattatttttacattttaaattaacatttttggccaggtgcagtggctcacacctgtaatcccagcactttgggaggccgaggagtgtggattgcctgagctcaggtgttcgagatcagcctggccaacatggtgaaaccccgtctctactaaaagtacaaaaattatccaggtgtggtggttcatgcatgtaatcccagctactcaggaggctgaggcaggagaatcacttgaacctgggaggcagaggttgcagtgagccaagatcacaccagtgcacttcagcctgggcaacagagtgagactctgtctcaaaaaaaattttttttaataaaaaaaaaaattaacattttttggggaacagggtcttgctctgtcgcccaggctggagtgcagaggtgccatcatagctccctgcaaactccacctcctgggctcaagcgatactctccactcagcctccagagtagctcggattacaggtgcaccaccacccctggctatttatatgtgcgggatgctaattatttcatgtttcatggaggtgtgtttatactactccaggatgctatatcacattgtatcctatgtggtagcttagcccctgggaaaactaaaaagggaatagcaaagtctcagggctggatgcttttccaatcctgactgtctgcgagtcccccaggaagcaggggttttggttttcaacacccttttcctagtctacccataaggacagaggagcagaacagctgagtgaggctttctctgctccatctagaatagcaacagccacaagcacagtaatagccccaagatgagtccctctaccttcccagcaccccaagccacccctttccaaaccttaccttttggcatcatccttagaatattaaacacttgacttctctcaatgagatgcttggcctggaaaaagtgcatgctgggtgggaatatcagggtcctcatggcctccttcatctcagcgattttgagcgtcatgagcctctcattggccagctcctccttggtgttcagcaccagccgcccccccagccgcatcatcttttctttcaacaacagatgcgcccgtgtttcatctatggatagagctgagccgaagaaagacattgccacagccaacagcaagaagcacagggctggccgctcagatgggccatccaccaacatcgggatgcctggactaggaaagggctcagatggagactccacgggactgcaaaggagagtgggggagtgaaaacctacagatttaagggtggaactctgatcttccttttctcgccctgctctcagattaccagaaggcaagatattgaaggattcttcttccagaccccagagaaaagacctacaggtacagacaggtaggggtttcccaatttttttttttttttttttgagacggagtctcgctctgctgcccaggctggagcacggtggtgcaatctcggctcactgcgagctccgcctcctgggttcacaccattctcctgcctcagcctcccgagtagctgggactacaggtgcccgccaccatgcccggctaattttttgtatttttagtagagacggggtttcactgtgttagacaggatggtcacgatctcctgacctcgtgatctgcccgcctgggcctcccaaagtgctgggattacaggcgtgagccactgcaccacctggcatttttttttttttttgagatggagtttcactcttgttgcctaggctggagtgtaatggtgtgatctcggctcactgcaacctccgcctcccgggttcaagtgcttctcctgcctcagcctcccaaatagctgggattacaggcatgcatcaccacgcccggctaattttgtatttttagtagagacggggtttctccatgttggtcaggctggtctcgaactcctgacctcaggtgatccgccagcctcagtctcccaaagtgctgggattacaggcatgagtcaccgcgcccggcaggttttcccaaattaaaggtcaccatgaggtcaaacaagccctggctcatgcataaagacactgcaatctgatttttagtggttcacttttattttattttatttattttaatttttgttttttttaagacagagtcttgctctgtcacccaggctggactgcagtgacgtgatcttggccctctacaacctccgcctccagggtttaagcgattctcgtgcctcagcctcccaagtggctgggactacaggcacgcgtcaccatacccagctaatttttgtatttttaatagagaccatattggccaggctggtcttgaactcctagcctcaagtgatccactcatctcagcctcccaaagtgctgggactacaggcatgagccaacatgtccagccagtgttttacttttaaatataaccagcatgcctgtggtcccagctattcaggaggctgaagcgggagcatcacttgagcccagtactttgaggctgcaatgagctttgacctcaccactgcactccagccttggcaacagatcaagaccttgtctctaaaaaaaatatttttttattaaaaaataaaaatacggctgggcgcggtggctcacgcctgtaatcccaacacttcaggaggccgaggcgggtggatcacgaggtcaggagtttgagaccagcctggccaatatgatgaaaacccgtcctactaaaaatacaaaaattagctgggcatggtgacgcatgcctgtagtcccagctgtttgggaggctgagacaggagaatcacttgaacccaggaggcagaggttagaataagctgagttcgcgccactgcactccagcctgggcgacagagcaagactcaatctcaaaataaataaataaaattaaaataagaccaggtgctggcacagcaggtggattgctcaagcccaggaattcaagaccattctcagcaacatgttgaaactccatctctacaaaagatacaaaaattagctgggcgtggttgtgcacacctatagtcccagctactggggaggctgaggtgggaagttcacctgagcctgggaaatcgaggatgcaatgagccaaaattgcgccactgcaatccaacctgggtaacaatgtcatatcctctctaataaataaatgaattggccaggcgcagtggctcacccctgtaatcccagcactttgggaggctgaggtggacggatcacgaggtcaagagatcgagagcatcctggccaacatggtgaaaccccgtctctactgaaaatacaaaaattagctgggcgtggtggcatgcacctgtagtcccagctactcaggagcctgaggcaggagaattgcttgaatccgggaggcggaggttgcagtgagccaagatcgtgccactgcactccagcctgccaacagagtgagactccgtctcaaaaaaagaggaaaaaaaaattaattaattaattaattaaatagcaaagaaacaattaacagaatgaagagacaacctatttttttcttttcttttcttttcttttcttttgtgggggacggagtttcgctcttgtcaaccaggctggagtacaatggcgcgatctcggctcaccgtaacctcctcctcccaggttcaagcgattctcctgcctcagcctccagactagctgggattacagacacgtgccaccacgcccggctaatttttttatatttttaatagagatggggtttcaccacgttggttaggctggtctcgaactcctgacctcaggtgatccaccagactcggactcctaaagtactggcattacagacatgagccaccgtgcccagccttttcttggctcactgcaatctccgtctccctggtccaagtagttcttctgcctgagcctcccagctcctgagtagctgggactacaggcatgtgccaccaggcccggctaatttttttgtatttgtagtagagacggagtttcactatgttgcccaggctggtcttgaactcctgacctcaggtgatcctcctgccttggcctcccaaagtgctgggattacaggcgtgagtcaccatgcccggccaatctcttgaataggagaaaatatttacaaattagttatctgatggagagctaatatccagactatataaggaaatcaaacaactcaacagtaaaaggacaaataatctcacttaaaaaatggccaaagacccaaagacatacaaaatggccaatacgtatacgaataaatgcccaaatttttttctttgctttgctttctttctttcttttttttttttccttgagacagggtcttactctgttgcccaggctggaatgcagtagcgtgagtccacttggttggactccaaagctcgctgcagcggcaacctcccggcttcaaggaatcctcccaccctagcctcctgagtagctgagtgtagtaccactacactcagctaattttttttttttctttagagacagggtctcactatgttgccatggctggtctcaaactcctgggctcaagcgatcctcctgcctctacctcccgacattctgggattatagatctgagccaccaggcccagccaacattttttctaatcactgggggagtgcaaatcaaaactacaatgagatcgtctcaccccatctcaaaaaatggctattacttaaaaggcaaaaaataacagatgctggtgaggatgtagagaaaagggagctccttacaccactggtgggagtgtaaactagtacagccactatggagaacagtatggatatttcttgaaaaactaaaaatagaactaccatacgatccagcaatcccattactgggtatctatccaaagggaaggaaatcagtatgtcaaagggatacctgtactcggatgcttattgcagcactattcacaatagcaaagttatggaaacaacccaagtgtccaccaacagatcaacggataaagaaaacgtggcaagtccatctaccgaagcaccggggagtgtcgtggatgcctacgagcaggtacaaaaaggacttctaaagctgaaaggcgtcgcagagctcagagtgaccaagcggaagaagaaaaagaaggacaaagacaaagctaaactcccggaatcaatgggaatgaacaaaaagaatgaggaggagaagcagcacggcctggacaagtggaccccggcccgcgcagcctttgagaaaatgcaggagaagcggcaatggaaaggatcctcaagaaagcatccaggccaggcttggtgactcacgcctgtaatcccagcacttcaggaggctgaggcgggtggatcacctgaagtcaggagttcaagaccagtctggccaacacggtgaaaccccgtctctattaaaaatacaaaaaattagctgggcgtggtggtgtgtgcctgtaattccagctactcaggaggctgaggcaggagaatcgcttgaacccggtagggagaggttgcagtgagccaagattgttccattgcactccagcctgagcaacaagagcgaaactctgtctcaaaaaaaaaaaaaaaaaaaaatagcatccaaaacccacaagcagagagtggaggacttcaacagacacctggacacactcacggagcattacattcccagagtcagctggacgaaatagccgcctgcccccagtagggagcagcatcgagggttggcaaaaggccatgctggggttgtgtgtgtttcctttggtatattctagaaacatggctttacacacaccctcgcatcttctgctacaaactgcttttcgaagctgtgtaccctcattctgtaacttgattaaagtaaaattgtccttgtactcagtttaggtttcttggcaacatatagaagatacacccttttagttcggatggaaagtttctaagtttattcagaggtaaagcccatttctgtgtccgtaccatgtaaaaatgtttttatccccgagttgcatctaacgctctgaggccagccagctgtcttctccaggatcagatggactccagaggataaggagctaatgccagggtggcctgtagtatgcagagctccgcaggacccagcatgggtgcccctccaagcttcctctagcttggggcctatgctggtcctgcaggccccagggaagccatttgcaactctgtggccttcagacttcctcctcagccactggccactgagacagcacagcctgggtggcagaacagccacctaaggcaagaatggaaggaaacactttgttcctttctgagcccattccccaaaaccctccttccaggtactcctaatgggtattgccatggcagacattgctaatggatcacagcattctttgaaatggagcccagatatagcctgcctgtcaatcctcagctgggggctcctagcagcctcttgtatttattcagagttgacacatcacacggagcctgtctggcattcctaccctaaggacacctcaggggtgacaggaccagggcagagccccagtacaaacagacatgggtgcagtcaaatgggagggcccaggcatccgtcttggagggctgggattttgtagggcctgtgtgtcctggttgaggatcaaaccgcatatgctattgggagaaacaatctctgtggacatacatactgaaagaataacaaaggcagaagagaaaaacaaagtgtggaatttggggttctcctgtgtaaattacacaagaaagcagaagccagttatttaaaaaagaaagaaaatgtggcatatatacacaatggaatactactcagccattaaaaaatgaaatcacgggctgggcacggtggcttacgcctgtaatcccagcactttgggaggccgaggcaggaggcaggtggatcacgaggtcaggggtttgagaccagcctgaccaacatggtgaaaccccgtctctactaaaaatacaaaaattagctgagcgtggtggcggatgcctgtaatcccagctactcaggaggctgaggcaggagaattgcttgaacccaggaggcggaggttgcagtgagccgagatcatgccattgcactccagcctgggcgacagagcaagactccgtctcaaaaaaaaaaaaagaaaaaagaaatcacgtcatttgcaccaacatgcacggaactagaagacataatgttaaatgaaataagccagacacagaaggacaaacaccgtatgttcccactcatgtgtgagagctaaggaagttgatctcatagatatagagaatagaaagatagacaccagagactatgaagggttggggtagacatgggggatgaagagaagttggttatgggtacaaatagacaagcacttcaagaggctgaggcaggagaatcacttgagcctagaagttgaagactggcctgggcaacaaagcgagacccccatctctacaaaaaatttaaaaattatcggcaggcagatcacgaggtcaggagttcgagaccagcctgaccaacatggtgaaaccccatctctactaaaaatacaaaaattagtcaggcgtggtggcgtgcacctgtaatcccaactacacaggaggctgaggcaggagaatcgcttgaacctgagaggcggaggttgcagtgagccgatatcgcaccactgcactccagcctggggaagaagcaagacttcatctcaaaataaataaataaatataataataaaaattatccatgtgtagtggtacacacctgtactcccagctactcagcaggctgaggtgggaggatcacttgagtctgggaggtcaaggctgcagtgagccatgatggtgccattgcactcctgcctgggtgacagagtgaaaccctatctgccccactcccaggaaaaaaaaaaacctacagttagatagaagaaataagttctaatgtttcatagtagactagggtgactatacttagcaataatattatgtatatttcagagtaactaagaccgggcatggtggctcatgcctgtaatcccagcacttagggaggccgaggcaggtggatcacaaggtcaggagttcaagaccagcctggccaacatggcaaaaccctgtctctactaaaaatacaaaaactagccatgtggcgtgtgcctgtaatcccagctacttgggaggctgaggcaggaaacttgcttgaacccagagggcagaggttgcagtgagccgagttcgtgccactgcactccagcccggcaacagagcaagactccacctcaaaaaaaaaaaaaacacacacacacacacacatatatatagagagagagactcaaataaaatggattaaagttaaaataaataaataaataacaaatataaccagagcacaagatcataagacatgcttcaaactgagaaagaaaccaaaacaaaacacacagagataaggaactgagaggaaacaaagcaacacaggaaataaaagaaaaacctgaaagaactgtaattaacatccttaaagacataaaacattgtgtgtgtaaaacaggaacaggaggtgattaaaaaaatgagaattagaaagaactttcagaaattaaaaacagcaaagccgaatgtttaaaaatttactagcaatattaaaaatgaagttaaagaaaatatttttaaaagtaaagcaaaataggagaaaagaaaatgagatgattattggttgaagaaatccaacacccaaataacagacatttcagaaggaaaaagaaaaaaaaaacaggtgaaggaaataagccaataaggaatacaagaaattgccccagaactgacagtctttagattgagtaccttgcacagcacagtcaatcattctgtggccacaccaaggtacagcatcttggtatttcagagcattagcattagaaaggattatcaaaacttgcagagagcagccagttcagggtggcaacgagcagggactgaaggaaggaaatgtattcagcatctcctcacacaaggctctatgctgctcctttacctgggttatctatttgaattacatttaagaaggggcagtggctcatgcctataatcccagcactttgggaggctgaggtgggcagatcactggtgcccaggagttcgataccagcctgggcaacatagcaaaaccaaaatacaaaaattagccaggcgtggtgtattgaacctgtagtcccagctattcatgaggctgaggcatgagaagttcttgaacctgggaggcggaggtttcagtgagcctagattgcaccactgcactccagcctgggtgacagagcaagactctgtctcaaaaataaatacgtaaataaaatttttaaaatgaaaataaaacgattgtttctctacacttgaaagtatgatacagcatactggaacatgtcaagactgtaaattaggagaccttaggaacagcctcaaattagtatcattctaactgtgcaaccttgggcaaatcactaacgtctccagatctcagtgtcctcacctacaaaaaaggtaacttggacaagatcagtggttttccaagtgcagcatgaatatcatcagtggcataaatacaatcttaggtggctcacaaatggataggggttatgttgacagataggtaattttaaaacatgtattagcacatcaaacccatgatatcgtaactattattgtttttgttgaaaaatttttaagttaaagaaaaatattaagtaaatagaggtgcaaggatatgacaaaaatggaaagtttgctactcattaaatcattttaatatccaagattcttcccagctcagttattctgtagtacatcagatagcaaagaaaattttaagaaggaactagtatcagcaatatgcagttatggcagaagctgtacccccaaaatcagagtgctggacgtcagcagaacccctttaacttcattaagtccttgactctcttttttgaccacggtgtttgcctgctactaaaatctctagggcaggagcacggtgacttctatgtcaccatcccacctaccccatgccacattctccatcaacagccccgccccttgtccctgtctccctggtgacacataacaaaggccatcaagctcccaaatcttcaactccatcctctccaagaaggaccccaaaagcatttgtgtcccagcaactgtgaacttttccaggctgccagacagaagtttatctaatggtggtcaagacctgcctggttgaatactagtaaaaacaatccttattcacaatttattgctatatctacttcatcttctctcctccacaagattttccttttacttttaaaagaggatgcatgaaaacttcataaagtagtttgcttccagactaagaagaaaggaggctgggtgtggtggctctgcctgtgatcccagccctttggaaggccgaggcaggcagatcacctgacgtcagtcgttcaagaccagcctggccaacacggtgaaaccccgtctctactaaaaatacaaaaattagccgggcgtggtggtgggtgcctgtaatcacagctattagggaggctgaggcacaagaatggcttgaactcgagaggcagaagttgcagagagccgagatcgtgccaccacactccagcctggtgacagtggagtaggccacatgcatctgtggtcctgagtaaatgcccttgggcccattttcaaaagcctgttgggagaaagcctgttactcctccactgagagtctcagacccagctcagatggagacagggagaggtgcaggtggatcaagcccaagctccggacttcccagctacctcctgaacctcatcatcccacagctcccaaaggaccccagttacctcggaacagctccagaaactgagggctgtttgctcagcgccccagcatctgtgcagagcaccggaaaagctcaccaactgtttcacttcctgttggggtaggttttatttccctccagtgtgcaccagggatccaactagaggccggggagaggggctctgcagtgctgaggcagccagagtggcaagtgtgtggcttacatgcatgcttgctgtgtgcatctgagtttgatgtggggggcttgtgcgcatgttcatgtgggtgtttgtgtgttcgtgtgtgtttcggtttatgtgcatgtggggtttgtttttttttttttttttttttttttgtagacagagtttcactcttgttgcccaagctggagtgcaatggcgcaatctcagctcactgcagcctccgcctcccgggttcaagcagttctcctgcctcagcctcccgagtagctgggattgcaggcgtgcgccaccatgccccactgattttttgtatttttagtagaaatggggtttcaccatgttggtcaggctgctctcgaactcctgacctcaggtgatccgcccacctcggcctcccaaagtgctggaattacaggcgtgagccaccatgcccggccgcatgtgggtttatttgtgttggagggagggtgtgtgtgtgtttgtgtgtactgtgtctttgaaaggtccacagcatgttggttttggaaacaagcaccgcaaagaggcactccaaaatctgttcatgaactctgggaagttctccttcctcaaaatgtgattgtggactgtggggcaacccattagacagagagtaaaaagtagctataataaaatatatgttttaggggggaaatcagggatgcggggacaggacagtagagggggcaggaggtaggagacaagagctggggtgtgaagaggaccagcaagaacaacgctccaagggacaagtggagcagacaaggctcctgtacccaggacggtcagagtcagacctcgctttgtagctggccttagcactgtagcagtggggcctcgaccaagttgtttcaactctctatacttcagtttcctcatctgaaaatgtggataataaaagcacccaccacagagggtccattgtcagaattaaaggaaaaacacatgcaaagtacctgccacatagaaagctcttgataaatattagccatgactattcttagaagtaactattgggatgcctcatccaagccaattagaaatgcagacatgggaggctacaccagggacctccatgtcacatgcatggtctaaagactcgattgcaccccactcctccccagtcccactcaaatctacccccaagaccccaaatctacccccaaaagcccacggcagtttcagttctgcagctcccatacatctggagccttgatgctcctttttgtcattttctccaaaaagtaccaaggtcattcatttaataaacaggaagaaatcccaaagtgaaaacacagaggggtcagggattccctcatcaagagttcaagactaggctgggctcagtggtgcatgcctgtaatcccagcactttgggaggccgaggcaggtggatcacaatggaaggggttcgagaccagcccctactaaaatacaaaaattaggtgtggtggtgcgcacctgtaatcccagctacttgggaggctgaggcaggagaattgcttgaaccctggaggtggaggttgcagtgagctgagattgcaccattgcactccagtctggatgacagagtgagattttgtctcaaaaaaaaaaaaaagagtttaacactaattttttgaaagttagaggaagcagaatgcaccgcaagtaataaggagaaacaagattgattccagcgccgcacaaagggaaaccaccaattctgaaagtaaatcatgtgaagggttttttgtgggttttttttatactttaagttctagggtacatgtgcacaatgtgcaggtttgatacataggtatacctgtgccatgttggtttgctgcacccatcaacacatcatttacattaggtatttctcctaatgctatccctcccccagccccgacccccccgacaggccctggtgtgtgatgttccccttgaagggtttttttaaagaccaggtcaaagctaaagatcaagcttttctttccaaacgctttagctaaaagtaggagctaattttcacatctccgaaggtggctccaggactccaagtcacaccttggcaagggtgtggcagctggcagaggactgcaggtccttgtcaggcagaacctgccgggttctggggagtggagactcagatcttgaggtggaagcagagacaagagctgggcacacttacctggatgtggggttgggagcggtgaatcagagcccagttagatcctggaggctggcagcaggctctgcagaggtgcaggggcacctcattcagaaggggccatttattggccctctgtggctaaaacc

SEQ ID NO: 2308 - DNA, 40797 bp, Homo sapiens; identical to SEQ ID NO: 2306
  source 1..40797: mol_type = genomic DNA

SEQ ID NO: 2309 - DNA, 40797 bp, Homo sapiens; identical to SEQ ID NO: 2306
  source 1..40797: mol_type = genomic DNA

SEQ ID NO: 2310 - DNA, 20354 bp, Homo sapiens
  source 1..20354: mol_type = genomic DNA
ctcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggac

SEQ ID NO: 2311 - DNA, 66507 bp, Homo sapiens
  source 1..66507: mol_type = genomic DNA
ttgaggcagagtctcactctgtcacccaggctggagtgtagtggcgcaacctcagcctctccaagtgctgggattacaggcatgagccaccactcccagccaatagtgaattttctaagagcatgtatccctatcagtaacagggatacatgaagatacttataaaatacagaaaaactgcccagcaaatcagggccctaaacagttggtagattccataaattcaactggctaccatgtatagccctcactgtaaggtaggtggttaggtttctagagagcattagtcttagaattatgaagagccatattaacccaaatgatttctaaatttagatatatattttccctgctacataaaaactctgggtaataactagaaatagacccacaatttagagacaatgtatactagatttatctcctttgtttttagttgaaggcaaaaaaaaaaaaaaaaaaaaaaaactattccagttgtcatcacaaataaatgccaaatgcctcatattcagcggttcattacagtgtataaaaaaaaactgatcatttccctagtcagtgctgttatcaatataaaagattaatttacaaaaacgtaaatattcataacccaatccagctgtattttctgcttttgcaccacaggtcaaaagatattttaaaaactaaaacctgaaagcctcaaaataagctagattcaccttcaccttaccttttcaaaaggagaagggccaaaccacacaagaactgtttacctgcaggaagttcaaacacatgaccagcatctgctaagtcacttcccagtcttcacaaaatacaagctgtgattgatttgtaggtcaaatctataaaaatattttgcacacttaagtcagaagagctgagaactaaattagcactctgtttctttgctgtcaacacgattctgacgctgcagtttaaaggaggcagccttttcacttctggtgaccggatggtccgtgagatcctcaaatgacttggcagctgtgctgctatttgggaaggggtccttctcaaacccatcctcgtccatatgtgagtctgtgctggggtcttcctggatggtgtccattctctggtggtccagttttggagctgctggcgccgaagggatcacaggggcaggctgcaggcggcctggagtctggggcgcaggaaagggtttgataatgcgaaccgatgcagaatccatgctgctcagcatttcgacgttctgcaaagacatgggttcaattgattgataggaataaaagatgaatcggaggtcctcacagctccacccttacccatcaaacagcctcttattctgttggcactgtgatgctaagaaaaaagtgctaggtgaggctcactcaacctaagtgactaaaaaatactaggttggtgcaaaagtaattaatgccattacttttaatggcaaaaacagtaattactagctttcaagcatcctgaaaacttacttaccatttgaagacccaaaagaggattcaaacctctcaaggtaagatcccaagagagaaattgaactcaaaatattaactaagtgttgaatggctaaatcactccttatggcttgggaaggggacagcacagctctttaaatgtccatccatgcaactaatcgaagttcaccatcactgttgtcagaagggtaaacattccaacctagacccttcctgctgcaacatgaccttccatcagccagtgaaagctcttgctgggtcaggtgaaggtctttgcctaacagggcctcagaccaggcgaagattatgtttctttcatatggtatacttacactggggtgaaacagagacagagattcatactgtttatccaatttcttatcctagaaagaaacagcaagaaggtcattccctacaaatacaattcagttagtgagtactatttcatcacaggctattcctaacactaactgaagaacttagaacctgagttgtagaaagtgatagcaggctcaacagatgacaatccatttctcacccaagctttagttatgccaccagtctagaagtgtttcctttgcactcaaaggaaatacattttggcgttaagtacagaaagaggcaaggtttaagtgctatgttttctgagaaatttatccctctgtgggcaggggaataataaaggcatcttcctgtgcatgaaatgacaaatgtcccagatgctgggtacaccaggaccgcactgactggaagggcaactggtaggaagacccaggtggctgggcctgcagcattcttcgcactgccccggcccatggcctcactctcttagctgtctccacagtttctgtggaccatgctctgctggaggaactgggcctcaatccctacatcctacttctgcagaaggctaaccacatggccatctgctgccccatccctgcctgtggctgaagcataataggtgacagagggcaaggaccaagaatccaggactaggcttcctgtctgggtgccatcaatgcattctatgaccaaaaacaagccatggccctccctcctatcggaggctttgctctgaaatcaagggtcgtgccttgtccacatgtgcaacttccctgtaaacaaaataggttccatcctccaatagaagcaatcgtgatggatggcactgtcatccagagacatctgtcaaagcttcaagcacgtcaccttcagctttcttcagcacaagtgctccctagagatcttcctatacccatcatgctcaccaccctgaggaagagctgctctgtgagatggcccctaggcaggagaagccagcaggaaaggaaaggaaggaggcagtaggaaaaactcctttgtcatcagagttgtgctggaatttttaaatgctcataggaaggccactatgaaagagtttgggaaaacaagtctggaagcctgggtgtgactttctcatctctacagcagacaaatccccattccccacagatgcaagtgaatggattcgtaagaacatttatgaaaaagggcctcaaatttataaaggaccaggagttccttagtcaaagcccaattcaacttgtagctgttactgattctgaatgagaacagaaaagactgcttactcttattttttggggaagatgtaaatactctatatgacagctgggccccagtccctacatcctatttgtgcagaaggctgaagacatagccatctgctgccaataatctacatgatatatggggaacatctgaaatgccgatgtttgatatttgctctattgcaacgaagtcagcctgaaaatgctcttcaataagggctttactcatcaaaggacctggacaaatccagttaaacagtctcctatgcttaaaagtataaaattcctaagaaatttatatattaaaacaccaacacacaaaaatagtattttttttaaaagaccattagttaagctttctacaagacatgttcccctaggaataacaacaaaaaaagctattggaaatatcaggccaaactttgctaagaacaagttttaccttttccagagattacatggttggagttgatcaaaatttaaataaaacatttaattacttaaaagttgatgacttaccacacaatggacaagaatgctgaaaggaatccaaaatatcaaggagaaaaccaggacagacccaacgatgttgtctgctaaaaactttcctgtgaacaattccaaacagttaatgtcttgaccaagtacttcacaaatctaaagtgaaatgctcttaggatattaccattgtgtcaaatgccagagctgctggctagacatactaccgagagcagaatgtctgtgctgcctgtattacaccacaccatctctccataccaagtgcttttaaagaaatagccctcatatactggctgacaggaagagattgcagaatattcaacatgttacctggagtagctgtgtcaacagattaatatggaatgctactactagtaaatgcttaagaagacaaagtttttgttacctggatattatttttgtgattaaattatggactcgtgacaacatgatataccctgcttctgcaaaatatgaggctcacttttacatcaagcaggattcagtatatagcattcagtcaaataaacactcttacatcaatcaggattcagtctatagcattaaactatgcttatgctaatcacatggatatttttgggtaaagaaggaagccagtattttgactttatttcccttgtcagaaaatctgtgcatccaagctccacggggacagactatctatgagttcattttattctagccaacaaagttgtttcataactaaagctgtgaatagttccaccttctactgcagaattaaagcacatcactctgaaagcacacttttctaatgtcatcacagaaattgactcagctctcagtaagtaatctggggaaatcacctaccaaaagtattgatgctcagctggtcaatgaaatcccaaaatcgttcaattacatcctgtactcgtttctcacatttgccctatgaagaaaaaacatacatacagcatcattcccaaacacaatgtattcagaagcaatgtagctttataaaaataactgacatgtaaagggcttcattaaaatcaaacgttttcccatctttgacacaaggcaataacttccgcgtaatgagtacccaagaaagtagaacatctgtcattaacactttcataattactccatttttacaagtgatttagaattaccaggagacaaaaatcaaggaaaccagtttgctaaagatgaggcattccagtaaggactctacacatacacagtggacagtgaacaacacagccagactccctgtgaagcctcgtaaatcttaaaaccctctcccatcattctgcatgagaaaaattatgcttctctagagaacaaaagggtctggcttaagtaagtcaagcagccttctaggtctttcctactcattcagcacctgtttcaaaatcacaccctgaataattttgcaatcttagtcagttctgtaagtaatctaggaaaacataattaggacccactgcctgaaaccaaccaactttaccataaagtccccaccccagtccttctcagtctctgggctcaaagcctcccaccacagaaggaaactacaggcagggacctgaaagcactccgtcttctcctcctaagtaatacccgtagataacaatgggccagaaggatgtagccccacttgtgttttgatttgttttcatctgcaaaatcaagtacttacaaaataaaaacttcctatctggctgttacagaaaaagctgtacataaatactcacattcatgtcacaaaatcctactgtacagggctttcctttcctcaaaaataagttcttttgttcagcatcgacatagggcacacagcggccagaaaggtccctgcagcacaccttgcaggagttgtcagtttctggaacagagaacacgcattgacagctggattgttctgagacctgcctctcctcctgcctcctctttcctccctgaccatgctcccaaagaggtaagaaatcacatttattttttatttaaatagctaatactatccatagcccccaccaaggagtagtttctgaggtcacactcctcagccttcagtgacagaggccacaaggtttaaaaaaaaatgcagagaaaaatccattctagattcaagacctctcttcaaagtctaactattctctccccttcaagcccctcacaatgctcttctaaatgcttccctttgtcccaactttcttgtcaccctgctgacttcaatccttggtttttcagtctaaagtgtgcccctcagggcccacactggctccctgaaagcgagagcagctgggacacaactgtccacccttgggtggggagctcagtgaccccaggagcatgagccctgcagccaaagctccacaactcctcccaagaacagctctgacaggtcacaggataaaacaccgggcatctgtgagccatgtgggcatacataagaatggcagaaatgccagaaaattaaaccatacttaggagaaaaagaaatcaactagaacacaaaaacaagcaaaaagaaaaccttttcagaaaaggccgggagcagtggctctcgcttgtaatcccagcactttgggaggccaaggcggacagatcacttgaggccaggagttcgagaacagcctggccaacatggcaagaccccatctctactaaaaataaaaaaaattagccagatgtggtggtgcttgcctgtagtcccagctactcaggaggctgaggcacgagaatcacttgaacccgggaggcggaggctgcggtgacctgagatcgcgccactgcactccagcctgggcgagagtgagactccatctcaaaaaaaaaaaaagaaaaccttttcatcattcactaatttataaaatatttcttggacttttactgtgtcgggctctgtccttccagagcaccccaagcctcttggcattcaacacaacagatttatttggcatctgctacgtgttaccttttttttttttttttttaagaggtgaggtttcacaatgttgcccaggctggtctcaaacaactcctgagctcaagtgatccacccaccttggcctcccaaagtgctgggattatagatgtgagacactgccctcaacctatcttctttacctacacattattgaacttggaagagttcctcactccactgtatggatggtgagcttccaacccagtgattttatttaactaccgggttctttgtcttttatttattttattttttacttatttatttatttatttgaaatggagtctcgctctgttgcccaggctagagtgtagcggcgcaatctcagctcacagcaacctccgccccctgggttcaagcaattctcctgcctcagcctccctagcagctgggattacaggtgtacgctaccacacccggctaattttttttatttttagtagagacagcgttttgccatgttgaccaagctgctctcaaactcctgacctcaagtgatctgcccacctcggcctcccaaagtgatgggattacaggtgtgagtcaccacacctggctctctgtctattttgaaagcaagagaactccctcatcgactcccatggtttaagtggggtgggaagcagagtccagccagtccctgaccagtccatgaggatgccctcaaacccaggggttccaaaatagcacagaaacctaaggaaaactgacaggccagcaggagagaggctcctgccccaggctgctctaagagatcagaggggagcagacccagccttcttgataactgcaaaaatcctcatctagtggggttaggtcctggaatcagctctctctggtggagttgttgcaggagtatcctagttccatgccaatgtaatgtagatagctactgctgcttttgtggtttgtatgatatggagcagaggaaggctaggacacacctctacctacccacccactcacccccaacaaaattccctcctctcccacctcaaagcctgccatatggcctgaaactgcagcaagaagaaacaccaacaggataggtctcccaggtatggtggatctgcatgcagagatgcctgtctccagacaccaccctgcccttccccatcccctcatcctcggcttggatctcaccactgctgtcattcgcacaacctccaaatggaggaagggagcctggcagacaaaggccatgttttctcctgctgctggactgggaataaaactgctcaccattacatgcacaggactccagctgctgttccctctcgcagaaagggatgcatttcccatccttacacttgccaagatccaagcaaacagtgtcatcttcagcatttcctggaggcgggcactcactgctattacctggaagcaaacaccagtcataacaaaaagaatgagtcacaggtccaccagttctacaggtgcataatacgctgtttctcatacaagtgagcatcttaccttgcaaaagcaaaaagtgacctacagagctaggacaagagcctgcatctcaccagcaatcagcatttaaatgggagtgcctggctatgtgccaggctaggctgcatgagtccctggcctcccaagccccagttagaatgcatggtctccacttctgcatctcacagtcatatataaaagaatatcctatgtgctattacttagaataaattgcaaactttgtatgaaggcttaaaagaactccacggccttccctatctggccctgacttcatcgcacacaactctcccacagcccactgctttggctatgacaacctccattcagttccttcaatattaacagatactattccttctacctggaatgctggtgtttccactcttttggggcaattagctggcttttcttatggattaagttttgtctcaaaggttttctgagatatccctgaggatgctaagttgatgtggcctcccacttccattatgcactatcacactccttctctccttcattgcatatgttttgcaatttatatatatatatttaatgttattttctgttttccctctactagactggaaagccccatgacagcaatgatcaaatctattaagttatctccaatccctatcatattataggtatactacaaatatttcttaaataaatcaattattctttttatttttcttttgagacagggtctcagtctgtcacccaggctggaaggcaggggtgtgatcatagcttactgcagcctcaaactcctaggttccggcaatcctcctgcctcagcctcacaagtacctaggatttcaggcgtacgccaccatacctggctaattttctttctttttttttgagagacgagatctccctgtgttgaccatgctggtgtaaaactgctgggctcaagggatcctcccaccttggccttccaagtgctggaatgataggcatgagccactgtgcccaggccaataatgccaaagaaaacccaccaaagaaagttaaactgggagagacaggatggaatgagtgaatcattctggaaaatgaatagcacaagtagctaaaagtcaacacaaatagaggaggagaaaaaaaacactttatgaaagcaatggactatatatccacagctctggactggcctttcagctgaagaatgaagccaatcaaaagaattctgacttagagggtttcagagcagtaacacaaaatgtacagaaaatctggccagtttcaaacaaaagtgatggtttattaagtacccaacagataaccaggcactttgcctctggttctcataaaacctttcatgagcactgggcattcatcatgtcaacagtcatttaacaaactattactgaaagtatgatgtccagtgagctcagggaaggtttatattgtggatcattattgtatttttggtatatgatactgccctgatacattaaaaaatgctcaataaatatctgttgagcatctgttcttaaaagactaaagtcagagtattagacaggtaggaaaataattctgaaaatggtatcatctatctagcatggtccccaaagtttagcatgcatggaaatcacctgacagaaggttacacagcacagactgctggcctcccttcccacattttttgatgcagtagatccagggaggggactgacaatttccatttctaataagctcccaggtgatgctgctgctgctggttgtgaaatgctaattgctttttttctttcttcttcttttttttttttttttttgaggttgttgttctctagcttttcctgctagaaaatactgattccttatcaggaacttatcctctgctatctactattttgtataaaatatcaagggaacaaaaggctgtttgataagaacaaacgttttcaaattgttttacttacgtttatttaaaagaaagcatttttctcaatctattttattattacagtgaagatgaaacattgagcatagctagcaaatgcttctttaaagcttgatttagatattcaggttcctaacatttgtttttttggtttttttttgagatggagtcttgctctgttgcccaggctggagtgcagtggcgtgatctcggctcactgcaagctccgcctcccgggttcacgccattctcctgcctcagcctcccaagtagctgggactacaggcgcccgccaccacgcccagctaattttttgtatcttttagtagacacagggtttcaccgtgttagccaggatggtctcgatctcctgatctcgtgatctgcccacctcggcctcccaaagtgctaggattacaggtgtgagccactgtgccgggccatcaggttcctaacatttggcaaagtaatgtgatagtgacagatcccaaaagataaaaacatgggcaacatgtcatactatgcacacggaaaaccaaaatcaagccaaaataggacacaacttcattcactaggtccctgaagacctccagctttctgtttgcatccttatcacaaaacctaggatagttacaataaaaaagataacaagtgttggtgaggatatggagaagctgggaccctcatacaatgctgctgagactgtaaaatggtgtagccattttggaaaacagtctgacagctcctcaaaagattaagcatagttaccacatgacccagaaattctattcctgaataatatccaaaggaactgtccacacaaaaactcatagataaatgttcacagcagcattatttgttatagcaaaaaagtggaagcaacccaaatgtctatcaaccaatgaatgaataaacaaaatgtggcatatccatgcaatggaatttacccagcaataaaagtacatgaagtactgatacatgctacaacatacatgaaccttaaaaatgctatgttcagtgaaagaagccagtcatacaatatgtggtcacgaaaccatattgtataattccatttatatgaaatgttcaaaacagacaactccataaagaatagggtggttagtggttgctctgagttgtggggaatggggggattggaggatcatagctaaaggatacagggtttctttctggagtaatgtaaatgttctaaaattaattgtgatgactgcataaatctgaatatactaaaaatcattaaactgtacactttaaatgggcaaactacatgagtgtgaattatgtatcaataaagctattacaaaatcaaaccaaccaaccaagagagacaaattttgaaaaatataagaatgggacagatagatatatcagaggaacaaaaaaactagaatagcaaactgaatattgctttttgacaatttaagtcaaaaaacatcgcaagggtaaaaaaggaacattatatactggtaaggaacagcagataaagatgtagagatatgtccgtttatatacctagtaataacatagctttgaaatttttaaagcaacaattgaccgaacaaaagatactggacacctggaaaggttagctccagaaagattcaagtcctgaatgtaaaaggacaacttatgaagctaatagaagcagctgtggaaaatatctttttaaccatccgccatggcttttctgaaccatgtgtttaaaaaatacacacacacaacaaaatgatggatttgattacgttaaagatttctgttctgagaatggcaacagataggagacgtatgcccaaatggatgattacataagaactcctccaaattcacagtagtgaaataacatgaaacccaatttttaaaaaatgaaccaaatatatgaactggctattcacaggagaaatctgaatagctgaaaaatataaagagatgctcaagaaaaatgtaagtaagtgcattaggacaagggctgttaaaaaaaaaagtaagaacaagagattactttatactcatcatgctaataggacagcagggtaattccaagcgttggccagaacgtcaggataaggagtcctcagacacaggcaacctagcagtggtgctctagagaccagcacatcctgcctctgtgactacacaatgacactcctcagtacccagagaaacacacaggttcctgaagggacgtaggaggatgtgatctgtgtcctatctggaatatcaaggggatgaaggcaatggaagtagctaccacttggtgacttgtaagtaaaacacagccaatcatataactaaacaatatgtaggtgtccccaacagtgaaatacatatagatacatatagaaaaactggttacccttctaacttgtatcctgcttcctccacactattccagtgcatagattcatgataacattcattatcccaagattgtcattttgattgtttccaaaattttgctattaggatgtagccattaaaaaccttgttatattatctgtagcacaatatgggtaattctttaaaacatgatactgaattttttaaaagtaaatttaaggtagaatatcattttggcacattaaaaacacatacatgcacaaaataacactatatgatctttcaaggatatacacatatccaggcaaatattaaccacagtagagtggatgtctgtgaggagaaagaggagagtgatggaaatgaaagagaaatagaaacaggtcttaaacccaccaaagccaagtgtcacaaactaaggagtgccagaaactcaacccggcatatgagattaaaaataaggtgtctctcatctgaacaaaacataatcttgtttttcaaagacacacacacacttgacccacagcattccaaggaagcaacaagaacacgaacctgtgcagtaggacacgcctttgcaagtagcattaatcgcctcctggcacttcttctgggcagtctcaaactgacagtttttacagcaaggactgttcctgtcactggagaagaacagcagacaggaacagagcaattcaaattatggccccatatcaaatcaaacgctacagttacgttacagtgacctgaagatcaccggggaagacctcctggctccgtcacccactcctacatcatcagacatctccgctgctagagctacctgcacacactttgtcccttcctaatgtgcgtgaggtcacataaatgccacactataggagaaaagaatgggaacacagcaatcacctgtgaaacatcttggtgcccttggttttcattcatttaacgcattaatttaaaaaagacaagatgggctgggcgaggtggctcacacctataatcccaacccaacactttgggaggccgaggtgggtggatcacctgaggtcaggagagttcgagatgagcctggccaacatggtgaaaccccatctctactaaaaatacaaaaattagctgggcgtggtggtgcgctcctgtaatcccagctacttagaaggctgaggcaggagaatcgcctggaccccggagacagaggttgcagtgagccgagatcgcaccactgcactccagcctaggcaacaagagagaaattctgtctcaaaaaaaaaaaaaaaaaaaaaaaagatgaggcaggtggaccacgaggttaggggtttgagaccagcctggccaacatggtgaaactccgtctctactaaagatacaaaaaattagccgggcatggtgctacatgcctgtaatcccagctactcgggaggctaaggcaggagaatagcttgaacctggaaggcagaggttgcggtgagccaagatcgcgccactgcactccagcctggtcaacagggcgagactctctcaaaaaaaaaaaaaaagacaaggaaaaaaaaaaaagacaaggtggggccacaaggcaatccatagctaagacactcggcagccagaactctactccccatcagtatttacagcgttaatatgcactgtatccagttaaatctcaattattcaccagaaaactgaagtttaacccttttacttctaagccaggcactggtctatcagtgtatataaaaaatgaaaacctgggtaactttctaacttgtaacctacttcctccacactattccagtatatagaatcatgataacattcatatcccaagactgtcattttgattgtttccaaaattttgctattaggatgtagccataaaaaaaccttgttaaatcttatacccttgttaaatcttatctctgttgcccaaaagattctttgggcagccaggagcagtggctcacgcctgtaatcccaacactttgggaggctgaggcaggcagatcacgaagtcaggagttcgagaccagcctggccaacatggtgaaaccccatctctactaaaaacacaaaaattagctgggcgtggtggtgcacactgtaatcccagctactggggaggctgaggcaggggaatggcttgaacccaggaggcggaggttgcagtgagccaagatcacgccactgcactccagcctgggcgacagagcaagactccgtctcaaaaaaaaaaaaaaagaaataaaagattatttgggccaggcatggtgcctcatacctagaatctccacactttaggaggcttagaagggtggatcacttgagcccaggactttacaacaagcttgggcaacatggcaaaaccccatctctataaaaaatacaaaaaaaattagccaggtggcacacacctgtagtcctgtctatccgggaggctgaggtggaaggactgattgagcctgggaggttgaggctgcagtgagccatgatcatgccactgcactccatcttgggcaacagactgagaccctgtctcaaaaagaaaataaaggccaggcacggtggctcccctctgtaatcccagcactttgggaggccaaggtgggcagatcatgaagtcaggagatcgagaccatcctggccaacatgctaaaactccgtctctactaaaatacaaaaaatcagccaggcgtgatggtgcgtacctgtagtcccagttattggggaggctgaggcaggggaatcgcttgaacctgggaggcggagattgcagtgcgctgagatcgcgccactgcactccagcctggcaacagagcgagacgccgtctcaaaataaataaataaattaaattaaataaaaaagattattttgccaggcacggtgcctcacacctgtaatcccagcactttgggaggccaaggtggatggatcacaaggtcaggagttggagaccatcctggccaccgtagtgaaacctcgtctctactaatacaaaaaattagccgggcatggtggtgcgtgcctgtagtcccactactcaggaggctaaggcaggggaatcacttgaacccgggagacaaagattgcagtaagccaagatcgcgccactgcactccagcctggcgacagagcaagactctgtctcaggaaaaaaaaaaaaaaaaaagattcttttaactataggactgctaaaccaaggagcatgcaaggtcaaggattttgttacataatgtcacactgctttccagaaagcttcttcttttcttatttgttttttgttttttaagagatagtgtctcactatgttgcccaggctgttctcaagcatttctcccacctcagcctcccagagtgctgggatgacaggagtgagccaccgtgccaggcccagaaagcaatttcttgctgtgaagggcaaaagaggtagatgtaaacaaacacactcacacccctttcagttgattctaaagcccctgcaagttcagtcttctcttattttggacatcttgttataccaacttcccaaaatccctgtggagagactcctcacctgcactggacaccttccttcaacgtgcagtcgctgttgcagcaggtgtcgttgttcagatacatgatgccaggatcacactcttctccttcatccaccctcgagttcccacaaactttattgctgcgttcttgaaaacactcctgggccttactttcaatggtcttatagattgattgtttactgcagtttgaaaacatcttgagagaaaaaaggcaataaggacccaaaataatatcataaaaatgtattcccatgcaatgtttgtgtcttctctagagacaaactcttaatgtaaaaccaccatcagagccaccctggagttatggcaaggccaccacagtctcctccaaaggccactgatatggaactgggaacctccctccatagaatgctaaatggctgatgtgaacttggttaaggatctataattcttcttacgaaggtaagcaagctatacaaatactgagaccaaacatcccagtcaaagcccacttaaggacaagcagaatagcacaacagagagctcgtagctccatcagacttgaaatctcctcacctcaggcatgccactcatgcagtgacaagaattaagaacctctgtaggttaatgttgtcccagacaaaacaattcagaaatgcaggagaaggggtttcttctccttctttggctacttatatggatgatccaagtttaaagttgtttaaatatttgagcttagtaataggcataatagtacattttatataaattaaatccccaattgttacctaaacattttcatcaaccagcaagaccagtgtctcaaaaagtctctacactaccttcccaccctggagtacagaaccactaggataactcccttttaaggctgagggttttatcaggagctctaaaactgcggtcattttccagacctcctgaagttatcaaaaaaagaagaggcttagggaaaactgagcatagttacttcttaggtcggggtctccaaagtgctctgcagatgccaaaatggcttcactttcaccccagacaacaatcatgaagcccctgagagccaagtgtatgagaccctccaaaggtgcctgtaaccaccaaatcagacaccaaaggagctactttcagaaagatagcaaagacctcatcttacacagaaatactaactggctttttaaaaaacatcttcaaatctgtttttttttttttttttttttttttttagatggagtcttgctctgtcaccaggctggactacagaggcacaatcttggcttattgtaacctccgcctcccgggttcaagtgattcttctgcctcagcctcctgagtagctaggactacaggtgcatgccaccacgcccagctaatttttgtattttttgtagaaacagggtttcaccatgttgaccaggatggtctcgatctcttgacctcatgatctgcccacctcggtctccaaagtgctgggattacaggcgtgagccaccgcgcccggcccaaatctgtcgttacagtacagatgtctaaggggtctggttattctaatcggggcctcaggcagttgtcattttggtgggtttattcatcaacatcatgtatctctgggttccattttatcaggttaaaatggagttaaaattcacagtgaacagataagaagacctcttcactgatttgtcagagttacaactcccaagcagctggagagcactaacgataaaaggaccaacccgcaactctggctttctgcctacacatccctgaagatctggcagcttctgtttgcatccttgtcataagacttcctcttccgttcagcaaaccttcctaagaagttacaatctcaaaggtcctacattccttttcactaatgtcatctgtccacagagaagtccacctgtggcaaactgctcttcataggcttgcctagtagagggtgatgggttctgtctttctaggtcaaggaactactttatttttgtcctgtaagcccttttcatcagttaaaaatatttttattaaggaattcatttaaaacataggctgggcacagcagctcatgcctgtaatcccagcactttgagaggtcgaggcaggtggatcacctgaggtcaggagtttgttgaccagtcagttgaccaacctggccaacatggtgaaaccccatcctactaaaactacaaaaattggccaggtgtggtggcatgcacctgtaaccccagctactcaggaggctaaggcaggagaatcgcttgaacctgggaggtggaggttgcagtgagcagagatcacaccactgcactccagcctgggcgacagagtgagactccactcaaaaaatcataataaataataataaataaataaaacatagaagatgcacattatcttcttacaaggggactcctacttgggcaaccaaactagaaaaacacagactaaatatgatgtgctcaggacaaaataaataaattgttcttcattgatacagactggcagctccagaaaaaaaaagttcttcccaggccccattctcattagcaagttcttttttttctttttcctttttttgagataaagtctcactctgtcatccaggctggagtgtagtagcacaaccttggctcactgccgccttgaactccccgggttcctcctaccttagcctcctgagtagctgggactacaagcatgtgcttctatgcccagctaatttttgtattttctgtagagatggagtttcacatgttgtccaggctgatcctgaactcctaggctcaagtgatctgcccacctcggcctctcaaagtgctgggattacaggtgtgagccaccatgcctcactggcaagttcttacagggctgttttgaagagccccagaactggcagcaggaagagtcagcagcatgcatgtccacccaggcagtctgcaaagtaaaacattttgctcccaagttctgacactatcctcataaccaagaagcatatgacctattacttagagaaacagtatgcaatatggtagccaccaaccatatgtggctacttaaattttgttcctagtcacatattttacagtttctattacagaaatattcaagcatctatgaagtagacaggatggtatcatgaatgcccccgtgcccctcaccagcttcaacaataatcaacttatgacttcacagctcctctacatccgcgctacttttcctctgctcccacactgctgtttttgtttgttggcttattaacaactttattaagacatatttcacatatcacaaaattgatccatttcaagtatataactcagtgatttctaataactttaccaagtgttgaaaccattgctataagtcaattttaggacatttccatccttccagtaatctcactcatgtccttttacagttaatgcccattcccgtctcccatcacaggcaaacattattaaaaatttaaataaaatagaatttacaattcagttcctcagtttctagccacatttcaattgctccactgggctagtggctactatactgggcagagcagacacaaaacatcccccgccccgcagcagaaagttctattgggcagcactgaactatagtgaacatgattagaaatgcagagactatgaaaagagaaggaaaattcaacagtttgacaggttggaagagtagacaaaaaggggtagaaaaatgtttctctggcacaagttgtcaagcagaggaaaaataaaacataacatgcaaagtaacagaggaactgtttacacataacagccaaagaaaatgagatgcagaaaatatacataaaaagccaaaaaaaaatgagatgcaacaatcaaagatcacaaaaagaacaggaggcagaaatttcagaaagcagggtgtcagagccagggaaaagcagaagtaatcttgccctctgtgtccagggaaggcttgcacattagcccacagccaagctcaaaataggagtcaggacaaatacttcacaatcttttgtgattagaatcagactcctttaagctctccccaccgaccctctttaactcagcagtgcaactattgttttcctcacactgctttatgctgtttaacttcaaataaaatgaaagaaccagatatttattaacacaacttttagttcagactctaagagttagtcacggcactcttaaagtctctgaaagtgttttacagtatcacaaatcaactagtattctctatcagaaacccccaatagtaaatgattccattaattattcaacaaatatttgttacatgccagatactcctactaggcactggagatagagctatgaataagatagagctatgaataagacagacaaggaagggcctttctcccatgaggcttgtagtcaggcaaactatgtgtttaactgcaaaagttaataaaaacgtgtaaactgtacatgtaaattgtagagttaaaatgaatgacaacttgtaaatgaaatgacaaatttttaacataaagcctgagcccaccagaccctgaaatccagaactccaaaaaaagccattattattagtaatttttcctagagctcaaatctacaccattaagcttgacaacaaagtccaaatgatagttttaaccagatttagatgaaccgtgcttcaccccaaaacacacaaccacgtttcaaggtactttgtaatttgcacatccatccctagggaaacgcctaggaatggaatacgtttctgagctctcattatgatcattatacacagcctctttccaaaccacataaaaaattctcgacacacacataccttattgttctcgtgatcgccactcacagctatgggatacatgacatatttccctccctggtcctcattcggggcacattctgctagaccatccggatcatgttctgctccaaaattatgtcccaattcatgagttgtaaccaggtcagcttccttaaggatcatgcaaagaaaacattatttctcaatatccagccatcacctacttctgccagttgggcctatgctgtcttaaatagagccttataatcagatcaacaagagaataagaactgcatgcttataataccagcactttaggaggctgagatgggaggattactttactctaggagtttgaggccagcctgggtaacacagggagaccctatctctacaaaaataataaaaaatattaaccaggtgggctaggcatggtggctcacgcctgtaatcccagcactttgggaggctgaggcaggtggatcacgaggtcaggagttcgagaccagcctggccaacatggtgaaaccctgtctctactaaaaatacaaaaattagctgggcatggaggcacgcgcctgtaatctcaactactcgggaggctgaggcaggagaactgcttgaacccagggggcggaggttgcagtgagctgagatcacgccattgcactccagcctgggagacagggcgagacttcgtctcaaaaaaaaaaaaaaaaaaattagccaggcatggtggtgcacacctgtggtcccagctacttgggaggctgaggtgagagtatcacctgaacccaggaggctgaggctacagtgatctatgatcacaccactgcactccagcctgggtgacagagtaagactttgtctcaaaaaagagtaataaccggactatgattcttctaccaattatatgaatttaacagaataagtaggattttatttaatactatcaaacattattgtaagtagtaacaaatcaatttaagaaaatgtaatttataagatatactggaacattcataacaaaacatcaaaccttggccatttcaaccacacacaatctggtgctgataaatgcaataagctaactgtagttaattgtccagcctcctcacatgcccctcggcccaatcacatgtctgttaaaacctaaagcatctcagcagaaaggaaaaaaaaagcaaggggtaaaaaaaacagtacggataggcgcagtggctcacacctgtaatcccagcactttgggaggccaaggtgggttgatcgcctgaggtcaggagttcgagaccagcctggccaacatagtaaaaccccatctctactaaaaatacaaaaaattagctgggtgtggtggcgcacgcctgtaatcccggctactcgggaggctgagacaggaaaatcacttgaacccaggaggcggaggttgcagtgagctgagatcatgccattgcactccagcctaggcaacaagagtgaaactctatcttaaaaaaaaaacaaaaaccacaactgaggaacaacaaaacaatgttttattttctcaatgactgaattcatgtccaataacaatcttaatgacctagaggacttggtttattagaatccagttgcagggctgtacttaatctatcagattatcagatgatttctatatgaataataaattttgccaataaagctaaaattttttttccatatttatctgaataaaatatcaaacttaaaggccaggcacagtggctcacgcctggaattccagcactttgggaggccaaggcagctggatcacttgaggtcaggagttccagaccagactggccaacatggtgaaaccctgtctctactaaaaatataaaacctagccaggcattgtggtgggcgcctgtaatcgcagctatttgggaggctgagccagaagaattgcttgaacccaggaggcggaggttgctgtgagccgagataggccactgaacccccagcctgggcaaaagagtgagagtctgtcttaaaataaataaataaaataaaataaaataaatatatatacatataaacttaaaattcctgagttcttttttcctaagggggggaaatcactccatagaacctgaaaaaataatattttgcaagtcatttttctatacaagaagtctttccacatgttcatattaaaaccgtagtgggaaaaaaaacttaaatttttagcaaaagcactcaaatcccaaaggtgtaatgaagagaaatatctcctaactgcttggggaaaattcattagtggatttgctaatgactcttaaaaaaaaatctcaaaaatttcaaatcaaattttgtttttttgctgtgtttttttaagaggaaagttctggaagaccaaagaaaatatgtcatgaaatcaagccattaagaagttgtgactccaaaaaagtaaaagcgtgagctactgtacacacatgtatgtttctgtccatggctcctggcttacaaccctccgtagccctggttacggtcttctgttataatgttggggtgctttagggctcaggagcaatcctcaggaaacagaatctctctctctgaccttctcctgtcctccttttacctgatccaaggcaagactctaatctgattgtgggtccagagatcctcattctcattctcattctagagagggtcctgccctttactgtggagggaggaatgctgcacagagaggtcaaggagaatctggacaggccttggtgggcttccccactcagtcggttagtatgagaacatacccattttgtccaatcacatttctacacagttgtcattcgtgcttatgtaatgaagcctccataaaatctcaaaaaacaggattcagagagcttccagagagcattttgaatacatggaggttgacaggaaggtgcaaaactcattcgtgtgccaggagggaggtacatcccaactccatggggacagaagctcctgtactcgggacccttccagacctcgccctatgtatcccttcatttggctatttctttgtatcctttcttttttttttattttttgagacaaagactccctctgttgaccagtacagtggcgcaatctcagctcactgcaatctctgcctcccaggttcaagcacttctcctgcctcagcctcccgagtggctgagattataggcatgcaccaccacacctggctaatttttgtatttttagtagagacgaggtttcaccatgttggtcaggctggtctcaaactcctgacctcaggtatctacccacctcggcctcccaaagtgctgggattacaggcgtgagccaccgcacccagcttctttgtatcctttaaaatatcctatgtaataaacccataaactaagttaagcttttccctgagttctgtgagccacttaagcaaattaatcagacccaaagaggagaatgtggaaaccccaacttgaagccagttggtcagaagttctggaggctcagacttgtaactggtggggaggagggaacagtcagtcttgtgggactgggccctcaaactgtgagatctgatactatttccgggtggagagtgtttgaattgaattggaggacacctagctgatgtctactgcttgatatgtagggggaaatccccacacgtttggtctggtcacacaagtcttctgtgttgatgatgatggttgtgatgtgagaatagagggaaaacacagtttgagagattttttcccctaaaacaaagtaccataagaaaaaaataaatttagaaattaaggccaagcacggtggctcacgcctgtaatccagcagtttgggaggccgaggcagacggatcacctgagagccagcctgaccaacatgaagaaaccccatctctactaaaaatacaaaattagctggtcgtgatggcgcatgcctgtaatcccagctgctcaggagaaagaggcaggagaattgcttgaatccgggaggcggaggttgcagtgagccaagatcacaccattgcactccagcctgggcaacaagagaaaactccatctcaaaaaaaaaaaaaagaaaagaaaaaaagaaattaaaagattcccaaaagctaattagtgtctttttcttttctcataccactctacattattgttcaacattgtccaacaatgatagactggattaagaaaatgtggcacatatacaccatggaatactatgcagccataaaaaaggatgagttcatgtccttcgtagggacatggatgaagctggaaaccatcattctcagcaaactatcgcaaggacaaaagccaaacaccgcatgttctcactcaaaggtgggaattgaacaatgagaacacttggacacaggaaggggaacatcacacaccggtgcctgtcgtggggtggggggagggggaagggggaagggatagcattaggagatatacctaatgtaaatgacgagttaatgggtgcagcacaccaacatggcacatgtatacatatgtaacaaacctgcacgttgtgcacatgtatcctagaacttaaatttaaaatataaatatatatatatatatatatatatatatatatatatatatatatatatataaataaaaagagacagggtctcaggccaggcacggtggctcacgcctgtaattccaacactttgggaggccaaggcgggcagatcacaaggtcaggagattgagaccatcctggctaacacagtgaaaccccgtctctactaaaaatacaaaaaattagccgggcgtggtggtgggggtgcctgtagtcccagctacttgggaggctgaggcaagagaatggcatgaacccaggagacagagcttgcagtgagccaagatcatgccattgcactccagcatgggagacacagcgagactccatctcaaaaaagaaaaggaggatctcgctaagttgctcaggctggaatgtagcgggtattcacagttgcatttatcacactacagcctctaactcttggcctcaagtgatcctcccgcgtagctgggactataggctcctgccaccacctgtttttaaatcacccaaagtccacagtttatgttagggtccactctttgtgctgtatattctatgtgtttcaacaaatgcataatgtcttatactgactgttgaagtatcatacagagtaattaccctgctctccacctattcatccctccctcccccagcatctagcaatcactgatcattttatagtctgcatggttttgtcttttctagaatgtcatatatttggaatcatatagtatgtagcctttcagactggcttattttacttagtagtatgcttttaaggttcctctatgtcttttcatggcttaatagctttttatttttttctcattttatggatgtgccagtttatccatttaccaactaaaggatatcttggttgcttccaagttttatcaattatgaattaagctgccataaacattcttatggctgggcgtagtggctcacacccgtaatcccagcactttgggaggctgaagcaggcggatcacctgaggtcaggagttcgagaccagcctggacaacatggtgaaaccccatctctactaaaaatacaaaaattagctgggagtggcagcgggcacctgtaatcccagctactcaggagactgaggcagaattgcttaaacctgggaggcagaggttgcagtgagccgagatggcgccattgcactccagcctgggtgacaagagtgaaactccgtctccaaaaaaaaaaaaaaaagaaaaaagaaaaagaaaagaaactgccaactgccttccaaagtggctgttccatttttgcattcccactagcaattaatgagagttcctgttgctccatagccttgttggaattgtgttgccagtgtttgggattttagccattctaataagctactagtaatagcacattgttgttgggtttcttaaagttttttatagaaataggatctcactaatgttgcccaggatgggtctcaaactcctgggctcgagcaatcctcccacctcagcctcccaagcaactgggactacaggcatgtacccctacaaccagcttcattgttaatttgcaatttcctaatgacatatgacgctgagcatcttttcatatgcttctctgctatctgtatatctttggaggtatctgttctgctcttttgtctgtttttaaattaggttgttcattttcttattgttgaattttaacagttctttatacatatggaaatttttatttatttatttatttttaattttgtagagacagggtctgaccatcttgcccaggttagtttcaaactcctgggctcaagtgattctcctgcctcggcctcccaaagtgccgaagattataggaatgagccaccatgcccggcctctttgtatatttcagatagcagtcttttctcagatgtgtcttttgcaaatgttttcccataccctacaccaagtataacatcatagtcaaaaaatcagtataccaaccagccctttaggaagccaaggtgagtggatcacttgaggtcaggggttcatgagaccagcctggccaacatggtgaaaccctgtctctaaaacaaaaatacaaaaattagccaggcgtggtgacaggtgcttgtaatcccaactactcaggaggttgaagcaggagaactgcttgaacccagaaggcagaggttacagtgagccaagatggtgccactgccctccagactgggccacagagcaagactctgtctcaaaaaaaataaaaattaaataaaaattaaaaatcagtatatcagatactaatatgtcctaccaacatctctctccccttcttccttacttaatgagccctaattttgcccaggacagcaatatactcagctaaaatagccagctttccacattccgttgaggctaagggcagccacgggacccagtgctgtccagtaacatataaacaaaagccaggatggggcctccagagaagctttttagaagggccagactaggctagccatgttctctttctcctcctttctccaacacagaagagaaccatcttaaaaccatgaggtgacatccatgaggacaaagacttcctgcttgttcttgagccactgagggtacctctgagttgctgtaccacccagaaaatgctatccctgaacttcttgttgactgagacaaataaaccccttatttaaaccactgcttatttaattttctgttatttgtagtcaaacacattttaacagacatagctggagaaaaacaagatcttaagatattccagagaaaaaaacaggtgacaaacaaagataagaactcaaaatgacttcagattctttagaagcaacatgcacagaagaccatagagaacatgagaactaagaatatactcagccaaaattatcaatcaggcttaagagtggaataaagacattttcagatatatgaaatcccaacaatatgcaggtcatctacgttttcttaggaagctcctgcaagatacactacaccaaaatgatggcactgagaaagagggagaccatggggttctgaaaataagagggtgtgggatgccttgaatgacagctgcactgcaggactaggagacagggagctctaagagttgctgcaggtcagaggggtccaggacagagggttcgagaaaagcagtggtcctcacatgtttcaaaagaaggctgacaggccatttttattttcttctttatgctttaattttcatatatcccacaaaaatacataaattttatttaggcagaaatttaaaaaacagtatatattacattttttaaaaaaatacctacataaatatataactgaggttctactacaataaactctaacactattcttttagaaataaaagaacatacctttgtaaggatggttttaccataattctttgtgctcgtcaaaccactattcaaatagatatttttcttcccaactgggctataataagctaaagtcaaaaggaaacagagataaattgcttattaaatacagaattataatataatccaatcatcttaataatcccagcagcatattcacacaagaaatggaaaaacttaccctttggacaaacacctccatggctgtttgctctgggagagccaacataagctaatccaagagttcccatatcaaaatcttggtatgtgaaaaggtgtgccaagcaaactttagatgcttcctcagctatatcaaagctaaattgctttgaaagaccaaaaaaaaaaaaaaaaaaaaaagcattcttagattaacaattacatcagactaaaagatgtaatctaaatcaactaaacattccagaacagaactatgatggcatgcagctcagcaccagcaatcacaacctcgtgcagtgctttgctctttccctaaagtgcttctccacctgcacaggtgagaggcacacactgtcatctgacaagggacacaaaagggaatagttcgggagcttgctccagctcttcagaactaactcactgctcctccgagggctgttctgaagacatacagcccaggactagagatgctccaattcgataaggggattgcagcactccaggccaaaacagatccctctcaagtatttcaaggattcaattggttttatagaaattttaatcttaaacttttttgagcttcataatatattgtcatttatataaatatacacttatagaaaagcatacatacccagttttatgttactaaaataaagattttacatccatttaaatcaacactgcaggtttgagaggattttttttttcttaatttaaaagggcttcatacattactttaaaaacctctaccataaccgtccagcgtctccaagtttaaaaaaaccttaatttggggggggggtttgatttattttgcttgagacagggtctcgctgtgtcacctaggctggaatgcagtgacgcaatcacagctcactgcagcctcgacctcccaggctcaagtgaacctcccacctcagcctcccaagaagctggtaccaaaggcgtgcctcaccatgcccggctaatttttgtattttttgtacaacatgttgcccaagctagccttgaactcctgggctcaaacaatccactgcctcatcctcagcctcccaaagtgctgggattacaggcatgaaccaccatgcctagccaaaaccctcaatgtttaaaatgctttaaatgagaggccagagagccctatatgaggaatgaagtgtggttacatggggattctgatagttccgtggtaaaaggatgaggcttctaagaatattctaggaggcttagggaagaaaactggagaggaccatctgtcaacataagtcatttttctctttggttcctcccctgccatgggctgtctggaggctcacagaaaagcagacaggcgcagtggttcagctgttctaggagtcaggagatctgtgctcaattcaacctctgccatcaccagttgtatgactaatcagacaagtcatttaatcttcctgctactggctgaattgtgccaccccacaattcaaatgttgaagtcctaaccctcaacagtaccccagaatgtgactctatctggaaacagggcccttaaggaggtaattaaggtacactgaggtcatatgggtgggccttaatccaatatggctggtgtcctgataaggagatcagaatatacacacacactgagggaaggaccatgtgagaacacagggagaagacagcatctacaccacaagtaccttggcctcagaagaaatcaaccctgctgaccccttgattttggacttccagcttccagaactgtgaaaacccaaacttctgttgtttaagtcccccagcctatgctgctttgtcatgtcagctggaataaacagtaacacttgctgagcctcctcacaaggatgctgtctcaaccaacctctcagggtgctcagcagatcaaattagacaaggtatgaatgagtaccacacaggtgctgcacattatgcttctccatctggatgaatagttataatatcctttaattctattgaagctttgaaaacttgatttcagcctcatgagaccctaaacaagaatccagatgagccacaccatacctggactagcccatgcaaactatgggataaataagtgttgttctaagctgctccacttgtgataattaaagcaacaacaagaaactaataaacttgccaacacattaaaagataaaaactatcgcttcatataaagtcattctacaccaaagtaatagcacacacaaactcaagacactggaatcacatggcagcaccctgttatacggcaagactccaaatgacataaaatgattaagttagccatctttagattaatcgccagaataaaaacacaaaaattttaaattcctgtagagaactttcagatctccaagctatatttctactctccaatacatgttcataacctgtttgataattactgccctaaaagataaattgataagcttcagagagagctgaactaagtgtgcagaactaatgaaacagtgtgcaaaaactctatatattgggtatccatgttattttctagagaagatccactgattgtctcattagatcctcaaagatattaaggttaagacgcactgctttggccgggcatggtggctcacacttgtaatcccagcactttgggaggccgaggcagacggatcatctgaggtcgggagttcaagaccagcctgaccaacatggagaaaccctgtctctactaaaaatacaaaaattagccggccgtggtggtgcatgcctataatcctagctacttgggaggctgaggcaggagaatctcttgaacctgggagatggaggttgcggtgagccaagatcacgccattgccctccagccagggcaacaagagtgaaactctgtctcaaaaaaaaaaaaaaaaaaaaaaggaagcattgctttatagcgtttttctttttcatagagtttttgttatttgttgtctatgctgctacatgggatggggttactgctggatcagctggaggagactgcttctgggtgtccatcttttctaacatgctccttcattaaaacacatacaatccacatatcagaaatgacaaagtggtgttagcaccatatccaggattctaagacctacctctagcaacatcttcacatcccaagcatccttttcttcatttgggtaactttttgccatgttgtagtgcttttcaccaggttttacctcttgtggagacttgagaatgcgaatctatacttaaagagatcatatacttagaacacttccaaaataagtcagaaggctctgaatactgcattattttatctgttcaaaaaaagaatcgttctagaaaaaaaacattttaaaaccaaaattcataaattcttcagtaccaatattcaatgtttgaaacaaacagagaagcatatggtatggaaaacatatgtcaatgaattatttataatattataaatgtactcttaaattttcatatcctccatgtttattttgaaaaaataagaacttgggttacaggagcctaaaatatttattacgactacagtcgacaactcaggaaagaataataaaatatacatctctttgtgcatcaaaggaataaaaggctaagaatagagtcttctccttatacaggcatttcagacaaattcatattaaacctgcaaagaagaaaaaaaaaagtaacaaaggctcccattagtaagtgtgagataaagaaggaaaccatgctcagctcagagtttctgtgagtctctctgcctgcctgcctgcctgcctgcctgcagagaaggcccattctggtctcctctgccactgtgtggtaagtttactggggtggactctgcagttttgatggtggctggtcaaggtcaaatctgggatagaactacttagaagcccaccatgatacacatctaaaccacaccctccaatccatccttcatcagatgtaaagaagttaatgttttaatctcctatattattcctgtttcttcgactggttccaaatgcctaaagcaaaaagaaaatttacaggttccctgaaactcaaacatgatgcagctatttataataaaacaagtgaagcagctttacatgcatgaacatgaagtactctccaacatactgtgaaatgaaaaagcaaggtgtaaaagtgtactgcatagcaccgttgtgtcaaatacagacatatacatacactatacctgcatacgacatctctagaaagatacatatgaaactagtgacatgaatgtctttggggaaaggaactggtttgacaataaacaggctgcagagacttacttttcactggcttttgtactgtgtacatgttacctattcaaataataacttaaaaagaaaatgcgtaacagtgaaagagaatgaaaagggaaaaataattctcttagttttatacaagtaatatcaaagtttaacatttataaacatggtgaatgatttttaaaaattttttcaacctctaaattctatactatataacttataaaaatatggtttactacaaaaagcttggaaaaaaatagagataacaatttatataatttacatatcaaaatgtctctctgcccaaagcaataccctttgtcagaagcctttttaattagtcctagcaatttgaaataacttttaatatgagctattattaagatgacattaatataacattactagacacactctgttaacagattacaagaaatcagaaggagatatctgagaggaaagaacctaaaggttctgtatatataaatacagccttgcaaaggtacacagtattttttagtaaattttctgactaaggattcaatggtgcatgccagagttttaactaaagacttaagcataatcggaggggggaagaaaactacagagaatataaaggccatgaattcaaagaaggaacaaagcacagcagcataaaaggctttctacctaaagcgagactaaggacagaaaacttcacaatctagaactaattaacatcaaaaatactgcacaattcatcataaaaaatcattggcatctgagaaaacttatttacaattattgttaaggacaagtttttaggttttgaatacaagtgacaaatatttacattacaaaacttaagtaatataagccatatctattgataaatacctgctctatctgtattccatagcctttaaaacctgcattatcccatgaagtgttccgatagatgtcatcaactctgtcaattagctctatctgtgtgtatttaaaaaagaaaaaagacattatgtaactctttacctctcctggcaatgcaatataaaatctatggggaaagaaaaaatctcagtttagaggccattgcaaaagtttctactttcgcaaaaactagcattgagatgttactgtatcagagtattcccaacctttggccccaaacttaaagtgctgttaccagaataaaacaatggtatagtttaacctaaatttcaggtactcaattgcacatggaaccaaaatgacaagtaacaggcttttttaaaactaccgtttcagccaataataaaaattaaatttaaaagtcaatcagtatacctgaaatacagttgacccttgaacaacagatttgaacttcaagtgtccacttacatatggatttccttgagcctctgtcaccagagacaatatgatcaactcttcctcttcctcctcagcctactcaacatgaagaccattatgatgatccacttccacttagtgaatagtaaatgtatttttctcttccttatgattttcttttttttttttcaagagacaaggtcttgctctgtcaccaggggtgcagtacagcggcacgatcatagctcactacagcctgaatttctggactcaagcaatcctctcacctcagcctcctgagtaacagaagactacaggcacacaccaccatgccgggcttttttttttttttatgattttcatcataacattttcctttctctagcttacttgattgtaagaacacagtaataatacatattttaaaaatgtgttaatcaacttattttattggtaaggcttctggtcaacagtagactattagtagttaaatttttggagaatcaaagttatacagtggccgggcatagtggctcatgcctgtaatcccagcaccttgggaggctgaggcaggaggattgcttaagcttagaagtttgagaccatcctgggaaattctccatctctactaaaaatcaaaaaacttagccaggaagggtgaacacctgttgtcccagctagaggaggctgaggtgggaagattgctttggcccgggcaatagaggctgcagcaagctatgatttcaccactgcactccggcctgggcgacagagccttaaaaaaaaaaagtcacgtgaggattttcgactgcagagggaagaaggtcagtgcttctaaccacacccccgcactgttcctgggtcaactgtattcccttctaaaaagaattccatcttcactctatctcttggtgagtacctcgaatgtcttccccagaaacaagtaaggggccgtggcagacaactgccaaccctattcccccactctcaccccaaaaagttcagcactgaggaatgggtaagaagacagccagaaagaacaaggttcatttcagcaaccctccttcttttgttctctgatttgggaaaactggagaaggaaggcagtatagtttccaaggaaaatgacatgagaaagaacaaaatgctaattacctatctttttctcaaagagaatattctactgttcaaaaactgggttgatgaggtttgttctagcaactgtgaaacaagttatgcctaagaagttgtaaaaaaatacaatttttaagactagatctctcattatattcatatttatagtgcaatgaacaaagaagtaaaataagaggagccccttaatataaaacccagattaagagagaagctttttaaagtaaaaatctctcttatttaggaacaagaatcacagtgactcttactagcctcataataaattcacttgatatggggccgagtgctgtggttcacgcctgtaattccagctacttgtgatgctgaggcaggagaattgcttgaacccaggaggtgggggttgcagtgagctgagattgtgccactgcactccagcctgggcgacacagtgagactctgtgttgaaaaaaaaaaaaaaaaatccacttgacatgaaagggaagggaaagaagttgggagggtatgaataaaatggacagcatgggaaaagcaaggcaatgagaaagacatctttactgcaccagcttcttcttgcttcatgaatagctgcattctccattattccctcagtaacaacattttggtcagtgccaagtaatcatgacgaatgaagtcacactagcaaaaaatgtcaatgaaaaatgattccccagacttcaaaaatcataatagttcatacttaaaaatccagtatcatcacttcttacatctttccttcacttctgtgccctagaactagttatgaccatgaaagtcccacctatttcaagtgaagtccaatgattaggtctttaacatgacaaacaaaactcgccttcctctctgaaatatacatataagcaaaagaaaaacatgggttcatgcaaatacatatttttacattcacatgtgacaccacaggttcactaccatgatagcagtgatgtttttaaagaactcacttatatcaaggaggaaggactacattataacctctcccaaaccctatatgcataaattctaacatgcagaaaatattagttcaagggtaaaatgggttgtcacaaatttgaaactataatttccatacagtaacataaaaacctcagagaatatccctcaaatattttagggaaataacagagtatctggaacagatctggttgcattaagtttcatggaatgtacccacccaaatttttttttcaattactcgatgcaatatcaaatacttactaagtaatttgtagttgtactctcttcccctctgcccatgtatctgtagaagcgatgatctgctaccaccaataatttacacgtgttcttcatgggatctgggtcagctcttcttttcactcgatgaacaagctctaatatgaatttgtatgcactattaaatcaaaattcaccaaaacaaggagttttatggtaacactttaaatctaacatatttttgaaacaaacattatgtgagcttaatatcactaaaggattctgaacaacaacaaaaaataatttggaggaagacagaaaagtgaaaagtaacataaagttaaaacactgtagaattcaaaaccaaggacaagtgcctctttaatttttccaatacagaaactttaaaaagtgctcaacagagtaaggccgggcatgttggctcaggcctgtaatcccagcactttgcgaggccaaggtgggtgaatcacctgaggacgggagttcgagaccagcctggccaacatgatgaaaccccatctctattaaaaatacaaaaattagccagatatggtggcacccgcctgtaatcccagctacttgtaaggctgaggcaggagaatcacttcaacccagggtgcggaggttgcagtgagccaagattgtgccattgcactcaagccagggcgacaaaagtgagacttcatctctaaataaataaataaataaatagtgctcaacagagtaaaacagtcacctaatgctgggctatgaagctgtcagtcatattctacaacaagaagtttatgaattaaccaatgtaacagtaaaaatgtcaagatattcacattgaaaattagtttaataggacaactttcttgtgaaataaattaagaatttctttatttatatattaaaatgctaatatataattttaataacataaccgtctttggccgggcatgttggtgcacgcctgtaatcccaacactttgggaggctgaggtgggcagatcacttgaggccaggagtttgagaacagcctgaccaacatggtgaaaccccatctccactaaaaatacaaaaattagccaggcctggtggcacatgcctataatccagctactcaggagtctgaggcaggagaatcacctgaacctggaagtcaaaggttgcagtgagccgagatcgcgctgcaaacaaaacaaaacaaaacaaaacaaaaaacctaaccagaggtgttttgggcagtaaaattccaagatggttacgttttttaaatgaccctaaatggattgtcccaagatggatataaccttcttgtattctaagcagtatatatataggtccctcctactaccaattaatttcttataaactctaaagattgtctttccaccatattattttatcatttctaaatatctgcaggaatattttccctcagatcactccatttcccttttccctaatcttttttaaagtctaatctctgttgttcccattattttccagagttttcaactcttacattataaacaaaagaagatgaaaatttctggaacaaacctcttattttcatgccaaatactatagttacttgacaatcatgttattttttaacaaataacaaccacccctactgaagtcaattgtagtatgtttgtttcttatttgaaatacactctttaagtcttaccttcaggtggttctctgtctactaacccttttgggagcaactcttcattatccacttttaaataaccacacacttttggagactgcaaacgtgaaacattcttgatatcttcagatttataaactaacattcttttgtctttggtatcattaacaaatctccaaagtggctaaaacagaaaatatatacgactgagatggaaaacaataataattcctaaacactaaattcttctaacattctttgcttgttcttagataacattcatttctaggttaagtaaactgattagtcatgttattaaaataaataatctcaatttttaatcatatggagtttctatgcaggaaagtaaatacatagattataaactctgattattttatctgtatataaataaagccttacatactttgcacgttgtgaaatctttcagaggatgcagaagagaaaaatgcatatcattttccactcattcattcaaaaatattatgtaatatctactgtacactggcactgttataggtgatggtgctatagtaatgaaaattggacaaggtttctgttcatgcagcattttcattttagtttccttaatacttaggtgtttgacacctttttgccacgttaggttttatccacacaaaagaacaaacatatttatatgaaagaaaactcagaacttgtaacaataggtctgaaccttattacttgtttcagcgaacgcagtttttaaacaaaatctccacttacaatgttacaaggccagagtaaatcacaattaacatactccaaaggttacccaagtcaaaaggctgtttgtttgttttgtttcaaagcaaagttattctctgtaagaacactggtctcatcagaaccaggcagtttgtggggggacacacaaaaaatatatttatctccatcagggaaatgcaaatcaaaaccccaatggggaaaaaaacccccacaatgagacacccctgtatacccactaggatgactatgatcaaagacaaatactggtgaggatgtagagaaatccagaaccctcacatatgctgatgagaatgtaaaatggtaaaaccactttagaaaacagtctggcaggtcctcaaaggttaaaagtagaagtaccatatgacccagcaattctgctcctagtatataaccaagagaaatgaaaacacaagcagtaatgtaaatatagctaaaaagtggaaacaacccaaatgtccatcaacaactaatcaatgaataaacaaaatgcagtttatccatacaatggaatactattcagcaataaaaataaataagatacagatacatgctacaacacagatgaaccttggaaacattattctaagtgaaagaagccacacacaggctgggcgtggtggctcatgtctttaatcccagcacttcgggaggccgaggcaggtggatcacttgaggtcaggagtttgagaacagcctggccaacatagtgaaaccccgactctagtaaaaaatacaaaaattagtcaggcatggtggcaggagcctgtaatcccagctacctgggaggctgaggcaagagaatcagttgaacccaggaggcaaaagttgcagtgagctgagatcatgccactgcactccagcctgggtgacagagcaagactccatctcaaaaaaataaaaaaattgaagccacacacaaaagacatgttatgtaattccatttatatgagatgacccaaacagacaaatctaaatagacagtagatccctggttgcctagagctgggggagttagggaggaagggggaagtatggctaaaggatacagcgtttctttttcaggtgataaaaatgttctaaaattgaatgaggtggtgtttgcacaactccatcaatatacgaaaactgccgggcgcgatggctcacgcctgtaatctcagcactttggggaggccatggtgggcagataacttgagtccaggagttcgagaacagcctgaccaacacggtgaaaccccatctctactgaaacacaaaaatcagccgggcatggtggtgggcgcctgtaatcccagctactcaacaggctgaggccacagaatcacttgaacccaggaggcagaggttgcagtgatcgtgccactgcactccagcctgggtgacagagtgagactccatctcaaaaatacacacacacacacacacacacaaaactacaaaattgtatacattaagtgggtgaataatatagtatgtgaattttatctcaataaaactgttaaatattatatgcatatacatctttggtaatccatgtatgaggcagatgtaagaaacaagggttacagaatttcagggttggcagagatctcaaaagttaactaacccaacttccgggctacaggaatcttccatatttagtaaagttcatttagcctatgaataggagtgaaattttttttcttttgggtcaaacatttctaagttcacattgattgtttcctagtatagtcagtccagcacagaaaaagacagctggctttgggatcagatatatctgagttcaaacctcaaccatacctcactatgtgccttggacaagtaccctgagcataacctccctcattaggtaaagtagtgataatacctaacttgaagattatgaagattatgtaggtaataaatctagttttatattaacatttcaaaagaaaagtggttgttattaataaaagctaaggctattaccattattactagtaagttgctggaaaaaataatttgatgagtaattgactaaaaggcagaaaactggattggatcctggactggaaaaccaaaaaaaatctacaaaggagattttgaggatgactagagattttgactatggcatgattattagataatattgtagaattcttgtcattttctcaggtatgttacttttattacagctatagaaaagagtgcctttattcctaaggatgcatacagaagtatttaggggtgaagggtcatgatgtttgcaaatgattttcatatgattcacgaaaaaaagagagaaagctaacaggacattatgttagaaattgtttaagggctacagggtattttttaaaaaaatctttctgtaactacagggtactttttaatctttctgtagatttgcacattttcttttttatttttttctgagacagagtttcaccctgtcacccacattggagtacagtggagcgatctcagctcactgcaacctctgtctcccaggttcaagcgattctcccacctaggcctcccgagcagttgggattacgggcgcaagccaccaagcctggctaatttttgtatttttagtagagacgaggtttcaccatgttggccaggctggcctcgaactcctggcctgaagtgatccacccacctcagcttcccaaagtgctgggatgacaggcatgagccactgcaccagctgaacatttttaaaactagaagctgggggaggccaagcatggtggctcacgtctgtcatcccagcactttgggaggccgaggtgggcagatcacaaggtcagaagttcaagaccagcctcactaacatggtgaaaccccgtctctactaaaaatacaaaaattaggccggatgcagtggctcatgcctgtaatcccagcaccttgggaggccgacgcgggtggatcacctgagaccaggagttcaagaccagcctggccaacgtggcaaaaccctgtctctaccaaaaatataaaaactagccgggcacagtggcgtgtgcctgtaatcccagctacttgggaggctgaggcaggagaaatgcttgaacctgggaggcggagactgcagtgagccgagattgcgccactgcactccagcctgggcgacagagcaagactccatctcaaataaataaataaaagttgggggaaatattatctcactatgcaagtttaacccaggattatttatataaatagtaagctatggtaaagtcagtgacggtttaaaatatttaacggctgcgcacagtggctcacacctgtaatcccagcactttgggaggccaagcaagaggattgcttacagtcagacatttgagatcagcctgggcaacacagtgagacctcatcaaaaatctgatacactctacaaaaatttaacaaattagttgggcatggtggcatgcacctgtagtcccagctactcaggaggcagaaaagagggattgtttgagcccaggaggtcaaggctgcagtgagctatgatggcaccactgcacttcagcctgagtgaccaagtaagactgtcataaacaaaatatttaatgatgatgtgttaaaaataagatatatattttttcctgctcacttatattcctaagatattagtgcagatagacaatgtttttgcatcaaggtaagtgtaaagaattattttttttcatgtcagactggtaatgtgctaacattgtaacaaggttctagggtggtacatctcatatgtgtgtgtgaacagccaatcaccacacttatgaactataaaagtatcaaaagaattataaagagtatgaaaatcacccctgtaagtagtaaatcattttttcaataaacattattaatttcatgcaaaagtccctcaaggtatctgatgagtatacttgtaagtaaacatctttgtgtgtgtgtatgtgtgagatagggtctcgctctgtcacccaggctggagtgcagcagtacaatctcagctcactgcagtctccgccttccgaattcaactgatcctactgcttcagcattctaagtagctgagaccacaggcatgtgccaccatgcccagctaattttttttttttttttttttttgtggaggagtagagacaaggtctccctatattgcctgggctggtctcaaattcctgggctcaagcagtccacccgcctcagcctcccaaagtgctgattacaagtgtgagccactgtgcctggctaagtaaatatcttacaatgaaatattagttatactcatttttgtacttagtgaaacaaaggtatggatggaaacagaattcctatttttccaaaaggaagtatttgaaaaaaatgagtaatctagctgggcgtggtggctcatgcctataatctcagcactttgggaggccaagatgggcagatcacgaggtcaggagttcaagaccagcctggccaacacagtgaaaccccatctctactaaaactacaaaaattaacggggcatggtggcacacgcctgtaattccagctactcaagggactgaggcaggagaatcgctttaacctgggaggcagaggatgtggtgagccgagatcgcgccattgcactccagtctgggtgacagggcgagatgccatcttaaaaaaaaaaaaatgtaatctgagcaaatttaacttggatcctaaagacacatattttggcttaagaattaataagctggccaggcacagtggctcacgcctttaatctcagcactttcagaggccgaggctggcagatcatgaggtcaggagatcgagaccatcctggccaacattgtgaaaccctgtctctaccaaaaatacaaaaattagctgggtgtggtggtgcgcacctgtaatcccagctactcgggaggctgaggcaggagaatggcttgaacccaggaggcagagtctgcagtgagctgagatcacgccactgcactccagcctggtaacagagtgagactcagtctcaaaaaaacaaaaaagaataaattattctaaggaaataagcagacatatgcactgcagcaaaaacaatgctgtgcatttaccacactattttctctttctgagctcaaattacgactatcttttccattctcctttgtagcaggtcagagataaagtgttctagaatgtattgaacggaaggccatttccaagcctggcccttaatatcctgtataattctctagctctgttttctttctgtgagaactacagaggacatgtgtccaaaagtcaaagccacaaagtagaggagaaccacctaacccacatcaagccacaggagagtaagaaaaaactttgcttgtgttaagctactcagctatgggagtttatctgaagccctcgcacagcctagacagagcttcctacagtttcttcatttaacttcccagactattacctatcatccagactattccaactaaacacatgcaccaaaaggtgtgcccaaggctgttcactacaataccttttatttcaaaagttagaaacaaaacagttgaggccaggcacagtggctcacgcctataatcccagcacttttcagaggccgaggctggcagatcatgaggtcaggagatcgagaccatcctggccaacatggtgaaaccccgtctctactaaaaatacaaaaattagccaggtgaggtagcatgtgcctgtagtctgagctactcaagggtctaaggcgggagaaccgcctgaacccaggagccagaggttgcagtgagccgagaccacgccagtgcactctagcctgagtgacagagtgatactccatctcaaaaaaaagaaaaaaaattagccggacatcatggcgcacacctgcagtcccagctacttgggaggctaaggcaggagaatcgcctgaaccggggaggcagaggttatagtgagccaagatcacgccattgcactctagcctgggtgacagagcaagactccgtctcaaaaaacaaacaaacaaacaaacaaaaccctaatttagatctatattaacacgaaaaggttcataatcatattgttaaacgaaaaatgtgtgaagacaaactgtacatattgtatggtcctagttttgcaggaaaaaatagtgggtataactatatttatttgtgtatttacacatagaaaaaaaaatttggaaggatgtctgtcaaaatgtcaatagtagttatctgtccaagtacagataatctattttccgaattttgcaatgagcatatattttaaaataaaggtattcttaaaaaataaattgatttgaaagaacaggcaaatttaagacattccagtgatgctttgcctattctagaatgaatgcatttataatattagttcctttactttctactaaatttctgactctttctggtaggccagactcctcaaaacattgacattaaatagcttaaacattaacaaactataacatactgcaaggccataggtttctttttcacaataatggacagtcaaaggactaacagtcatgtagattggatataattaaaacatatagtatatatagctccagcagactgttttacccctattaagcactcaaatacacctgaacatttcattttgaccaatcttactcagttttcccacaggtgatctattttagtgatatcaccaccaccacccagagtcttctcatttttcaggaaacacagaatcaacttcaattcacaattatgaggaaacgttttgttttgtagactaatatctgacagatagatatgtgtcttaaccaatgcagccactgtggtcttgatttctattgctactctttcaatggaagagtgaccacagcctgactttcctagcttcctctttaacttctcagactatgaactaccacctttcattgatctagcatttccagtgtgtctagcagaaaaacagagaaattgaaaaataatacttcacttttcatttctgaggatgtttacatttattatttgagaaagaattaaaaaatgagtcaggagggaaagaaagttttctcttcctattatccatcccacatgtaactctctcaattatggtacttagaaatacagggtgtatcataacacagcttcttagagattatccttttttaaaaagtctactttcctagtaaaaaacttcaaatacgaagaggaaagaaataagtataattacttttcacctttgcagaactgagcagctttttgaaaatcagagatataagctactgaaaaaaaattcacatataaatttacctctatgttatattcggccccatctgtgttgattctgattataacatcatcatctcttatgtgggctagaaccctagagtcaggctcaccttaagagaaaaaaaaaattattatttaaaaatacttacatcaaataagaaactatgcattactctcaataaaaattaaatccttcagggtggaatttgcctagtactgtgagagctctgcaaaacaagaaacaaaggctccagaaagaagctagataatctcaactcctaaggggtagcctcaagtttagtcacttgaaacctatccctttcccaaaacaaacaaaactgctaagattttcttctggaataattttatctacttctaggtaaaggaagaactaagagagacagaaagcatgatttagaatgtacaggcctaggaactatactatttgtggatttcaatgacatttttttttctcattgcagaaaaaggtcaaaaagtaaactgcaattgcttgtttgataaattttctcaaatacatacgtaataggatcaccaagtattttatctccaagcttccctgtttaaaatatcataaagaaagcttacagtcactgaggaaaagaaaggttaaattcctatcacttaagaagaatttaattttaatcattaaaccagccagctagtatgacatttagataatactcatttccttctattagaatgttcctgcctctaaacttatatacctcaaagaaaagtcaaagaatagcacttctatgacaccccgtccccactatcctgcaccagaaaagaatatgcaatcaagttagatttggagacctaatacaccagacacaggggcaaaccaacaagctccatactaaccaaccacgtgtccagtgaagaagtcctgccattttacagtgtactcgctttcgtttttaccatccaccaccacgaccttgaaattttgtgaaaaacgttcagtacttgatgtcaggtataatttaaaatgcctgaagaaaaatgcattcatattttactctaagcacacaaattttaagtctcattttcacataattaaactttcttaaaaagccagaagcattgacattaataaaacactatgcaagttacaactaaagtcttattaggtacttagagcaatatatctcctgtaacgacaaatgaactaatttatttagctataaaaacagcagatcacaataaactcacactagggtaaagatattcaaagaacttatacattcatctctcctggaaaacactgaagaataaggaaacacacatgactgcgtagttaagttggaatcctgattatctaaaaaaattattatcaaaaactaatcctattatataccatttattgaacacctacttggtgttaggtactatgcatctattatccccacttcacacaagtacaaattgaggcttggaagctaatcaacctactcaaagttacacagctagtaaatggtgaaactgggaaataaacctggtttatttcaaaaccctgtactatgctgtctctatcaagctgggtggactatgagaaaattcttattgctgtgcaaaattaataaatgctgctttctatatttaaaagtactcatgcggccgtgcgtagtggctcacgcctgtaatcccagcactttgggaggttgagctgggcggatcacgaggtcaggagatcgagaccatcctggctaacacagcgaaaccccatctctactaaaaatacaaaaattagccaggcatggtggcgggtgcctatagtcccagctacttgggaggctgaggcaggagaatggagtgaacccgggaggcggagcctgctgtgagccgagatcgccagcctggttgacagcgcgagactcccgctcaaaataagaaaaaaaaaaagtactcgtgctttttttcctcctcaaaacaacatatcttgcaaaaaagtaacccacaattacagttaggaaaataaatacaaggtatctaagacagacattagaatatagactccattggcaccagaagacaggaaaagaggggaggggaggggaggggaggggaggagagggggaggagaggggaggagagggggaggagaggggaaggggagggggaagagaggggaagggaaggggaagggaggggaagggaggggaggggaagggaggggaggagaggggagggggtatacacttcagttctttagtgggcttactattctttttgttgagtttcagtccagttctttaattggcttactattctttttgttttctatgactttccatccttacatgaaaactaggagtggtgagcaagactttctcaagtattatttatagtctttcaatgtgtccatgaacaccaaagacaaagaaaggtatattattcatctcacccacagaaacaaattttgtcagctgttgtactgaaaatatattacttccccatgggattgcaaaagtctttaaactaccggaaagaaatctagactgggactatctccatggcaacaaatatttttaactttttgagcataacaaggtaattttagtttgcttgtggttttttaatggtcaaagggaaaagacaatagaacattatttcgtaaatccttggaacattttcttctgctatcctaaaacatatcttcccacacattctcagttatgatttttccctccagttatgctgagaactttcaaaagcatacttattataaatgtcttattattttgttttaaagctaagagttgcaacattacttaatgttcttttcagaaagaaatcagtggaattgcatttttcatttgctacattaagaatcttttctaaagataaagaccaagcgattataaaattcatgttttttgattttccaatattagcttttgagttataaaacgtccaacagaatgtcaaaatttcttttactttatcctcccaaaattatgtgaagtcattttcttacagatttctttaacgttttatctttctgacttttgacttaagaatttacagtaactaaagaccagctaaccagtttgaattaacattattaccctaaccatttttaatggtccatttagtcaggtatatcactttcatttctttatcagttctagaccttctcaagtaatctgatatatttcacttttaggagaaacatttaactttttccaaaaaaattcaggcaacatcaaaaaagtatcaaaacagtatatactccgcagctttttcgttatttaaaaataagataatttcttgatttttttttttttttgagacggagtctcactctgtcgcccaggctggagtgcagtggcgcaatctcggctaactgcaagctccacctcctgggttcacgccattcccctgcctcagcctcccaaatagctgggactacaggcgcctgctaccacgcctggctaattttttgtatttttagtagagacggggtttcaccgtgttagccaggatggtctcgatctcctgacctcatgacctcatgatccatccagctcggcctcccaaagtgctgggattacatgtgtgagtcaccacgcctagctgataatttcttgatttataacaaaaaggaaatgaaacttgtaaggcaaattttaaacaagtttctttttttcttaagttacttcaactcttcatacaacctctcagtgtttctatgctttttcaacctctaatagttacatccaaatttaatgcaatgatcttggtttaaattactttgccttccactgctatcgaaaaacggaatcttctcatttaccatcaagtaatgaggggtttcatagagttaattcagccctgatacaaactgattacttcagctatctttgtttttgttcttgttttaaactttaatgacgcaatatgatagaaaagaaagggtatgggctttggagtctgacaaacttggcttaagtcctactttcatttactcactgtccgaccttggcctcaatctttgaatcctaagtatttatctacaaatggaaataatatcacctaataactgaacggttttggggattaaaggaaataacctattttaaaacacctggtataaaattccatagactgttagataaatttcccattaaatatttagtatggaaactttgtaaaataaattacatacttccctgctttcttacacagagaaaagataacaagtggctacgatttaatattttcttagggaatcaatgtcatctacgaaacttgaaagagaaatatgtaaggctatggaagtttttgcctctagaatacggattctacaggccacttcaaatccaaagaaacccaaaaagctaaactttgagttcttttcattttatagtttcctcactcttccttcgctcctacttatttcttgctactatatccacttcttcaccaaactctccaccagtatagcagaaataacacaagttttggagtccaacctttgttcaaatcttgtatctgtcatttactagctgagtaatcttgggcaagttactaagctgtctaagccttaatttttttttttttgttccttcaaaaaaggaatcacttttagagataacttatgtaaaatgccagtaaattacagaaaataagtacctgattaactgtagctattaatattaccaatctgctcaaatttggtgtaagttgaaagctaataaccaatactataatattctgacataaaatcgaataaaaagaagtcattaaaaaataacctaaggataattgcaatagctaggaaaaattaatttgcattaaaaatttgcctaaaataaccacatgacaatgaaccaatctccttaatatactaagcactgctacaattcagtagttagaaagacaaattcaatagaaaaatagtcaaaagagataaaaaggcagtttacagaaatataaaacaaattacttacaaatatataaaaagatgctcaatgtcacacaaaatgaaaatcaaaacaactataaaatgccatgccctttagaggggtgacagttaaaggctgataaacctactattggcaaagataacaggaaacaggtaaactcatatattgctgctggaagaataaatttgtcaaatctctttgggaggaaagagcaatatcaataaacatagtatacatatccttgacccagtaattctccttccaggaatatatcctataaaaacacctcatcaaggtacacatttacaaagatactcactagagcactgtttgttgtattaaaaaaatcactttggttaaacaatatccatctgtagtgtattagtcagtatgttgttacaattctatgcaataggaatatttatgcagctgtttaaaatgaggtaaatatgctatctatatcacctatacacacacagagacctataggcaaaaaacatgcattaaaatattttgggtcgggcacggtggctcacacctgtaatcccatcacattgggagcctgaggcaggtggatcacctgaggtcaggagttcaagaccatcctggccaacatggtgaaacctcatctctactaaaaatacaaaaattagctgagcatggcagtgggctcctgtaatcccagctactcgggaagctgaggcaggagaactgcttgaacccgagaggtggaggcttcagtgagctaagatcgtgccattgcactccagtctgggcgacaagagcaaaaactctgtctcaaaaaacaaaaaacaaaacaaaacaaaaaattggaagtttacaaaggaaacctctctgggtctgagaagtctaactgagttagaagtaaaaactttgcatatcctccatggcttgttttttaaaccagacgcacatattccttttattttttaacatagttgagaaggcttgtcctatataaagaataaagatggccagatgcagtggcccctgtctgtaatcccagcactttgggaggccgagatcgtggatcacttgaggtgaggagttcaagaccagcctggccaacatggtgaaactctgtctctactaaaaataacaaaaatcacccaggcgtggtgctgtgcacctgtagtcccagctacttgagaggctgaggcacaagaatcgcttgaacccaggaggcagaggttgcagtgagccaagatcacacaactgcactccagcctggacgacagagcaagactctcaaaaaaataaataaataaagaataattcagtcaattctccatgtgtctgttttttgatactgaataaagcttcctaaagactttaaaaagaggcctgcaattatttaacatttcaatgtgcaaaacaatacgtggtattaaaattactactgaaatagaacatatccatcaatttatgctaagaagtaagaggaactcaatgtagaaagaatattaaatttgggccaggcatggtggctcacacctgtaatcccagcactttgggaggccaagatggaaagaccacctgagcccagaagttcaagatcagccttggcaacatggcaagaccctgtttttaaaaataaataaatatgaagcaggttaaagaatcctggaaactaagtaactagttagctaaataaataaatagaacagtaaaatctagacccagctcaccaccaggctgtggggtcctgaacaaaatctttatctcttcatatataaagataatatttagcacatgattgatggttataaagtagcaccaaaaacaaaaggttttataagcattcaattaatttaaattatgttagaattttctaaacatcgttaccatcattaacacctctgcaatatctatttacttttttaaaaatactcatcagtatgaactttatttattttatttatttattttttgagacagagtctcactctgttgcccagtctggagtgcagtggcaccatctcggctagtgcagcctccacctccctggttcaagtgattctcctgcctcagcctcccaagtagctgggattacaggcacgtgtcaccatgcctaatttttgtacttttagtagagacggggttttgccatgttgcccaggctgagcttgggcaaactcctgagctcaagcaatccacatgtcttggccccccaaagtgctcggattataggcgtgagccactgcacccagccccagtatgaattttagaataagcattatactggaaattaattacaaatctttaaaatgtaatttcccaagatttcagtagatacccttacttttttgtttttgccaaaccaagcccccagtgccccaacattattccatgaataattcaaattaccttttcaaagctgaaaaagttagtagtgtttctacatgtgttgaagtctgtagatctctttttcttaccgaatgctgctggatattagataaagagagaatatcgtagtctgagagcaaagaatcaagcttctctgaaataaaggtaaaaaaggtattagcatctaaacctaataatcaattgtagtatcgttaaaatgagagtgccagacaataaatctttcctgatgtaatccattaggaagtgccaagcacaaactataaatcattttttatcaacagaaactccactgcctcttccaaaatcaggatttttagaagacaaattgggtgacttgagtctctttaaaaactgtctaaaaatatttgcactgatgccttccctttctttcaacaactatcactgcagacactatggtattcaaaatccttccaatggacttagaaggtcctcaaaatacagcaacaggagcttaaaatacaagtttattgctactgatgttaaatatgctcacaaaaccagttttaaaagaaagactcttactcatgtgtggaagctaaaaaagtggatctcgtggaggtagacagcagaatggtggttaccagaggctgagaagggaagtgggagtggtggagatgaacagaaagtggttagtgttacaaaaatacagtttgattagtaagttctaatatttgatagtacagtacagaaattatagttaacaatttattgtatacttcaaaacagctagaagacttgtaatattcctaacacagaaaagatgtttcaaatgatgggtatcccaatcaccctgatttgatcactacatattatacacaggtatcaaaatatcacatgtacccaaaaaacacatatcactaaataaaacaaaaactcaatttaaccatacaactgccaagagacaccccccacctttcccaaaccccttctttatcctctacccaataccctaccctcctaccctcctaccctaactggcttccagaatgctagcaattaggcctttaccttccagaggaatatggaaatctgacaatctctaatgaaaaacctaagattctgatatcaaaagtttcccaaatgaggccatgcatggtggctcacacctgtaatcccagcactttgggaggccaaggatcacctgaagccaggagttccagaccagcctgattaacatggtgaaaccctgtctctactaaaaatacaaaattagccgggcatggtggtgcatgcctgtaatcccagctagtttgaggcaggagaatcgcttgaacccaggaggcagatgttgcagggagctgagattgcaccactacactctagcctgggcgacagagcaagactccatctctaggcgggggaaaaaaggccgggctgggcacggtggctcacgcctgtaatcccagcactttgggaggccaaggcagggggatcacaaggtcaggagatggagaccatcctggcaaacatggtgaaacccagtctctaccaaaatacaaaaaattagccaggcgtggtggcgggcacctgtagtcccagctactcatgaggctgaggcagaagaatcgcttgaacctgggaggcggaagttgcagtgagctgagatcacatcactgcactccagcctggcgacagagcaagactccatctcaaaagaagaaaaaaaaagccaaaaagggctattttttattcattacaacatccttgcctcacaatactcagcaaaaaccttgcacatatcagcactcacatgttcacaaactgcacgaattctcagtgctgaaatgcaatatggtcctttagttcttcaatttccctgatacaggttggtacatgaactcagtttcattcaagatcataatcactcctactgacttaggaacttaacctcaacattatagtttcattgtcaataatatagcccagtagttctcaaagtgtagttcccaaaccagcagcatcatcatcaactgggaatttgttaaaaatgcaaatgctcaggtctcccctcagacctgctcaaacagaaatccgcccagtgggatccaatagtctgtgtttaacaaggcttccaggcaaggctgacacactcaaatatgaaaatcactgaactggctgggcatggtggctcacacttgtaatcccagcacttggagaggcagaggcgggtggatcacctgaggtcaggagttcaagaccagcctggccaacatggcaaaaccctgtctctactaaaaatacaaaaaattagctgggcatggcagcagacgcctataatcccagctactcggtaggctgaggcaagagaactgcttgaacctgggaggcggaggttgcagtgagccgagatcacaccactactctccagcctgggcaacaaggcaagactccatctcaaaaaagaaaaagaaaaaaccactgaactaagctaaaggaaggtaacaactcaaagtaaagaaaaaaactttagccacaaagatgttcattattcagccttgccttattttcaaggacaaaaaccagaatgatggtaaattagtaactgtgaaatggttggatgttgtaacacttccaaagacaggggaaaaaatctgcaactattttaaatgtcgttcacaaaaggtttttaagaacatggggctgagggcggtggctcgctcctgtaatcccagcactttgggaggtcaaggtgagagaattgcttgacccaaggagttcgagaccagcctgggcaaaatagtgagaccctcatctctccaaaaagtaaaaataaaattagccaggcatggtggcatgtgcttgtagtctcagctactcagaaggttcaggcgggaggatcacttgagcccaggaggtcaaggctgcagtaagccaagatagcaccactgcactccagcctgggtgacaggatgagacccagtctcaaaaaaaaaaaaaaagaaagaacatggaaaaatacatatgttataatgttaaatatagatttcagaaatattcatattgtataatcttaactatgtataaaaataggtctagaaaaaataagcacaagacagtaacatcattggttattttgggtatattttctataataagcactttttaaatgtagcttgctaaagcactttaaaatacttaactaatgcatttcaactgcaattgattctcttttaataactggatatctcaaattgaagattctgaagccattacaaactatagtaaaaacagttcttcctttggagccaaactgtagctacgtactactgctattgtgttttcactaacaagtaacctctcaggtactcaatatttcactgcacttcacttccaaaattctaaccactagtaatctcaattttttacaggctttacaacagaatttatatttctccccatttcccaagagtttatctcttatccatatccaattctctcaataaacttaagtataaaccacctgcttctgacagtagagtttattacagttaataccagacactgccgcactgtctatctcagctcagtgtctggccatattctttttttttttttgaaatggagtctcactctgtcgccaggctggaatgcagtggcgtgatctcagctcactgcaacctccgcctcctgggttcaagcgattctcctgtctcagcctcccaagtagctgggactacaggtgcacaccacctatccagctaatttttgtatttttagtagagaaggggtttcactgtgttggccaggatggtcttgatctcttgacctcgtgatccacccacttcggcctcccaaagtgctgggattacaggcgtgggccacagagcccagcccatattctctctttaaaaaactacaatggctgcctacttctctctagaatgagagcaccttccttactttctacaagttgccacagcagtcatcattttgttatcttttttgtcatctgcattttttgttgtttttgctttttgttgttttgttatgtgcttttgttatctttttcatccccctacccctcctttcttgcacacacattctacacttattttttctcttttccaccagactccatttacttgattatttaacaaatatttattgagaacctcctacctttcaggcactaaggatacaacacagagaaaaagaaacagacttccagtattgtgacactggaggaaagaccaaaattattataaagtacatcacagaccaagacagaagtagccacagaaagttatgcacagacacagcaggggcatgatccctgcctgctgagtcaaagatgttttcccagggaaacggttttgaagaccagaaggatgaggcagcaccccagagaaggaaaagaaaggagaggccttaggtcaagggcataacatatgctgaattccacaaaaaatagaacacaacacttaaagacgtgaaagcaactcaatgaggctacagtgcagagcagtacagagagaatatgaagtgtgaggctggagagtcaggcactggtcaggccatgaagggctatggaaggaaatcagggattctgggctttggataatggcaatagctgtaagttggaaatttcattataggccagctgtggtggctcatgcctgtcatcccagcaccttgggaggccaagatgggtagatcgcttgagccccaggagttcaagacaagcttgggcaacacagcaaaaccccgtctctaccaaaaaaataaataaaataaaatacaaaaattagccaggcgtggtggtgtacacctgcagtcccagctgctcaggaggctgaggtgggaggatggcttgagctcaggaggcagaggttgcagtgagctgatatcgtgccactgcactccagcctaggcaacgaggccagatcctgtctcaaaatccaaaaaaaaaaaaagagagagaaagccaaggtgggcgatcacttgaggtcaggagttagagaccagcctggccaacgtggcaaaaccctgtctctgctaaaaatacaagattagctgggcgtggtagcaggtgcgtataatctcagctacttgggaggctgaggcatgagaatcgcttgaacccaggaggcaaaggtggcagtgagccgagatcatgccactgcactccaacctgggtgacagagtgagactccatcccccccaaaaaagaaagaaatttcattatgactgcagtgtggagaatgggctagaggggaacaagaccggaatgtaggaaatctgctggtaggctgcagagcaaaccaagtagaaaccactaaaagactcctaggttgtggctcactgtgattaaaaaaaaaaaaaagaaaacaaaacaagagaggggctgatatcaggagacaattgcatgctgaaagattctggagttttgaatgatagagccttgggagaaacagaaatgaaaacaaaagattctggagtttcatattctattttgttccttatacacagttgcaatttcattgctcatttacataggacttcctttgcattaagtcatcatgtctagttgtgttactgatgagccacatagtgattttcagcagggagagtaaatctatgttatcacaagattcttaacactgacatcagcggtaaaaagtagccaatactttgttccttctaaaggtttcaaagaagaataaaaagaaaacggggctttcaggcctgtaacaaaatggccttctggttgtagctgtggagttgcctacagaagattagataaaccttccactctcccacttctcttatatctgaattgttttgtctctgggataagcttttatggccattcactttaatgcattgacataaagtatatccatattttcttcattaagcccagagctgacatttttaagctaaaactaatcgtgaaactttaaaaaattatgtatatggcaggtcacagtggctcacacctgtaatcccagcactttgggaggccgaggtgggtggatcacaagggtgggagttcaagaccagcctggccaacatggtaaaacccagtctctactaaaaatacaaaaattagccaggcgcggtggcaggcacctgtaatcccagctactcagaagcctgaggcaggagaatcgcttgaacccgggtggcagaggttgcagtgagtgagctgagatcacgccactgcactccagcctaggtgatagagtgagactccatctcaaaaacaaacaaacaaaaattatgtatataattttgtgtgtatatcaacatatatacacataagtatagtggtatgtatataaccgtcccacacgtatttaagaacaatgtaaataaagtgttatatgagaaggttctggaaacgtgtgggtttttgttttgttttgtttttgagacagggtctcgctctgttgctcaggctagagtgcagggcacaatcaccactcactgcagcctcaacctcctgggcatgagcaatcctccgggtggctgggaccacaggcacatgccaccgcacctggctaatttttgtttctatttttttgtagagacaaggtcttgccatgttgcccagcctggtctcaaactcctgggctcaagtgatccttcccccttagctttccaaaatgctgagatgacagtcgtgagccaccgcgcccagcttgtggattttttacattaatttcttttattttttcagcaaattgcattttcctaaaatactacttgagagtgtactgcagaaccccaaggcactcagctcactcttcactgctctgctgcatgaagtacgaaaagttcccccaaaatgacactatcaatgtcatgctcctacttctgatatcagaaatggaaaacataaagccagtactgctgtgaagtgtttattgtgtttgtgctgaagacacaggagccttcctcttcagcaccccccaaaacacacaggacagggaagcaggccacgtgtagtaagtgtcaggtgcgggttgttgggactaaggaatgagaaaaagggagcagtgctctctgctaggccagggaccccagagcctgggaactaaacaattttatggatttataccagtaaaggaggatagagtatgagctgcttcaactaattccctatcaagagctcctcaacagacctgggacgtaacctgagccaagactctccagcaagaccagtaaccaggatgcaagtttcaggttaggcaatgagactacttccacaattaccagcagccctgcctagtcctaggctaaacctgtatccgatactcattcttttttttttttttttttttttttgagatggagtctcactctgctgcccaggctgcactgcagtggctcaaccttggcacactgcaacctctgcctcccgggttcaagcaattctcctgcctcagtctccccagtagctgggattacaggcacgcaccaccacgcctggctaatttttgtatttttagtagagacaggtttcaccatgttggtcaagctggtcttgaactcctggcctcaagtcatccgccggcctcagcctcccaaagtgctgggactataggtgtaagccactgtgtccagctactcattcttgtaatcaaaagaataggtaactggctggggcagtggttcacgtctgtaatcccagcactttgggaggctgaggcaggtggatcaccagaggtcaggagttcaacacaggcctgtccaatatgatgaaaccccatctctactaaaaatacaaaaaaaaaaaaaaaaaaaaaattagccaggcgtggtgggggacacctgtaatcccagctattcgtgaggctgaggcacgagaatcacttgaacctgggaagtggaggttgcagtaagccaagattgcgccactgcgctccagcctgggtgacagtgagactctgtctcaaaaaaaaaaaaaaggtaactaattttggacatgttatatttgaagtgccaaatgggcagctgaatatgaactccagagaacaagtccaggtcagagatacacgtctagtcattagcagaacactgtcaaatgaagtgaaaccagtacaactcatgtaacaacaaagaaaaaaaaaaaaggaagggggggaacggagagatgcccatttccttggctgattttaggagtaaataaagagatacagattgagcatcccttatccaaaatgcttgagaccagaagtgtttcattcatcagaattttttaaattttgaaatatttgcatatacataatgaggtatcttggggatgggacccaagtctaaatataaaattcatttatgtttcatttattcacttactttgagatggagtcttgctctgtcgcccaggctggagtgcagtggcgcgatctcggctcactgcaagctccacctcccaggttcacaccattctcctgcctcagcctcccgagtagctgggactacaggcgcctgctaccacacctggctaattttttgtatttttagtacagacagggtttcaccatgttagccaggatggtctcgatctcctgacctcgtgatccacccagctcggcctcccaaagtgctgggattacaggcatgagccaccgcgcctggcctaaacaatatttttaagtaactttttttgcatgaaaaaaagtttgtgtacaacgaagcattcgaaagcaaaggtgtcactgtctcggccacccacataaataatctgtggttgtctggcatcaccatcattcctgactgattttacatgctacaataagtaatcgttttgttatacctattcacacataagtactacacagtaaaaaatataccactaacagtgaaaaaatcgtgtgttaggggtaatgtgtgctgtcatgccagcattcaaaaagtttcaaattttggagcatttcagattagggatgctcaacccatatatgaaaagcctttcatttcacttccgttacctcaatgaagcccattcctgtcctcctttcctatcaatctttttcagactttcttcacattacacttccagctgtatacacttattatctcacaaatagaaaatggtgaaggatccaaaaatcaaccacaattggccttggaggaaacctatatttaatgttctaggaaatcctgtgaaagtcaaaaggatctctccagtttccccatcacaattatctgcttaattcctctccattctactcttgaaatatggtttatctcttagactaatataaagcagagttacattaaatctcccttggagcagttagggcagttaagcatttaggtttcaaaggaatgcagccagtaagcaaaattaacatcaaaagagaaagccagatgtcaaaatactgagtaaaatggtgctgtcaataatgaaatcagcactgcaatatggagaatccccatgccaataacctcaaggtaaatttgaaaatacatgtttcagatacaaactttctcatccctcatctgtgacctatattttttcctcccacccactacatcctcttttattaaaagtaacacaaagggaaaacgattttgaaatcaaagtgagacttatacaccccagctgcaacttcaacaagatatcatcatgactaagctcatatgactcataactttcctaaattatgcaattcataacagttcaattgaaatcatttttggtgacccatagaggactctaaaaaccaggcttcattttattaggtattttttgcctttcagaaaaatgttgtcatatgcctaatcgatattgagtactgcaatatagtagtatttgtaggacaataaacataaaaaataaataataaagcatgtttttcaactatgaaactatttgctagtcttgaccaactcaatctaatggtaaggttaagtaacaaattatattgtaagctgtcaaacaaactgaaaaaaaaagtcattcttcaaaagaaaaatacccacaaggcctatgttcatcattgacaactgacagcatcttcctgagactcattttcctcctcctttatttgaaaactagacttgatctctaagattcatttggtgataacacttgctataacgtactctagcactctcctctatgctgttttagaagtgtcctaaatgaatgtctatttccctatgctataaccatttgaagatggatatcgtctgatctttgtatttccaatgccacgtataatacttgtgtgtccttcaaatatttcgtttaaaaaaaaaaaaagaggccgggcctggtggctcaagcctttaatcccagcactttgggaggccgaggtgtgctgatcacctgaggtcaggagttcgagaccagcctgaataacatggagaaaccccatctctactaaaaatacaaaaaattagccggacgtggtggcacatgcctgtaatcccagctacttgggaggctgaggcaggagaattgcttgaacccgggaggcggaggttgtggtgagctgagatgacgccattgcactccagcctgggcaacaagagcaaaacactgcctcaaaaaaaaaaaaaaagaaagaaaaagaaaagaaaagaaaaaagaaaagtctatgcattcttctggcacaggtggtctgcattttgcaaataaaaaacaaacacatgggccaggagcggtggttcatgcctgtaatcccagcacttagggaggcccaggtgggcggatcacgaggtcaagagttctagaccagcctggccaacatggtgaaaccccgtctctactaggaatacaaaaattagctgggcgtggtggcacatgcctgtaatcccagctactcaggaggctaaggcaggtgaactgcttgaaccccgggaggcggaggttgcagtgagctgagatcgcgccactgcactccagcctgggcaacagagcaagactctgtcttggaaaaaaaaaatggtctaaaaaaccttacgatctgcaaatgttatgaattgatctagaaagtaatgtttctctttaaactgtatgcttccttgggactcatgcttatttttacctacgaacaacagattaataacataagtgaaacagttgtgtcagggtggtgcaaatataattttaatatctcaaaatacatatttattctttttactaacatttatccttaaaatgaagacccttaccctatccctccatcctaaccacaatcctacctcaaaatgtccttcaatttgtactgacttaccacttctcagcacttcctaacaagatcccttgcctttcattagtcacttgtaatccatttcaatcggaaagaatcataagacagctgttcaagtgataacactctcaacacctttagtatccataccaatccattacaatttctgtccactaaatataaagaaaaaaaatactacacatggtatcatggtgaaatttgggaaccagtacaaccatgcaagcctacaatttcacacactgggaaaacattatttcacactttattactaattaaagtatcttacacgtcaatttttgaaagataaaaggattttaaaatacactaaaagttcacgcaaacttacttccaccaaagttcagatcccttaatgcatctccatccttaaaatccaatctctctggaaaatctaatgaaataggaaccctctactttctagcctctaaattcatcaaactcgtcactcttgataatttctttgtttaaaagtgcaaggaaagcattcatagtggcagcatcacgagttggcttaccaggtttccgcctccccccatctcccaagcacctccaataagctacaattgaaataaccaagaacgtgcttaggatgttcgcaaaaacacaactcttaagactccaactccagtctccgcctcccaacgagattactgcataagtacctcctacagcagaaattctagttccctccttcgaggaccaggaagaattctggagctttgggcccttcctttctggctctggtaggaacacacaacactagatttgttccctactaaggcaagaaccctgaccacatctccctctccaaacaagatccagccaccctactccttaccgctttcccaacaccctccccgaacacaaagctagggagcaaacccctctcaggcgctcagtcactacatggagcccgtccagtagccctttcccactcagagacaggcccatctcctttattctttccccaaactccgagagccacacccccttctacactgaaaacttagggacgcgccaccatcgccaataccccgcccccaaacacctgatagacccagctcccctgctcttccctcaaacgagcgctccaggcgccggcctaagccaactcccctgggtctttaccgagtctctggtgggggccgaagcccgggtcatccggaggtcgcggcgccagcacgaaaggaaccacgctggtcaggaataggagagactgcctcatgttcccggccccgctaccgactccacctctctgggcagccttcgcctgacggggtttcggaaaactgctcacatcgggggaggacgggatccgcccggcctagcccctcaatcctcttttccctcccgcgccgcctactgggaagattctaccgccaggctcgacgcccccagaagtgcaggt

SEQ ID NO: 2312 - DNA, 294163 bp, Homo sapiens
  source 1..294163: mol_type = genomic DNA
taactgtgttctatgtggatccagcattacaactgataaggtaagggcaattatatctctttgtttgatcattaaagtcagagtataaagaaatcccctactactccatcttccctttcaaatgtagattactagggcaatcttgccagtgtatttcaggatcttgaacttgagggatagaattgtctggtgcctgctctaaaaagagatagccagcccctgcaatagctgtcggtacagtttctggctaatgaaatgcagagaaatgaggaagatggtgagctgtgcttgtgtggtaacgggtgatttcagaggaaaatgtcaaagcagctcatctcccgaggccctacatgatgatgttttagtagccacctttattcaagatttaaatttatgaaaagagaatcataacgatatcttaattgctctgaagatgtcttttcaaaagaattgtcacaggaagatttccttcagaggaacggagaaaccaaaggagatggctttattgtggaagagttgaggaaagccttctgtcctagaagttaacatttacggatctctctggcaaataatagtctccgtttcaagtccattatgtttgataaggattcaaaaagtcttaatcgaatctagcagtcattgctgcttgtttctttcctaatctccctgattttgaattataagatctttgtctcttaaaataaaacatcatttgttaaagccttttcaaaattaagaccaaaaccgtcacaactaattgtttcttggcatcaaataaacaaatttttaaagtttgatgaattgtttgtaagctctaatcaagtgcgtggtgtcataaaagaggggagggaacccactgaaacaatatatgtaatttgtttgcattagtatttgagataattacaaagcaagtgttcaaaagctgttctgtatactccagaagggggaaagataggagaggaaaagcataagaacacccagccattgtcagctgctctctaaaatattgccggattcacaattgtcgaacattagcactactaagaatgctggggacagagtgtcatgttgaatgtagagtgatgacttcataggaaggcaaagctgaagatatgaccagtttgcagtcacagaaaaatcagctttaattaatttgagtgccagctctgtgtataattacacagcatgagagtttgcatgcaaatgcagaaatgctgattgttcaaatacttgcacttgctcattaatacgttgggactaagcagggctggcaagcagacagggtacggcacacacggtgcctgcaggctaatttgtattatactgtagttagcaaacagatttcagatgtttctcctttctttaaataataagcacaaaaatatgtatgtcattttcatcggtggcataccttgttttctttttgattaaaataaaatgtttttggtttctgaaaaagtgttgagggtacattaaacattactagaacactgatttataaccattgatgccaggtctgggatatttctatttgacatttcatgtaattgtccaaactgatcatatttcataattagtgaaactatattcaaacaatataagtttatgattaaatcccatggaggaacaaagggagagacacagttgtattgcctacttttctgtcgaatctagtatcttgtagtcagcattggctgggtccagaagcttcagtagaactgatttctttgtgaaagtacctaatcctaaaatgtcctgcggtgagattttccattctgaccactgaatcttttcagagatcagcttcaaccaaattcccaactatctggacaacaccctaggggaaagagtctgcctaaatcactacaccaggaacatctgataatttattaaggaatttgcccaagttccccaaatctggtactactatcaatgctgtctgttttcttgccaacatttcaatgcttttcagttctacaaatatttatggagcacccatttctgttagacactgcaaagcagaggatgtactatagtaagccagatagatacagtctctgcattggctatctcttttctcccaggaattgtctcaggaaggaacctacgtcagttccctgggacatagatgtttttagcagtcattaccttgggggaaagcccacattacagaaacttgaatctatggccttccataaatacagttttcatggtccttctgggactctctgatattctttcaaccctattcttgtgtaagatgaaggaagctacctctgtcttgagggttgaatggaaatttaatggatatgtgaaagagtctattaggcaagcccaaaagttttataagaatatattgaagaggaaggctgtcatacctttccctgaaagcctatatctgtaagaatagtcatttctcaaggaaaaagggtgaacacaacatgtaggtggatatggggcactttacaccattgggtctgaccacaagtaggcaggcatctacctacgtgttttcaatatgaccagctgagaaacaccagctagacagcatcaccccttctttctaaaaactctgccaatgtacatgtacaaagatggaaggtgacaataaaaacactcatacataccacctaagcttccacttcactttcagagtagtcataaccttctcatgctacatatcacaagtatgcaagaaggaagaagaaaatccaggatggtgaaagaactccagggtatcttcatgatgtacaacacagtaatttcggaacagtggttttcagagaacaactatgaattgcaagtaccctgagctcaaacaacttttccttatggctctgtcatggtcagacacacatgattaggaaacaaaacaaaaacaaaaacaaaaacaaatttccaaaatatgtatgaattaagaaaacaccatcttgctgggaccaaaatattaaaaaatatttgttatatggattactggtatctttaccaaggagagttaaaaaacatcttaagggcttttgcctataagaaatgaattctaatggggttatggtaatatatgaaaggaaccatattcacagatgatgcaagtaatttcatgaagctactaagggataggagagaaagataatacatttgtaaagaagaaagtagagaatttattctgcaactagaaagttttcaggaaacctgagaacactctagctacagagatgaagaaagcatgtaacccagtgtagaagcacaacacactggggtagttcaggatggtcaatcgcgctgattaatacagcgtgagaaccatagaaggaatgaaagcagctagtgagtcagcaatgattaggtcaacaaaaactgtttcctcagatttgtgggctgaaatatgtattccacagaagacatatttcaagggcatgagaagaatgaaggggagaataattgaagatagcaaatgtgaggaatctgtacccagaaagtgaagcgggagaagtaagcaagaaaagttttaggcaagtggagatttgagcatgtttgcagaagggaagaaattagtggagcaggggcaattggagttgttaggggaaatgtgtgattaatggaacaggagttggggagaatccaggtagttatgctagctagagagtttttgttttctgttgttgttgttgttgttgtcttattccaagagagaaggacaggaaaagaggatggtgtcaggaaatctgaggtggaggcgaggaaagttatgagagtatgtgccagatgcctttggtccagtgtggacattggtgagatcatctcctgggagagtaagtataggaaagggtggaaatgacacagagataaaaacaactttattctcgtaccgaagaaaaggaagagcaaaataatgtaaaacaatttacaatgaaaatgggtaaaaaaatgtaaggagaatgaagaaatggaaactggttattataaagtttcacttaaacattaacttgtgccaaggttaaatgagtaatgagtctggacttaggattacctaacagtctctaagtttacattttccaatatcagcccaccaaaagtaatgggttcttttgtttgtttgttttatttttagtttagtgctcttgtattctacactaaggaaggaagtgtggggcagatatctgcatatgaagtaaaggaggccaataagccacaaaagagcttagtctttaaggaaaaacccatcatctctctggagctaccccttccccctgctcatctttggccttgctggtaacagtaaatgtatttatttaactacatgacacaagcctgtatggggatgcttaggcctcccttcatcatcatacttcccctcttacacaacccagatttctgttggctcataccacctgggtgaaacaccaaattcagggcagccatctcctaaaaaccagttaaatctaatacctgtgcattacttggcaaaaagagaaggccctaaaagtctgactgtctgcttaatgcgtctggaattaccattagcatttaggataggtgcattcttaggcttagctggctagtccggttttcctgcctcaagacagagcatagcacatcagtcactaagtggctgccagtggacacagggcatcccctgggagcggcgggcctggatatggtctaacaggggcgctgagcattgagattcctggagagattagtggtagtggtatgtggatgtctgggccttcaaggaccagatagtaatcagtaggaaaaggaacaacacaaaaatggtcccagaatacttccagcctgccatttgctgctgcttccaatttccttcttctttggtcctctttctctgctttcctcttccccacctttcccagatcccaagtctaagggtcttgttgaccaggtaaaacagtttgtaacatgtggcaaatagagaatgttgaagatttttaaacaaaggaatgaaactcaccttaattcaaaaccaaagatatcttgaggagctactttatgtcaggcactggagtgtatgtaggggatttgaagataaacatatcaggccttttacttaaggaattcatcatctaatggaaagacaaaactgttaaactcaaatactggatgacataggggtactgaagagaggaaacgaggatgatggcagaaaaagacacttctgcagaaaaagaaaaatactggcaaagcaaatgtctgaagcaaatgcatgtagatatgggaatgcacataaacatgaacaaaacagtgttgttgttttcttttaattttatttatttatttatttattgagacagagtcccgctctgtcgcccaggctggaatgcagtggtgcaatctcggctcactgcaacctccacctctcgggttcaagcagttctctgcctcatcctcccaagtagctgggattacaggcatccgccaccatgccccactaatttttgtatttttagtattggccaggctggtcttgaactcctgaccttgtgatctacctgccttggcctcctaaggtgctgggattataggcatgagccaccacgcccagccctgtgtattatttttctggcagcaatgtataatgttgtttggatgcagaaaagcctacaggtgtgcatcaccatgccaggctaatttttgtgtttttagtggagacggggtttcaccatgttggccagactggtctcgaacccctgacctcaggtgatctgcccatctctgcctcccaaagtgctgggattacaggcgtgagccatgcgcccggctgggagcagctcttaaacggcaaaattcctgtagccaggtcagcctgtgaaagaacagcaggaagccagcctatagaaaagaggtgaagggctgggcgcagtggctcacacctataatcccagcactttgggaggctgcaatgggaggatcgcttgaggccaggagtttgagactggcctaggcaacagcaagattccaccgctataaaaaatttaaaaggttagataaacatggtggtagtctcagatattcaggaggctgaagcaggaggatcgcttgagcccaggagttcgagattgcagtgaactgtgatcatgtgagctatatgcactccagcctaagagacagagcaagaccttatctttaaaaacaaaaattttggggccaggcgcggtggctcatgcctgtaatcccagcactttgggaggccaaggcgggcggatcacgaggtcaggagatcgagaccatcctggccaacatagtctctactaaaaatacaaaaattagctgggcgtggtcatgcacgcctgtagtcccagctacttgggaggctgaggcaggagaatcacttgaaccagggaggtagagattgcagtgagtggggatcacgtcactgcactccagcctggtgacagaacaagactccgtttcaaaaaataataataaaaataaaaacaaaaaaataaaaaaatttttttaaaaagggatggaaaagaggatataaatggtcaagaaaccttagaggagaaattgacagggttttgcatattattgcagagagacaggaaagctgtcatacttgactttaaggtttcaaaccttggtgatgacatttttgaaaaaataggaaacataggaggggatgtaaatgtgagagggaagatatcgaatccaatttggacgtaatgagtgttttaggtgccagagcttgtctttccagagaagagcagtgtgcaggtggaaacctgtatttagcactgagaagacgcagggctaacagcagagctgtgggcatcctctgcagacaagacccaaaggataggtgagattgtcaacgaaaagagagaacaggtgagaaaagggctaaggaacaaacttttagatcacatacacatagaatgcaaagaggaaagagacagaagttgcagtcacacagttaaaaagaaaactgagaatgtcccaagaaaggaagaaagggtggagagtttctggaagcaaggcctgatcaggcatcaaggaggagacacagacaaggaagatggaatatgagaacattagctgtcacaatgacttagtcatggatgactttcaggagagaaatttcatgaagagatttctcttcataggaagagaagtcataagctgggtgataaggacttaccaaatggctctaatgtattttaatattgaaacaaaagcaaagcattaagctttctaggggtttagccctaaattggaggaacagaagataagaaatagggactacctcaaagggtgaggaaagtagtacaaatttaacttggtctgccgcgctattttacccaaccagaggcctgttgtaatcctggtttctctcaagctgttacttcccatcctcaagtgaaggtgggtggcggttaatggggaaaaacttgatgactaaggttaattatcagaaagaaaaattacagtgtacaattatcagggggaaaaaaaggatgactaaggccataaatcacaatcaggctcttcctacaattcatgcttaggaattaaaggaattttcccctaagaatgtcatctccactccacccactgttcatggcctattttatctctttgaatacagtctatcctcataggagaatgtgaaaatttcttgttttgtgtggcctgcccataggaaaaggccttgatgataatcctttcacgtaaaagtgtgttccttggcttctggtgacttttaaaagctatagaattctcacaaaagctttgctatccatgtagcaaattcagtggtcagtctccctaccttattaggcttagtttaaaagccatgataatctggacaatcctaaatgaaggtatatctttcctcggcttttgcttgaatgtatgttattgttgttgttgttgttgttgttgcatccacatgttggatgctcagtgctcggttctacccaaaccaatctgataacaaataccaccatattacctgtgagtagaatattatttttgccctattcgaatacttttttattagccacccacagctcctcttcaactacatgcagatacccctttaagagtgcagctgaggtgtgatatctagcttgctggaagagaatataattatgtttttacctaataggtaatctctgtgttatccaagagttctgtatggggaatatgaattatccatgtaccacattaacaaagcattcaattgcacttagcttgtgttcttcttttcaaatataagtagctattttaaatgcctacgcttgttctctctttctttttagttgtaagaatatctctgccacttacctaatttttgcaaactttttatttttgtgcatatatttgtgtacatatacacaaacacatgcacacatacacacacattctaaagcactcaaggaggcaccttcataaacttgccttgcacggttgttggtttatccgtcaaagaaatcattaccaagagaatgccgtgcttcacatgcttactaaattttttaaaaatgcttttcattatatttatgcaaacataacttggctagctcataatttaccaaatttaagcatttgtcagggttatttccaatcactcagaaaaatgtgcctttgtgtattttgattatttaaagcaatattgtttccattatgcatatctgttgccagaacagcatgactgtcttgactgaatgaggaagtgggaatgctcttaattttcctacacgcatctgcagaagtacttttgattgtttagccaatgcacatataatgatgtaggcataaatgtttctgcacacattttccttggcacttcagaagagaagggtaatgcaaagggtaattacatatactattgtttgcattaaaatttacatatatatatatatatacacacacacatatatatatcctaaattgtaagctgaggaaatgtttaatattttgaagcataaaaattaggatggactccttctatagaaatctctgttatgtgatcacattttatttatatacttcagctaaacaatttcctttattttttgctttgggcttgtataagctttctaccaaactctaaagttcttagggatcaaatagtgctactcaaacttgcttaccttgccttgaaacacatcaacttacttgctcgttagatgggtccattattttccaaggagacaggaaaggaaaacagacaaggtattagagaccacacttctgaatatggtctcaccatataactatagaatcaaacattttcttcctaggttactatagttcatcgaatctaagatgctgtcaatggtaagatgtacccttattttatattctaaaaagaaaaactaaaactctgccaatgaaacgatgatatactactgattgaacaagttatccttatttcagagaagtcattagggtggtataaaagtaattgtggtatttgccattaaagtactgcaaaagccgaaattacttttgcaccaacctaatgggagacaagatccattttacaatggataaaataggctttatggaataattagagagctttagctcttgggtatagtatgttaactacatcagccaactgaatggtgctcctttcctgcaagagactatctcctctattcagtgagactaaaaaaatgtaccatggattccaaattgcttctgctgtttcccatgtacagagttatcaagaagatattttctcttttaaaagagatgactttggcttgaaggaagcagaatagtagtataaaaagtaaacacaaaaaacaaaacaaaaaaaaccttagtgtttggagtttattttttttttaatttaaactttattcttgtttctgtgagtccttaggctatgggttgacctagctgacacttgatttccctactcactgtttcctcagttcccagtttttctgcccatccatctctcttctccacactattaagaggcatttgaaattttgaggtgggtactaagtatgccttaaaatatcattataaaacaatattaaaaaatggtcaaccaagctttaaaaaaattttcgaaacatgttaaaaactatcctattccaaacaaattcttgtaaaatgtatacattaataatgaaagaagtaaagtcaattgtttggctatcagagaagggacttatagagaaataactgtttccccgtccccctcaccaactcaacttgatttaattagttgattaatcatggctgaacaactaatcacctgtggtgtgtctccttatctgttttggaaataggcgttacaaggcaagaaacaaagctagggggaaatattaaattgcaatttaatttatttatcacatattgcatatcaagatattttctaacgtgtcagattcttctggcattataggcaatattcacttactcatcactcatccatctgttaaataaacccatatgaagcacctcacgagtctcaggtactctggacagaaagatgaacagtgctgcctttctatagcagtgtttctcaaactttttgagctaataacccatttctactctcaaaaattattgaggattctaagaactcttgtgaggcatggtggctcatgcctataatcacagcactttgggaggcgggcagatcacttgaggccaggagttcgagaccagcctggccaacatggtgaaacctcatctgtactaaaaatacaaaaaatcagctaggtatggtggcacacacctgtagtcccagctactcgggaggctgaggcatgaaaatcacttgaatctggcaagtggaggttgtagtgagctgagatcacaccactgcactccagcctgggtgacagagagagactctgctcaaaaaattaaaaaaaaaaaaaaaaaagaacttttattttttgtgagttacatctctcagtatttaccacgttagaaattaaaatgagaaatttaaaaatatttgttaattcaaaatttatgaagaaaatcagccttgcacagatactagatgcaaaaaaaggaagaatattttactagccttctcagataaatgtgctattcttctttgatattgaataaaactttgacaaatagtttattaaaggttagttgcaaggtggaatctgaaaccatatcaatgaacatttaaaaatctgctgcattaaaatacattggttaatcttacattttggatagatctttaaccaatatactacatgcatgattttgtaacatcatgcattggtcatttggaaagtattgtttcactgagttatgtagatttcccatatgtcagcatatttcatgaaacattttaaaaggaatcaccactgttaatatcaccaccaagcttatcagaaaagtctttacatattacgaagctgtcaagttcacagtgacagatacaaattgttcttcaggttacaattcttgtccgcatgtttgaattttatcattggcaataagtactgttgattgttttccttgaagtgatttggcttgctttcattcattgtttaaaaaatatctgcacagcacctaaatctgaataaccatcgtttgtctgtcagttgctttttaaagtaaaaatggtatttcatgaagagagcagctatgtcaggttacaactcaaacatttatctcataagtgcttttcctcaagacggtcagacttcggtagtctgtgaaagtgctttttgcatgcatccattttgtcatatagaatattaaagatgtatattcagagatttagatttcttaaaattagcaatgattgtttttaaaaagacatacttaaaattggtatttttttgtttgttgtttgttttgtgttgtttttgtttttgttttattgcaagtgtgaggtggttaagaatatgactatagtgctacatatggtttggtgccacagttttaatttatgctaagatgttagcagttttatacaccagtgctttctatcatcattgcaaatgtcaacagagtgaaaaaggcaaataatgtcttaatatgattttgaaaatagatttcactttacaaatccccctgaaagggtccagggaccccagaggatctgctgacttcactttgggaacctactctagagattcaaaggttaagggagaagatagattaatgaacatgaattttcagtggtttgtaataagtacaatgatagaggaaagcaaaaaaatattttcagagcactctaaaggagaatatatctgagtgtgatcctgaaggacacccaagtgtccgccaagtagagaaggaagtctttggctaatcgaatcctgtgcctgggactatgatttctgttttcattttaccaatgctttgtaaagtgtaaagacatctcaaccatatggtttctatatggcaactggattaaaaaaatatatgcccagtcaagtaaggccattaatagacaattaccactaaaggttgagttactatgggaatttggaaggaaggacctggatggttgcatgagattccatgttgtattgcatagacatttgtatgtggtaagccagatgtcatctttcaagtacttttgggctctgagtcccaatagaaataaattcaaatcggtcttcatcgatgtgacctgacatgatgtcattgaactattttaactaacactgaaaaaaggtgaaattattgacatggattgaattcctaacatatgacttggtgaccttacagatatgattacatttaattatcaaacaatttaatgggtatcataatatccccatatttaagaccgagacactgaggatcagagacattaagtaatatgccaaaggttacaaaagcacacagtgtgcagaactggcttctaagccagctgtgtctaactgggaaatccctgttctttctccaactgggatatatataactaggaacaggcagagttatattaggtgtaagataagcctcagaaaacacactgcctatcatgctggagcaccaatttacctggatcgcggatttttttttttttttttttttttttgagacagagtttagctctgctgcccaggctggagtgcagtggcatgatctcagctcactgcagcctccacctcccgggttcaagtgattctcctgcctcagcctcctgtgtagctggactgcaggcatgcaccaccacgcccagctaattttttgtaaatagggacagcatttcaccatgttggccaggctggtctcaaactcctgacctcaggtgatccgcccatcttggcctcccaaagtgctgggattacaggtgtgagccaccatgcccggcttgagagtggattcttataatattttttaaattaaaaaaccccgatatataatgaaatggaatgaaaatcatttgaagatggagacttccaaggcattccatcttgagagggaaggacctaggatcttcctggagcatccaagagtcagagttcatagtcctctgcattgagggaacttttgagatacactctgagacgtgcatttttatgtcagacaaaccagtgtgttttgcccagtaactagaccaaatgctgttcagttagtatgccaagcagtctaaaattgctcctaattcctgattgttgtgggtataatacacatttctaagcatgtttcacagatgtgacatcagcatgtaccagaagaggtaaggttagaagggaagaaacgattaactctaatatttaccaacagccactaatggccaatgatagtgatgatgatgagaatgagtgtgatgaaaatgatattttttgagtatcgaccatgtgctgagcactctgcataaattcatcatcttaagtaaactgcacagcaatcttgtaagttgatcttattgtccccatttgtgtatgtacccagacataatactatgcatttgtgttatctcaacaagtctgtgagctattattatccatatgctgctgatgaaaaattggtctcagagtggataagtaatcgcccaagtttatacagtaagtaaatgatggaaatatgcaaagaccctgaggggcttgtctcaaaagccctagatcattccatgccatgctgccttgatattaggtagagatactgtattaatctgttctcacactgctaataaagacataccggagactggggaatttataaagaaaaaaaggtttaatggtctcacagttccacatggctggggaggcctcacaatcatggcagaaggtgaaggaggagaaaaagcgtttcttacatggcagcaggcaagagggtgtgtgcaggggaactgccctttataaaaccatcagatctcatgagacttattcactatcacgagaacagcatgttataagcctcctctgatgattccattacctcccaccaggtccctcccatgacatgtggggattatgggagctacaattcaagatgagatttgggtggaaacacagccaaaccatatcagatacctatataagttatcatttaaatttggatacttttgaaagtaaaagtggatactattaataattgtgccagagcaagagatataaattaagattgcctcagaaaataaggaataaattgttacctcactattaggcaaagatagaggctgagtggtatcaaacttcttaaaaatacatgcatcaaggtatttctttattttaaaatactgactaatcatttcacctcaagcaatcttttatagtatggggcagggcagggagaaggcatatatgtatgcttaatactcaagaaataatttttacctagcaatttatagagtaaaaaacatgcatcatttttgatacatttttatacacaatataatagaagtcaggcacaaaactctaaaggggataaagaagatttagaaaaccctgattcagtattagaaattaatgaatgtggtacttactatgtgctgaaatattataacttactgatcaaggggagagaattttgagaagtgtgctacatacttgaatagctcctatttcagaaataatcctgtaacaataacttgagacagttttatataattgtggcaggtagtcactccacattgattcaagtacaggtttgggcatgttttgtttttttttttccttttcttttgtagttgcttctactcaatgtatcataggtgtaagtccttaatttctttccagtaaaagaagaatagcttataatttcttttgtttctttttctttgatgcaagagttctctcctcccagtttttaacctgctttgttcagacattttttctgctctaattttttcttttttactcctcagtagatttacataaagttaagtgacttaagctgtttgtgacattatttttggattttactgcttcttgctttggctgctcctgatcatatccagatttattttctagaggaagctaatttagtaaattttttttttttttttggtaaaataagtactataagctttcaaccaaacaggccactcaaatgtacagaagaaaaagccacatttattcacaaacagatgggtttttcttttttcctttttttaattctaaagagacatatatatatatattcttgagtaaaacaatatgtactagctttgaacaaacattttatgcagacattaggtctaaacaggagaaaaagcaccagctcaaatagtataatttaccactgtgagatttttctgttagtgtgtatgtgcatcttgtaaattcttgtgcttaaagttgcctttcaaccttttaaaatcatccttatgaatcttttcagttggctggacataagaaaaggaggcttttctcatgaatgaatatgagagttattatgttaagcgtggagtaagagtgtgctgagcacttaatgcgacatgacgtgcctggtactccccacaagcttaccttcaaaaggatgaaacagagacaaatatagctctgcatacatgtcaaatggccaagtgctgagggggaaatatctcttatccccctgctttttttccattgtctcttcatgagaccaaggtcacagaacctaatgaggaacagaagtcaaaagaagtagagttcttaggtctcctgtacagtacctggattataattaatagctgaggttttgaggccaaccagatcaagaaaggtaagatgttctgttcccacaggcatttttgagcttggcaatgctaaagttagggatggtttgcctcttcaaagccccacagcatcgtaattgctcaaggtactgaaatatatgataccatttcatatgaaaatggggcaagggcagagagaagaaagactcaagtgatagagaagaaagaaaggcattttactattatatttttatactaatgaccttcacttggtctctaacacagtccgtcaaatcttaaaagtttatttctagccttaaagaaagtagcttgaacagttcatatttctggatatggcaggcagtgtggtaaaggaaaaagcaaagtccctgcaggcagagagatgtgtgcttgatcagttctgctatagactttgcatgaccttaagcagcttccttagattactcgagctctattttgttatctgtaaaatggttacaataatacttactccccggtgttattctgagtactaaatgagttcttatacccaaagcatctagtacagggcctgcacgagtttgtgttctttcattgagtattgctgttgtcattaaaaatataattttattctcagaaattacattttattactgccataaccttatagaccaacaacaaactgagtaatctctaccttctcttccctgtgtggctggcacttttggagaaaaatctcttaaaaggaaattaaagcagtgcaaccatctgtgatttgtcagggtcatataaaagagctatacaccaccaccaccatcaacaacaaaatcagtatctaagaactagattaatccaggtttgaaaccaccaaaaggagcataaaagggtaaagcaaaaatcaatatatattctgaaaagtatggacagaaggtaaattacagtttgtgtgtgtgtgttttgtggtaataaggaagattaaagtaatatttaaagtggttaagaaatctggacatgggctcaaatgcaactccactgtattccatttgatcttcaaagaaataaagtgctgtttagtttttgatcttcagtcttctcatccaaaaatgggaataataacagacttatttcataagattgtcatgaggcttatatgggatactgcatgttaaacaatcactaaaatcctgcattaaggatgaaatcttgttattagcatacatgagccttttgcctctatttagcatcggttggtcatgttgtctccattttctcttctggctgtttctctaaattatcaggacttcccaaagcaaaggcttgggaatgtctgcttctggaacatttgaatgcacttgagagctccctgagaatgaagcattctagagtgtaaaagtcatgaaccagttatatatgattctccgggtaagtccacaggaacccagcctgggcttctctcctttggaaagaggcacagcatggctcccaaaaggccaactacaagtcaaaggctatgcatcatcatgctttgacttttcaccatcaaaattcatctatcagtgagacacagatcatatgactaatcttgtttgatttggcaatgaagtgaaatgtcaataggcttcctattttgagtgaaattattaaatataccaaagggaatattacatgtgtgttagtcatcccagaataaagatgagcatacatccctgaaaacttcaactccattaatgggataatggatcaccagaatattttatatttcaaatacatactttgttcacattcttgcttcacttggagaattgtgtcactgttgcctaagtcttgggtttcctttactccatgcctggattctccattgacactaatgggaatttcaccttccagcacaagacaatatatggaactaaaatgacaatagcagaaggaaaataatacattttgtacattgtgctacagaatattttcttgactgtttctgttatagtcattgactattgctaagaaagatccatttggaaacccaaaaacatattgtctctagaggctagtcttttgaaaacatacttttacccttacatgtcatcacaaattacataaaataataattatagatcaatctacatagttttaattttgtggttggttaattataaaagcacacctctctggcactgccattagtctataaggtatgtgtgtctcactctgtggcaaggctcgagtgcagtggtgccatctcggctcactccaacctccgcctctcgggttcaagtgattctcctgcctcagcctcctgagtagctgggaccacaggcacgcgccaccatgcccagctaatttttgtatttttagtagagacagggtttcaccatgttggccaggatggtctcgatctcttgacctcatgatctgcctgcctcggcctcccaaagtactgggattacaggcgtgagccaccgcattttgggagaaaagattgtccatattttcttaaggaaacataatgcaaaatctgccagttactgaaattaaaagtatgatgatctgtttgtagttcatgttcacacattagcaataacctgtagagctatgagttgttagaatgtagcattaaaaaaaaaaaatcctctgtgaaagaagaacagatacaaagcccatttatatgagtgaccacatgtcaaaaatgtagtaaagtggtttgcagactgtcctgttcattattttgctgacttggaaaccttaaagtgttttgtatccttttcattatctacaaaagtataaattgtaatggaatttacataaaaatcctgctggagagtggagactttactgcatagtcagcttcgccttctaatccaatcttccccaaagcagttggtatgacagttgccaaactcaaacagcaggatctcttttgtaaagaaaagtgtgaatttgagctataaaatgaacagaatatttttctattactctggatgtttcctcttgctgagtttacatgagaagtctagcaggaggtgttattaaacagcctcagaaattagccccaaaacaattatcttggtttagctatggaaaaagacaccagaggcttaatgaaaagagcatttgaatttttgtgattgaatatctgttggacacctctgtagttattaacccttatggacaggatttcagattttttattatttttaattgaattggttttggaaaactgcagattaaaaacacttttctcccctgggttagtcagagatcccagagcaaactgtgtaataatgggttctttaaaagtttggtttaaaccttgcctcatggcaaggaatataccctttttcaacataaattagagttctcatattacaatagatttatagaactactacgtaagaaagaatatctctagtcatataggccaccatccgttcctcacaatcattatctgccaatacccatggctttctttgtgtttagtagtaaatttgctatgaattaaagcttcctacagactccttaagacaatattcctaaagttactatatttttcagttttttatcttcgtctacacatagccagaacatcaggtttctcaatcctgcttctttctctgtgttcctttacaatcccaagtaatttctctgtcatcatagtatttgctatttttaaatatttgttggctgttatcatgtcaaatcttaagttacttagccagttgctttaatcttttctcccaagcccccttcccaacctcacctccccagtcacttcatcatttttttttcttttctctttactctctccagtcttccacatatttctggaattgagtttatccaaactgaatgcacttttccaggtgcatcatatatcatcccttaggtctgggatatgatggttctttgtatacagcccaatgctagtggaatttgtctttttttgtgatcactgtcagcatgttgactcagagcgttttttgaacatctcctgctgattcctgagggggcctttctgcaagtgggctatcctctacctggtagtctatttttaaaatgtgatatgggagaaaacatgattttgtggactgtgttagaaaacatgtccaggtaccacattccaccccctgccatttttagaaacaaatctattttattggcatttttatttttgttttactatattttattatgaaaatgtaatggtagcatatgcagacaaattgctgctgaggttgccagagtgaaaatggagattcttctagtcgtattacagacattttaaaaaaagtagttgaaaaggtcagcactgaaattaaaagcattcctttttttcttttcttttttttttttttttgagacgtaatcttgctctgtcaccctggctagagtgcagtggcatgatcttagcttactacaacctctgcctcccaggttcaagtgattctccagcctcccgagtagctggattacaggccactacgcctggctaatttttgtatttttagtagtgacggggtttcaccatgttgctcaggctggtctcaaactcctgagctcaaagtgatccgcctgcctcggcctcccaaagtgctgagattaacaggcatgagtcactgcgcccggccaaagcattctttatttaatgttaacaagtgaggtctgtatattttcttcacctgttcgtttttttaaactgtttcttctgaccatcaaactagttcacaggaggtacaaaactgagggtgagaagcaagagaaaagagatataaaattaaatatgaaactacaaaattttagtaacacaaatttcagttatacaaattttttctatatcatcataaggaagtactactcaatataaaaaggctattgcagctattagatggaagtaggctacaccaaaatcaaccacaagtcactttaagcagtgtaagaaaatattatataacacctatatatcaataaagcaaaactggataacttgtgagtctgatgaattggggaaaaatcctcacttatatattaacatatatttatgtttatatattatactatatatgttttatatattaacataaataaataaatattcatgggttctaaggggctatcaattatgtaaacctactcccactaatttaataacagcttttcagaaaataaactatataaaatttaaacaatttcctttttttttttttttttaatagagccggggtcttgctatgttgcctggactggtctcgatctcctagacacaagcgatcctcctgcgtcagcctcccaaagtgctgggattacgggtgtgagccaccgcaccccgccagatttaaacaatttctttttgctaaatggtaacggcatacatttatctgtataattgcatgtcactctcatctctgaattataatcaaaatttaactcaaaacctcttttaatatacttggagtcacttttgaggctttatgatggtatcaaagagataaccacactgcttttagttcattcactttcaattatgtatctcagttaatactactttagttatatatccaaacaaccgacccaaattgatcttgaacaccaaagaaatttattggcttttgtaagttaaaaatctgcaggtaggccgggcatagtggctcacgcttgtaatcacagcaatttgggaggctgagatggaacgatctcttgagcccaggagttcaggaccagcctaggcaacatggcaaaccccagtttctaccaaaaaaatacaaaaattgcttctgtgcggtcacgccaagccagcgcctgggcctggaaccgggctgcagctcttcagcttcgcccactgcttcctgaccatggaccccccgcaaagtgaacgagcaggcccttgtgaaaatgtgtaagcaggatccgagcattctgcacaccgaggaaatgtgcttcctgagggagtgggtgggagcaggcggtaaagtaccacctgctactcagaaagctaaatctgaagaaaataccaaggggaaaaaaaaaacctgatagtaagaaggtggaggaaaacttaaaggcagacaaaccatcaagtgaggaaagtgatctagaagttgataatgaatgggtgattgaaccagacactgatgccctttaagaaataggagatgaaaatgcagagataggaccaggcgcggtgactcacgcctgttatcgcagcactttgggaggccgaggcgggcggatcacgaggtcaggagatcgagaccatcctggctaacatggtgaaaccccgtctctactaaaaaatataaaaaattagccgggagcggtggcaggcgcctgtagtcccagctgctcgggaggctgaggcaggagaatggcatgaacccgggaggcggagcttgcagtgagcggagatcgcgccactgcactccagcctgggcgacagagcgagactccgtctaaaaaaaaaagaaaatgcagagataacagaggagatgagatcaggcatatgataagaaagtggttgctattgaagccctaaatgatggtgaactgcagaaagccattgacttattcacaaatgccattaagctgaatttgcgcttggccgttttgtatgccaagagggccagcgttttcgtcaaattacagaagccaaatgctgccatccaagactgtgacagagccatgaaataaatcctgattcagctcagccttacaaatggcgagggaaagcacacagacgcctaggccactgggaagatgtagcccatgatcttgcccttgcctgtaaattggattacgatgaagatgctagtacaatgctgaaagaagttcaacctagggcacaggaaattgcagaagaaagtatgagcgaaacgtgaagagcgagagatcaaagaatagaaagagttaagaaggctcaagaagagcatgagagagcccggagggaggaagaagccagaccacagtcagaagctcactatggctcttttccaggtggctttcctgggggaaatgcctggtaattttcccagaggaatatctggaatggccagaatgcctggactcaatgaaattcttagtgatctagaggttcttgcagacatgcaggatccagaagttatggtggccttccaggatgtggctcagaacccagcaaatttgtcaaaataccacagcaacccaaaggttatgaatcttatcagtaaattgtcagccaattgggagtcaagcacagtgcccttctgataaataaagcccttgctgaaggaaaagcaacctagattaccttatggatgtcgcaataatacaaaccagtgtacctctgaccttctcatcaagagagctggggtgctttgaagataatccctacccttctcccccaaatgcagctgaagcattttacagtggtttgccattagggtattcattcagataatgttttcctactaggaattaatccctacctctctcccccaaatgcaactgaagcattttatggtggtttgccattagggtactcgttcagataatgttttcctactaggaattacaaactttaaacactttttaaaccttaaaaatatttaaaacaaatttaaagggtctgttaattcttatatttttctttactaatcattttggatttttttcctttgaattattgggcagggaagatacttatgtatggaagattattgctctaatttgagtgaaataaaagtttattagtgcgaggcaaactaaactcatttgaggataaacattgtattggatatgtggttcctgaagcattttggcttgtctttttaaatgctttatccttttctttaaatatttatttcaataaaactaactgggaccaccagtatttcagtaggacctgggtagagactggaagtacttggcagggcagtggcaatcttgctgtgttttatataacatgcatctttgggcaggtttgcccttaaatctcaccctgtggtgaagggatttttttttgtaatgctgcagtagaattggagtacttagttctgttcttgtccagtatatctaataaatgtttcatattatttccacataggggaaatgagggagtacttttctttttatatttctatgcttaaaattctctttcctagtcaaaaaatgcgcaactccgtgtctgctttctgcttgttaaatttttctgccttacttttcttgggctaaagacaggctttttccaccagcatcatcactgttattatcattaatggcataattatacaagcatatttaatgctgtgtttaatttaatatgtaatacatagagtaatggtagggtaatacccacaacaactgtagtttcttacttggccgtgagaatgcttacttatgtgttagacttccactctggcaacatcttgtcatatcaaaagacactggaaagagggattccctttgttgtttggtcttctacttagaaaatacctattggaattagagtttatcttgtagtattcatatttgtattttgaaaataataaggtttgaattaaattgatatgcacagaggggaaccaatttttttgatccaatgtgaattataaatgagataatccagttgttcattgtggagttgttgagactatgaaagacccattgtctttgtattcagctcttccttaaatagtgtaatcctacccccacctccgcttgctttctttccctcccctccaatgataaagaaaatgataaattttctgttgtgcattcaattcttattttaaataagactatgtatagacatcgtacctgacattgctatgtttctaacaatgtttcaatttaaagtgctagtgcttaaaaacattttcatgggataagaccttgcatactttgcttatttgaagaatcagtggtaggtgcagtgaagtaaattctatggagtacatttctaaaacagcacatttctggaataataaataagtttattcaggttctaaccctttgctgtacacaagcagacagaaatgcatctgttctgtaaatgagaaaaagctattatgctgatggagcatgcttttaaaatcctttaaaaacaccacagccgggcacggtggctcacgcctgtaatcccagcacttcgggaggccgaggcaggtggatcacaaggtcaggagtttgagaccagcctggccaacatagtgaaaccctgtctctactaaaaatacaaaaaattagctgggcatggtggcgggtgcctgtaatctcagctacttgggaggctgaggcagaagaattgcttgaacccgggaggtggaggttgcagtgagccgagactgtgccactgcactctagtctgggcgaaaggtgagaccccgtctcaaaaaaaaaaaaaaaaaagaacaaaaaacactcaccacataaacttgcatttgacgccaggcacggtggctcttacttgtaatcccagcactttgggaggccgaagcgggcagatcacaaggtcaggaatttgagaccagtctggccaacatagtgaaaccctgtctttactaaaaatacaaaaaattagctgggcgtggtagcaggcgcctgtaatcccagctacttgggagggtgaggcaggagagttatttgaactcgggaggtgaaggttgcagtgagctgagatcatgccatttcactccagcctgggtgacactgtgagactctgtctcaaaataaataaataaataaataaataaataaacttgcatttgagcttgtgtgttatgttaacatatgttctcctttctcaaaattgccaacgtgtacttggtttaactcaggaacagtttcttctggattccttatctgatttatttaactgaattatattctaatattgcaaatatcaccataagtgggtaatagtaaaattcctcttctgaaaatgtgtactgtgcttttagatttttaaattccacaatgtaaaatacattcttaattttcaaccccctccaaaaaacacaaaaattagctggacatggtgcacgccggtagtccccgctagttgcggggctgaggtgggagaattgcttgaacctgggaggcggaggttgcagtgagccgagatggctccactgcactccagcctgggcgacagagccagaccatgtctaaaacaaaacaaaacaaaacaaaacaaaaacccaaaaaccaaaacaatccgcaggtggtctttaggcactgttgattcatgatctcagaaagcatctcaatgacctgttttctctctgtttgtaggtattttctcttctgtacagtgtccactctcagcaggattgtcccttggggaaactgcagcagctccatctccttgcccctcttttattccaatagtcatgagaacttctctctcacaacccttacagaaatcctcagcctggctcttacctacctgaattgggtcatacatccttccctggactcatccctgcggccagtcacatgggattaatactgggttactgaaacccttagtgtggtcaaagaaaactttgtgtgatgatggaaacgttctataatctactatgtcccatacagtaacaactagtcatgtgtggctattgattactcaaaatgtgcttaaggcaactgaggaactaaaatttagactttcttttaagtatgttaaatttaaactaaatagccatgactgtattggacagcactagagttgagagtgcgggtcaaacctacttatattacatggattgaggagtcgttccccaaagaaaaggttttgggagaaggaggtcctattttaccagaattgggaaatatagatgccaaggggtaaaagtagcacatgttcactatacgtactctaaaacttcaactttttattaacacttttttgactgatagtttcatttcacgttatatagctcacatcatgttacctacagtttttctaatgctttgtttttccttaattagaatgcatacagtaggaactttggacagataactgttcaggcctgaataagaatccatcctaagctatcattagggattcactgcttttaattgaattctcttttatgtacactgtgtctttcagaggatattttaaatgacatatatggaaccaagtttacattaaatttcatgtggcatttttaatacagataactgaatgacaaagtagtaatcagtttatagatattgctgatgtcaaacatgtacagtaacaattgcactacaatgttctcctttaactgaagtatgcaaattttctctttgatgctgacttattcattgattcaaccaagtttccaagacaggcagggttcttgccctcattgagcttctaattctcaattttgtgaaaatatgagacaccatccatgttagacttgaaacaaaatagaccaaattaatactggtttattgcagaaaatttagaaatattaagacataattagtggaaaataaaaattatctataatcccgtcacacagaaacaactaccattaatgttttagtacatatttatttaaaaagtatatgtatattagtacttatatttatttgtataaggatgagaacctgctatagataatcctttaaaacttaatttttttttgagatggagtcttgctccgtcaccaggctggagtgcagtggcatgatctcagctcaccctaacctctgactccctggttcaagcaattctcctgcctcagcctcccaagtagctgggattacaggcacgcgccaccatacccagctaatttttgtatttttagtagagacagggtttcaccaggttggccaggatggtcttgatctcctgacctcatgatccgtccgcctcagccttccaaagtactgggattgcaggcatgagccaccacgcctggctgaaaactcaatttttacataatcatatggtctttaaaaacatcgtgtttaatggctgcacagtattccattgtgtgaataaaatatatatatatatatacatctaaaaagtaaaactcttaggtaaaaaggttatggactttttttaacattttaaagatttaggaaattacaagttccatgtaggcaaaggtttttgtctgttttgtttactgctaaataccagtgtgtaggacaatgtttaacacctagagtatatttaataaatatttgttcaatgagcaagtgactattggtatatttctcatcataattcaaacagccaagtatgagatgacccatttccctaaattctcatcaactttgggatttatatttttttcttttcagttttgtagacagaagatggtatctcattatggcttttgttctaacttatttactttttccagaagtacaaattgtgtccaatcatgcttacttaggcaaaaacaagttctacagggtgagaaacttgtagcctgattttggctgaatatctcaaaatcttaaaattttgactaagcaaaatccagcaggattatgtgtttgggaatcatatttcggtccactaagaaatcacatgactagagaagccactaagcctactttacctcataacatattaacatgtaaaaagcctttaaatgcaggtatttgtgttttactaaatcaccaaatagagaaacctagataactgtgatgaccctgcctaatatttagctctctctattctctgcagaactttttttcttcatgccctaaatgtaactcatagtctaatacataagcacaatcgaagtttattataaaaactatagagaaaatgcaaataaaccaacattgggagatccaatcaaatctcatgtggaactgtaactaggacctagaacacaaacatctcatggggctgtctcctctcgccgagcatctgcttttattctcttgctcttgcccccactcaatctctctgtctctcttttactcctctctctctgctgtagtgcctgtccatgctgaaacatggttctgcactggctttagatccctttcctattcaagcacttaactaactgtgctccagttccgaataagagaattagatccacttctcttggggaggtaactgtccttcttctccagcccaatctgctatgaccctagggaaggatcccctacttcaaatatgggagcaaagatgccctattgatatgggagtagttaaagaagaggggttagatctgataaacatcccaaaaggcatatgtcacaatgtgcctgcacttgttagatgctaggatacaaatataggaagaattattatataatatttattatattattatataataatttattaatctaacttgagtatacaatttaaataatcttccagccatcatttaaaagtcttttatgataatcagcagtttctaaaaatctagttttaattctattgctaagcttcgctgtatttatttttcaacttaagtgttttgccatttgtccctgtcagagatctttgattccacaaaaacaattttctaaagtttattttttgttctactaagtatgggttcttatttctagttatttttaactgagctgctgtatcttgcaattttagtactttcttgcagtactgtttttctcaaaattacctgactttgcaaaattaaataaatgaaaagaactacctcttgcaatgccacatttcaagcatttttgagataacccaactgtgctgtctatactaagcaaaatgattcattgaaactagtgatttaatgatgtacatattttttccatctttttcattttctttgcatttcataattttatattttcccccttcaattccattgcaattcaagtctattatggaatgaattaaatcattttctatttctcatttaactgatttctgacagttaatctttccagttgtaactagggtgatttttgaggaaaaagaaaataaattacatttaagttacacgtatgaacaataaactatttaaatcaagccatctccatcattaatatcattctggccatatactctgggtcttgcaatatatgacacatggctaaatttacgggattggtcatcttgcagtttcattacttctcctattcagatatatcctcaaattgtggcaatatgcatgacatgacagccttccttaatgactgatagagatagtttcaccatggttcagaccactgtgatgagcatcaatcactaagacagacaaagatgtcaaagctgctaagatgctctttaatccagtgatcctaggaaggcacaactgtcagcacagatctaagcaattgtctagctcggtggtccctaacttctttcagttagaaaacctgtgttataccagaaaacatccttgaagaattccacttttattaaacacatatacaatggccaacaccaggcacattgtaacaaataccattttagatgttttacatattgccttaaccctttttaccccttttctctgaaaattgctcccattcctatagaggtggccacttgtcctatatttgaggttagaaatctttggaaataaaatttaaatttactaattataataacacatttattcaaagaaataagtgtaaagcatgctatttattcagtcaacagatagtgcttagtgcagggccgggcacagtggcttatgcctgtaatctctagggaggccgaggtgagtggatcacttgaggtcaggagttcgcgaccagcctagccaacatggtgaaaccccatctctactaaaattacaaaacttagccgggtgtggtggtacatgcttataatcccagctacttaggaggctgaggcacgagaattgcttgaacctgggaggcagaagctgcagtgaaccgagattgtgccactgcactccagcctgggcggcagagtgagactccatctcaaaaagaaaaaaaaaaaatagtcctcagtgcttcaaacaagtagagaaccactgatccagaaaatatacttgttataaaattcactcttaccttaataattcagataattgaagaagttttttgttgtttcattctttacttaacattattgatcaacctgattatctactttagctaatatacacagacaaaacctgtaattttataggatgccatgtctaaggtatcacaattaccctcccatgattcagatatggtaaaattatgaatatatttctctgaggtgcagtaaaatagtttatttattacttcctcaacatctcactcacaggtggttacattttgaaagattattaactaggctgtgtaggcaagcacaataatttgacgtcaggaagccattgtctgagctagcctccctcctgctagggtctaaggatattatttacagaaatgaaccagtgtattatgtttaatacattcttagaacatttgtgcatatactatgttaggttttcctattttaagtgtttctatgttacttgagttcattaaaatttttttcccacctactttttttccccttaattccattaggctttttaaattcctacactggctttctaatctatcaattttgtacttacctataccaaatgagaactctcaccttcttcaaaatctgattcaaaactgatttccttcaagaacttttcagaataaatgccatgactttgcacttcctctagagactccctaagatttcaaatgttctatcatcttttttttttgcagcatatatatcatgcttattatatattcagtttgaactgctttatgctttgcaaattttcttttttggtaattgcagttacttccgtatttcacagatgtgtgtatgtgcttgctgctctctacgtcttgataatgctttgcttcagcctgatgcaacatggcctgtttgtttttttaaattttgccagacagtgttcagtaccatttatcactgttgactaagcaactaacaaattcttcccaaagaagagtggcagtgcactttgcggtttgttaattcattaatttacccattaaagattattgattgatcaactcctgtgctcctggcactgtgctaagcacttgagatacatcagaaaaagagagagactcagctatagggttgataatctggaccaagacaatctgttcaaggcacttgacccattatgctatccaaacattgttccaatgctctcgctatccacagagactagagtatcactagtccctgtccctttttcttttctctgtaacctacttattgctgttaacacagtcaagggacaggtagataactgtgagaaatccatatattttcaaagggaagtgagtagtgatcacatattcattatcttgaccttggagcaggtcagagtagacacagaagaaaggaatgttacctgctgccaactattgttaagagagtacaatgtgagatccacccctagtgcactagttgatgtattgctgtaaaatctctaggtattccagctgtaagaaatacatcagctacatatctcaacaataaatatatttgaaattatacttgtcagagaaaagcttgagagaactacatatgctttttaaactctattgttcttcctttatgtcttagagtttaccaatatcattattaatatttactgttaattgcttatgtatattatttaatgccagcacagccttacagaggtactgttttaaatgacaaagataatgattactgaaatggtgattaaacatacactataagcctagcaccttcataaaaatctcagagctctttacaaaagcaataaaacaacaaactgaaatagcagctgtgaaaatcataaactagtttaagaagataacacttaggagtttaagggttttttgaagcccataaataaaaagatgcaaagtttcatgctcatgaaaactagcttttagaatttgccagtggaggatagtagactaagtgacctaacatttgtcttcaaatcacaatggctatgttgaaatggatggaataccatatatatgtcttaagacttttatttgattttcctaggcagaattgtcaattgaccaatttttttacatttaactttaaaaaaaagaaagaccataacaaaacaagcttatgataagggtttttattttgaagaaatttcaaatactcttaatctaaatcctctatgccttctatgttttacgatatccataatattcactatgatgatctgagatactgtagaattgcatttatcaagctacttgactatattcactataatttacttacttcagcaagacaatcaaacaaaagtttgctgcaaaaggtgatactggctgatgcatgaggtagtatctgagctcccttgacattgtaaggtcactgcaaccaagggttcattaccacattgtgaagagtcagcttcaatgtataagctgctgtccagagaaacctaaagaaactaaagaaagcagaccaatcattaattgtatgtgtcgtattagtttgctagggctaccataacaaaatactatagactgggtggcttaagccacagaaatctctcacggttctggaggctagaagtctgagaccaaggtgctggcaaggttggtttcttctgagccctttcttcttggcttgcagatggctgccttctcactgttctcacctggtctttcctccatgtgcaagtacctcaggtgtctcccagtgtgtcctaattcctctgtttataagggtaccagtcaggttagattagggcccaccctcacggcctcattttaactattacctctttaaaggcactgtttccaaatacagtcacattctgaggtactggaagttaaggtattaacatatgaatgtgggggacggggcacaatttagcccataacatatgttgcagtgagtggaagagcatccttctaccccctgctaatagctctgtgcacttggaacttcagaatgtgaccttatttggaataaaggagctaaatgatttgaacacagggatacaaagaaggtaactgcagacactggggctgacttgaaggtagagggtgggagcagggggaggatcaggaaaaataactaataggtacaaggcttaatacctgggtgatgaaataatttatacaacaaacctccatgacacaagcttacctatataacaaagctgcacatgtatccctgaacttaaacgttaaaaaaggctgggcgcagtggctcacacctgtaatcccagcactttgggaggccgaagtggatgaatcacctgaggtcgggagttcgagaccagactaaccaacatggagaaaccctgtctctactaaaaatacaaaattagccaggcatggtggtgcatgcctgtaatcccagctactcggaaggctgaggcaggagaatcgcttaaacccggggaggtggaggttgcaatgagccgagatcacaccattgcactccagcctgggcaacaagagcaaaactccatctcaaagaaaaaaaaaagttaaaaaacatttctttaaataaaatttttaattttataatgaaagaaaagaaagaaaacatggaggggaaggtgataggaagatggaggcagagattggagtgatgcgtctacaagtcaagggaaaccaaggattgctaacagctgtacaaacttaggagagagacatggaacagattttccatcgaagcctcctgaagaaacaaaacttacaacttgattttggatttcttgcctccatgactgtgagagaataaatttctgttgttttaagccacccagtttgtagtcacttgttaaagtagccacaggaaacgaatacagttattggtactggaaaataataaacacacctaccacataccaatgacctccatgcacaaggcattattttggtatatgttgtctcttaagtcctctaatcaatgaagaaactgaggcttaaagaggtgtaagttggccaggccatggtggctcacacctgtaatcccagcactttgggaggccgaagtggatgaatcacctgaggtcgggagttcaagaccagactaaccaacatggagaaaccctgtctctactaaaaatacaaaattagccaggcatggtggtgcatgcctgtaatcccagctactcggaaggctgaggcaggagaatcgcttaaacccggggaggtggaggttgcaatgagccgagatcacaccattgcactccagcctgggcaacaagagcaaaactccatctcaaagaaaaaaaaaagttaaaaaacatttctttaaataaaatttttaattttatagtgaaagaaaagaaagaaaacatggaggggaaggtgataggaagatggaggcagagattggagtgatgcgtctacaagtcaagggaaaccaaggattgctaacagctgtacaaacttaggagagagacatggaacagattttccatcgaagcctcctgaagaaacaaaacttacaacttgattttggatttcttgcctccatgactgtgagagaataaatttctgttgttttaagccacccagtttgtagtcacttgttaaagtagccacaggaaacgaatacagttattggtactggaaaataataaacacacctaccacataccaatgacctccatgcacaaggcattattttggtatatgttgtctcttaagtcctctaatcaatgaagaaactgaggcttaaagaggtgtaagttggccaggcatggtggctcatgcctgtaatcccagcactttgggaggctgaggcaggcagatcacttgaggtgaggagctcaagaacagcctagccaacatggtgaaaccccatctttactaaaaatacaaaaattagcccagcatgatggtggatgcctgtaatcccagctacctgggaggctgaggcaggagaattgcttgaacccaggaggtagaggtttcaatgagccgagatcatgccactgtaccccagcctgggtgacagagtgagactccatctcaaaaaaaaaaaggtgtaagtaaacttctctggtagccacaaataataaatgtcaagctaagagtcaaactgacggctgggcgcggtggcttacgcctgtaatcccagcactttgggaggccgaggtgggcagatcatgaggtcaggagatcgagaccatcctgactaacatggtgaaaccccgtcttactaaaaatactaaaaattagccaggcatggtggcaggcgcctgtaatcccagctactagggaggctgaggcaggagaatggcatgaatccaagaggcagaggttgcagtgaaccgagatcacgccactgcagtctagcctgggccacagagcaagaccccgtctcaaaaaaaaaaaaaaaaaaaggagtcaaactgacaatcagtttgactctatgttatggtcattctatgatgctgtactgaactggcagacaatagtatcttgaggttataatgaattaatgattttgtgcttaaatggttcatttcattgaacttagacagtgactcttggaggcagttatagagaagcacaagaagtaagtagaagaggtatctccccttgatattgtagggaatccctgcaccagcatcatcccgtatctttctcttctaaccatcctatacctaatggggttcctcttatttatttcctggataatttatttattgggttattggattatttatttattgggttattcgattattcagcagagctaaacccagtatcatctgtagtttgatgttggacaggagtgtactcttccttgacatggacataagaggccaatttcagtttttaaccttgattttcccttagatccagatctctatgccttataaccaaaatatgattcctggcttgcttctttaatgtttttgactctgaaaatcctgagcagagcctaagtgttcactgtggataagtagatgaggaatgaggacagagatgccacctggaattttacatgagtattcttatcccatctatttataaggtttgccttttctccttttatagccctacagagactccctcactcttttttttgagactgagtctcactctgttgtccaggctggagtgcagtgccacagtctcagctcactgcaacctctgtctcccgggttcacgccattctcctgccacagcctctggagtagctgggactacgggtgctcgccaccatgcccggctaattttttgtatttttagtagaggtggggtttcaccatgttagccagcatggtctcgatctcctgacctcatgatccacctgcctcggcctcccaaagtgcagggattacaggcatgagccaccatgcccggccaactccctcaatcttaacctcttaccaggctccaactagtaatctttgtcattgtattagtccattctcacatgctataaagaactacctgagactgggttatttatgaagaaaagaggtttaattgactcacagttctgcagggagcatggctaggaggcctcaggaaacttacaatcatggcagaagggtgaagaggaagcaggcgtgtcttcacatggtggcaggagaaagagagagagagttaagggggaagtgccacacacttttaaacaaccagatcttgtgagaactaattcaccatcataagaataacaaggggaaatctgcccccatgatccagtcacctcccaccaggtccctcccccaacactggggattacaattcaacatgagactcgggtggggacagagagccaaccatatctagtcatgttcatggagctcagttttcctaacttataagtctgaaccataaaagagggaatattcttatggcttagattattttcgtgtatttatatattttaaggtcagggtatatgtttattttctatcacctcaagagcctacagaattgtcagtatcatctgaatgtgcaaataaaagttgattaaataaccaacagaatggtagctctggaacttctggagtcatcctggcaagtagaacctttcaggtcttgcctttaaaattaaaacaacgcatgtctctttttaatttatagttgctaaaaacaaaaggtgtccagattctacaagacagccaagatacacttaccccataaaatacttttgctgaattatccaactatcctttgattctctggatataactagacttgtgaacagactgaaacccaaattagaattcaaaatttgatagagtgtggtaggacagaccacagtggcctcagacctaaatttaaataaataatgaagttataaaataaacacactctatgtatcctgcattacaaaaaatgtatcaatattgtctgattatgtcttcatggtgccatacaatttggcaggatccggatccggatgtaggtcaagattgagtcttgtgctaagtgataagcaatacaccaaccaatgtctccctttcttggggtcctaattctcatgactggaagaacggcagattctctgagtgagacttcatccttttataatggtttctagtgttacactcagcaactattgaagaagctctccagtctcattctgattgctccagtgcagggacagctcaacaacaaggaaggtcattgaagcagcagagggaaaaatgaaacgtttccacaaatttctagaggtagcccaaccagtttaggaaactaatactaagactgggacatagtgacagcaaacattactgtcatgatatcatagtgtttattgtcaggaccttacagaaaaagcagacagcctgggcacaaaggggctgacatggcagttcaggtgagatgaagaagagacccctctacatgcagtggggtatccttttttctgttatgcattggccagtttggcctctccctattccatacagtgaaactgaaatgtggtgtgatcttcctacccccgttttccagatgcagtctggcattctagcacctgtgttgctgacctcattttcctcatgctttcttggcctcacctcagcctctgaactgtgatctttacctgaggcccttggcctggtgacctaagtgatcatttctctggattctaccttcacaacaattaacctggttataaggttccagccagcaggacttgagctacttctgctgtcattcatcccactgggtgcttctctatgcctgctaccccagggaccagtggcctagtgccctcctgataatgctgggtgcttttgcttttagaaagaacttcacaaaaaccttttgtgctggtaactgtagacaaggcactctattcagtatgaaccaaacagtaaagcaagcctggcaggcagaaaacaaaacaaaacaaaaccacaactttagacaagagttgaattaattaagtcagttatcctaggacaactttagttgctaagatgcagtctctggagtcaaactgcagggttctgcctcggctccataacttgctctgtgaccttatgcaaattatttaactgatgcctcagtttcctcatctgtgaaaagagaatagatatgttggaatgctaaaaatgagattatacatgtatgcatctacaacagtaccagcatatagtaattgcccaataaattattcatggtttgacagaacccttgggcccatttcctctaccttagaaacaacaccatcagcttactcgagaaaatgccctggcctggagcaggcagagagagccaaggtgagctcttattaactgtttatgttaagacattatataagctactctattttctaccccagccttatcctatggtaggcaaagaaaactagcctaacctggtaacaatgacttaaatattaaataattaaaataaagcagataaattgagcaagagatacctgcctcagcagaggccttacgaaaatcaaagttagactcagtctacccagcatgctaagcaaatctccacaatgctacagtgtttctgaacaggggcattcttagctttattgataagataacaccctttctttatccaggctgttccaggcattaggggtgccttagcatgcctaggtccttcccactaaatgccaatagcattcttcagttattctgataataccagatgcctgacacaacacatacatgcacaaacacataaatatacaaatgtacatgcatttctgaagtccctttagagaagtgataccaatccagattggaaaccaccactgtggcaatataatcacatggattgttcaggaaataggccttctggaagaaaataaatattatgatgtcaaaggaagatgagggttggctgaactcacttgttagcccacatctgggaaagtaatatctaacaaattaatactagggtgaagtcacttttaagaaaagatggcagattgtgcatgcgttttcattccaaattattttacaaaatgctggttattctgtttttattcattaaacaagggtttattaaatgcctaccgagtacataccactactatatgcatatccactttaaaaggtttatttgaaccaggacagagcacagtaagtttctggcatccttgaatataatttctagtttatttagtagccatgtctgaaatgacatcttatgtttgagttccaagtaatgaccattaacaaatatagcttaaaaccatttttttactttttgttatttttgtgaagctaagtttaacttggcaacatttttgtgaaagcttcaatgctttttggcctgaacaattgcactaaataatcctaacaaggttgaggcaagaacgtggttattcagacacagaaataaaatccagacatacacgggtacatgtctcaaaggttttgagctcccatagtgcttactgtttgtgctatatagacttgccactcagagctccagccaacatttagtatatgcaagttaaaccatttggtgggctttctcctctacattatctccacaaatggaatatccacagccttggctgctatgaatagaaataggaagcttttgagagaagaaatttatgcaatatagcaaaagagatgaaagagattcagacctcaaagaaagtattagagaaggagggtcagagactgtaagttgagtgtggaaaagcagagtgatggattatagagcagaatggggaaagacatggttaaaggattctattaccataggaaggaaggaaattattttttctcacagagaaaagaaatattataaaccagagtgttatgttttcagtatactgaatggtcttatgtccgttttgtgtattataggccagaggctaatcataggtgaagatgagacaagggaattctaaaaaaaaaaaagacagattatagaataagagtaaagaaaattggagtaaaatgaagttgaagagtgaggccaaaatagatataggaaatggaaaaacaaaacaaaacaaaacatggtaaagaaaggtataagaaaaagaaaagaacttaaaaaataattttatgatttcctatgaatttagagtcatcttatttttagaaaacctactgggcagtatattttacatttttagtgctaaccactgagatactaaaacatagttcacgcagatctagtctttacatttcaacattcacatcttgagatcaactttaacatagtaatgatcatactagaacatcataattggatatattcaattaaatttcgtagagtattacctttacttcttataaggcttgggatctcttgcacttaaaatttaaaggtacatgtgaattttacacaaatctatctacttttcctctaaaagcaaatgcagtaatagcccctgacagaattccctttggaagatatatttttcttagtaagagaaatcaaccaaagacaacttttaaatatttctaaccaagaggactgcaatattcaatcaagttaatgttatcagtgtggtgattatttgaatatctttgatgtcagagccatgcctcagaatttcaaaattcacttgactttgaaatcaaagtatacatgcttttttcctactgtaatataaaatatatattaaaattttatcaaaaaattgaacacacaaaaggaaactgcaaactttgccaaggattttgatacaaatttaatttgttttcaaatatcttattatctatgtaatatataaaacataagctaactgtgaatgtggtgtatattttactatttgtatgacaaaagactgaagttttcctgccctaggtttacattagcatgtgcatttttaaaaggcagtagtatgtattatagtggggaaaatatcagtccaggatttggaaatcctgttttagcttcaatcctggctttgtctactagccatatgatttctttaaatttttttctcttttaaactgggaatagtatgtttcctacctagttcgttgggcataaaaggatgctttaaatcaaatctataaaaacatatgaaatataatttgtttaagtgtagtttccttaggaatcataaacaacttcactcattaaaggtttgttatctaatgtatggctatccctcttttcttcatattgctaaactcttgtactgttcttccattagtggaaaaaagagaaaaggaaaaagaagaaaacatttcaattttcaaatccatccctttactatcatactttagactactctgattaaagattttgagagtgatgacattgaattcaacatttaaaatcaagtgtgttatgtctaatttgtatattttgccttcaaaagatgcaaattccttcttttggcatcatgtgaagagttaagaatgcaacgaaagaactgaaacaaaaacttattccataaatcaacactccagaaaagagacatttttcctgttgtgattgttattatcattccagcccctagcgtactaagagattaggaaagtttatgatatgaatgaatgcataactgaatgaatgtctctatgtttgcaagaaaaatattctattatttttgtatttaattattaatatttgccacagagtcagtcttaccacaaatttttctctgtctccaagccattgcttttcccagaatttctaaattgtgagttgttgctgttttatcaaatatagaatagtcatcacttaaattgttgggcaagttcagtactaacacttatctcttccacttaatctagaggtgagatttgcagaagcatcttaaagacaagagggacagggcttagagaattttttttttaaggcaccgttcttgcaaaagagtgatgtaagaggtaaggaagctaagagacaaaactgaacaaatgagtttagggagaaagctagccttttacagagtaaaaggaaacagaaagtttgaagtactttcctccagcctaatgagggtttttgaaattaagggttcttagagcaaacctggaattagaacaagttaaagaagtaaagaatgtagggaatgaatggagagggcttgtttgtctagagttggtgctttaatagaaaacggcaggtcagcagcaatggctgcagctgacaaattggcatgtataaaaatagggacattcttatgggggcaggaaagcagagtgctaataacagaaggttttttttttttttttgcacttgtattaatccaaagaagttatttaaaattatagttcacattttttttctccatttctcagaattgtttaaagagaggaaagagaggaaaaggaaagggataatttataggatgtaccttaggaattattattagaagaataaaaaagactactactggcaaacctaagtgcattagaaatgaagtaattaaaggttctataagaaaatgagcaaattagagctagcagtcatctattaacctactgtgacttataactcacattttacttttttctcccagtgcaaagctcccttattaccgtgtatgatgttcacatgcaattttctattgtcgtaaccacatatatgtggtgatgagtggatcttaatttgttcttctatgtgcctctagttcaccagctttaattgtagggcacagtttttctgtgctttgaaaagtgcccagcattgctaacctgtgtcagcatttgatgtctatttttgtaatatagcagttatcataagtgataaagataagcaatgaaatgcatgccaacattgaaggaaaggacaaggatagatgtagctgatgatcaaatgtatttactgtgggaaaactaagattggatataaatggtgggaagtgggaagctaaagatatacctagggagcaaagtaggagaataagatacttgcaaagagtgtgatgaatcaatttttaaggaaatgaacttaaattcctgatagatgtttaagtattctatgagcagacaaaaacacttgtgtttctaaatcttaaattaagacatgctcacaatttcatgagaaatcactatccattaaaatattgagcatgtttggcagtattctaaacactacttacattatcccatttaaagtacttgtaaactatatggagtaggaactaatataatccccattttacaaatgaaaaaccgatgaatacagatataaaacaacttgctcaaagtcacacagatagttgagtgacagaagtttctttcaaacacagtttgtgtctgattttgaacacaaattagctcctgattcaggcactagtaaccactacgccctctgtgttctggagaaccataaggataaaatgttactgttgaaggtggaatttttataaagaaactagcaatagtatttaagtacttctttggaaaggcagcacatgatgagaagctgagaaagatcttagtgttctctactccagggctgaagattgtctctcctggacttagtgtaccaaatactgctcaaaattactgtatcaaaatgcctcttattacaagggacaggatgacacactcatgaaaatagagtggaagaacaaaacagacaactggatgtccgtatttaggttcctctttcttttgctgtgtatattttctaaattgcctctatttccagctcaaataagctcatatgaaattatgtttgaagaatatgtttcgtgtactacttgagagatgacaatgtttcattgtttaaaatattattcccaatagcccttgcaactcatttgttccaagcacagaaggaaataatttgataacaaaccaaagtactccagtgcctcatcattgaggactgagttgacaacagaaaaacaagggatgggggactgcaagtcacccagtcatttcagagggggaatcatctcagaagatgacaaatatgagagacttctgtcttgataactagtggcatccttccctggtaatccttggctgttgggcaataaaagacccaatgtggagttaggaagaaaagacttaataataacaaaaatagtttaacttttttatagcacaatgaaatttacaaagtgcatctgcaaatattctctctcttgatctttctctctgagaagcacacagctgtgcattcttggaaaagtcacatatgctttcttgagcatcaacttcctcaattgtaagataggaaaaacaattattcttcttaggcaagttactcagtttcctcaattataaaatgggagaaatagtgggtattaggttgaaacagagttttgccgatagtcaacagaaatggcaatttcatatgattcaatctaatacctatcctatagagttgtaaggattaaatggatcaatgtacgaaaacagagcccagctgttagtacactcagtgttattcatgtaaatacaatctcatttcattcacagtaacactgtgacagataatagggttctaccttgaatataaatttatgtgaaaagcataaatattatttatggatttataaggggggaaatgtagctttacaacaaataccctgcaatataatgctttgttatgtggtttctaggctgctcattgaatattttattagcgagcttgtaaattctttgggttgtttctccctcccatccaaatttgccatccagggggtagttggctagttttgtaggtgaggtctcagtaaatactcttgtgattttgtctatcttataaaatgactcgaggccaaaagaatgagtattgctaggcttgtcaattcaaagagggctttaaaagcatgtcaatatgtcaagagaaattttttaatggattcagatactgcttgatcaaaaagaaataaataaaatataacataatgcatggagataaataacaggaaccttcagagatatttgtttgtacattctatttattttgtggaaagttttcattttgatttttatttctaatataatttgtaaattcctcattagacatcgtgcctttgaaaatatgtgtgtattatatactaaattggtatatattaaaagaaaaatgtattaaacttcaagttataagatgccaaatattatggaggcaattttagtaaaataaaaatgtatatttttaaaaattttttgagacagggtcttgctctgtcgcccaggcttgagggcagtggtgtgatcacaactcactgcagcctcaacctctccaggctcaggcaatcctcccacctcagcctcctgagtagctgggactacagatgcccacaaccacacctgactaatttttctattttttgtagagatggggttttaccatgttgcccaggctggtcttgaaatcctgggctcaagggatccatctgccttggcctcccaaagtactaggattactgggtgtgagccaccacgcccagctgtaacaaatatatttaaagctgtttaatctatattttataaaaagcctctgagaatgaattagaaaaatgatatgtttatagtatatattattttatcctgtgaataaatgttacataaaatcatattatcataattactaaaacaatattattggattctttttaaaataatttaaataacacaaccattattttggccattattctctctgagaattagtatactaattcaaattatatatatacatgtatatacacacgtgcacacgtatacacgtatatacacacgtgcacacgtatacacgtatatacacacgtgcacacgtatatacgtatatacacacgtatacacatgtatgtatatacgtatatacacacgtatacacacgtgtgtatatacgtatatacgtgtatacacacgtatgtatacacgtgtatatacgtatatatatgtatatacgtatatacacatgtgtatatatgtatatatgtgtatatacgtaatatatacatatatgtgtatatatgtgtatatatgtatatatgtatacatatatacgtatatatgtatgtgtgtatatatacatatatgtatgtgtgtatgcatgtatatatatgtatgtgtgtatatatgtatatatacatatatatgtatatgtgtgtatatatgtatatgtgtatatatacatgtgcatacatgtgtatatatatatatatttttttttttgagatggagtcttgctctgtcgcccaggctggagtgcaatggtgtgatctcagctcactgcaacctctgcctcccaggttcaagggattctcctgtctcagcctcccaagtagctgggattacaggcgcatgccgccatgctcagctaattgtttgtatttttagtagagacggggtttcatcatgttccccaggctggtctcaaactcctgacctcaggtgacccaccagcctcggcctcccaaagtgctaggattacaggtgtgagccaccatgcccggcctcaaattatattttaaacattatttatttgaaaatgataatataggatgtattcaacatagtcctttatttgactgaaaaataatttttcctttaatgtttgtgtgtgtgtgtgtgtgtgtgtgtgtgtgtgtgtaagagacagagagagagaaggagtgagaaagagacaaagtatgtgtagaaacacataagactggtagatttctttttattggattttttcatttaattctgggaatcttatttataaatgctgactttagacaaaagctgagattatcctcattttaccaaaaagaagactaggtgtaagaaagtaggagtagcttgcccaaaattatataacaagaactaggaagactttaagccaggttttaaaattccttgtttggtgctctttcttttacagatggatgctactaacttctgcttacaaatctatcctagaatttaactgctttcacattcttacttttctattcttttaactaatagtatcaattctttatattataatggtatcattggaacaggtagacatctattaagctaaggactaaaatggtcaatttttgtttgaaaataatagaagagaccgggtgcggtggctcacgcctgtaatcccagcattttaggaggccaagatggacagatcacgaggtcaagagatcgagaccatcctggccaacatggggaaatcccgtctctactaaaaatacaaaaattagctgggcacgcgcctataatcccagctactcgggaggctgaggaaggagaatcgcttgaaccctggtggcagaggttgcagtgagctgagatcgcgccaccgcactccagcctggcaatagagggagattccgtctcaaaaaaaaaaaaaaaaaaaaaaaagaaagaaagaaaaaagaaaacagtagaagagttttgaccatatctgcaatttaaattatttaaatagagtcactatttgagggagttagtgaaacatatttatctgaaaagtggttaatgaatgataaatttttttgtctatctcagtctcttatttctcattcattcctttttttttgttttttggtttttttgagatgaagtctcactctgtcacccaggctggggtgcagtggcatgatctcggctcagtgcaacctccacctcccgggttcaaacgattttcctgccttagcctcccaagtaactgggattacaggtgtgtgccaccacgcctggctaatttttgtctttttagtagagatggggtttcaccatgttggccaggctgatcttgaactcctgacctcaggtgctccacccgccttggcctcccaaagtgctgagcttataggggtgagccactgtgcccggcctcattcttattctaggacatttgaattcttccagcatactgtttgaagtagaacagctacaatgaaaatattttttaaaataaaaatagattttaaaattatgaagataatgtaatgcacatggaaaatccaataaatataaaacattttcttttttaccttaaaaattccactcaaactgttacctcaactctttctttcccttctaccttccccaatttaccattttgattgctatctttccagaccttacaaaatgatttagacagttaagagtttgctacatatttggcccaaacatatgaaagaaaaaaagcaaacaaatatgagaagaatatatttctcatcataagagactcttaccaaataaatggtaaactgatgacatgaaaaaactaaaccaaccattgaagacagcacatctaccattacttctccttgttcatgttctgttctctcatttttcttcattttccttcccagtaccattaataacctggcataccacatattgctattgcttgttgattgtcttttttcctgttactagatggtaagctccatcaggacaggaactttgagagatttttattttcttgaacagtgcctggaatatattgatgtattataaatgtttgttaaatgaatacataaactagacattggatgctttcagaatataattttatggttaattgaataaaactatgcttgttgaaaagatttctaaaatgtctgtagttagcacagcaatatttcaatagtgagtttcatagtcttttttaggttcataattttgaatgtcatttctcattatataaggtaatatataagtatgggaattagagtaaaattcatactgacttcatgactggccctgttttgaataaatcttcagtctgaatgtagttgcttataattggccaatttccctgagaaacaagccagtaagtaaaatatattgattaattgagaactgcagttaattgggtttttactaaaatttattatactggcacagagtaggcactcaataaatatttgtcaaatatgtgaagtctagttagaatttttttagtttctcaaataaaaagaaaaattttcaattaaacatgtgatatgcaatagcattagaatctacatagcagacaagctttttcaaaagtatctcaatttgttctcatgctcttctttttctatctttctgttcacctaacctatgaagctgggacaagtaaggtggaaatctctaggtgatgtgtgaacagagagcctcagtagcctaaacagtgtcagagctcaaataggctgagcagagcatctgaatgggaagggtcagatgcctaacagcaataggatattggttacaggtaggatggttgatcaaaaagtaaacatattaaaaataacaggagacagatgtttcattgtcagacaagttgttacaaatattaagagagagaaagtatggctgggccaggtggctcacgcctgtaatcccagcactttgggaggccgatggggctggatcacaaggtcaggatttcaagaccagcctagccaagatggtgaaaccccatctctactaaaaatacaaaaaattagccaggcatgagggcaggtgcctgtagtcccagctacttgggaggctgaggcagagaattgcttgaactcaggaggtggaggtggcagtgagtcaagatggtgccactgcactctagcctgggcaacagagcaagactccatttcaaaaacaaaaaaaacaaaaaacaaaaaacagacagagaaactacattggaccctgtggtgctggtttggaaatggaggaagcagtgtttcatagatatagatatatatggaaataaatatcaatgtaatatgtggatggatagataaatggatttttatgtgcatatatctccttggttctggatcctgagaacaatgacagccccaaaacaatgggcacacctacatcccagatcttggtttctcaataacattctcatctaaaagaaattaagactccttagagaaatagctgattccagggctggggcatgaaaaatacaaaacgagcctggaatatattactgtgctgaaatacggaagtattaaaacaatgccagggacatgtcaaagaaagatgtcagacagaagaggatcatactgaccatatctgggacaatttgaaaatcaaagtgaataataacagtaacagcagattataatctattgggtaaaatgaatatccatgagtccactctgacatatataaataaataaatagaaagttactctacttccctgcaatatacttatgaaaaggaggaaaagagcaattatacagtcatcaccttaatcatgagatcagtattcacatcatgagtaatgtgccacctgataggttgctatgaaatgaacatagcatcacttttgtgatttttccgccaaagagaggaaacctgaatctgataatgagaaaacaaaagagaaacctaaacaaggagcatcttacaaaacaaactaactcacaatcttcaaaactgtcaaattcatgaaagccatggtaaaactaaggaaatctttcagatcgaaagactgaaaatgcataataattaaatttaatgcttgattgtggactggatcattttgttataaatgacattattaagataagtggcaaaatttgaaggggatctgaggattatagtgatgtatcagtattaactttctgatttcagtggttgtatttcagttataaaggaaaatatccttgtttgttgaaaaaaatatgttgaagtatttgggaataataagtatcatatcatgttgacacattactctcaaataattctgaaaaaatgttatttgtcattacaacaattttgtgatttaagattgtttcaaaataagaaaataataaaattttattcaaattcaacatcttccatgatatgttgtcataatcccggaataggtttcaggttagtttagagaaaagtcttttacatgttataaagttttataatacagtttgctatggtctgaatgtttatgttctcccccaaattcatatgttacagtcttcatcttagatgtgatggttaagaggtgaggcctttgggaggtgattaggtcataagggtggagccttaatgaaagggcttagtggccttataaagagagagatcccacgccccttccaccatgtggcattaaagtgagaaggaagctatctctgtgaggaagtccaagcggaagggcccttgccagacattgaatgtgcaggcaattgatcttggacttccctgcctccagaactttgaaaaatacatttctcttgtttataagtcacccatttgatgacattttgttatagcagcccaaatagattaagacacatttggaggtgtagaaagcagagggctctcgccatctccactctttaaaactacagcattataataatgaaagaaaaaggcgctatacttttgtttcatttccaatgaaaacaattatgatctcttagacatttggtactgatagttatagtaatggttttctgtttctttcctcctttttttgaaacaagagtctcacagagtgcagtggcatgatcacggctcactgcagcctcaacattcctggtctcaggtgatcctgccaccttagcctcctgagtagctggtactacaggtcctggccaccacacctggctaatttttgtagacacagggttttgccatgttgctgggatacagccattcgccactgtgcccagttggttttctgttttcttttgtcttaaaggccttttaatatacttcctttagtatgaagaagccaaatagctacagtaggtattaaaatagcaacaaatattattcaaaccaaaaatgatacttccccagagaaagaaaatttagtagaaataatatgtggacaggtaaaatttttatattacttacattgctataatacaactattttaaaagagcacagcaaataatagattacattgtttcctagttgtgtaaacttgtagtgaattccaacaagaacaggctatgcaggccatacatgaggaaagtgctagaatggtactgaagacatcgctgtatctattcatgttatcaatatctaggtgtgtgtatttgtccaatttcatgctgctgataaagacatacctgagactgggcaatttacaaaagaaagaggtttaattggactcacagttccacgtggctggggaggcctcacaatcatggcagaaggcaagaaggagcaagtcacatcttaatgtggatggtggcaggcaagagagagcttgtgcagagaaactcccgtttttaaaaccaacagatcttgagagacccattcactatcatgagaatagcacgggaaatacccgcccccatgattcagtcatctcccaccgggtccctcccacaacacgtgggaattatggaagctacaagatgagatttgggtggagacacagagccaaaccatatcagtatgtaacaaacataggtaaaatgagagcatcaagtaaatttatggagtagggttgaatatactattaaagatttatttgcccaaaagtatactgatatgtttgagaaaatagaataattttctttaaagcaaaatacaaaagtacataatttcagaaattatgatattagaatatccagtttgtcaattcggaatttaaatattaaaaatttagattagaatgtaagctcatgaagtggaataaacaaatattctatttggttttgatctgttttttagttgatcagtcaagtaataatttgcatcatatcaaacacttcaaatatctggaaagttgtcattattactcctaataccagaaaggaatcccagaagctgaatgtctttccctaaaggcaaatgtttaaaggagaccatcttttgaatatatgatggtgcatgttttgggggaatattctttagtctattgtgagaatgagttgtggtctaaggaatttggagtgtcactggagagaagacaaggggagtggggtccttcatagaaaatattttatcccatgactacacatctgccagccagcaggtacttcctcctgatctgtcatggtggtgtgctgatagaaactaaaaaatgccaataaggcttcttggacttaatagactccttccctcccttcctccctccctcctttggatttcatagattccctccctccctccctcccttccttcctctctctctttctttctttctttcaataacacagtgtagtaggttcaaaatccaactttcttgctttgtagctttggaaacatagacatactaatttctttgtgcctctttttttaatatataaaatggggataataataacacccaaattataatgagcactaaatgagacaacgcgtgagccaccatgcccggcttttttattttctcctcctccttctcctcctcctcctcctcctcccccttctcccctcccctcccctttccttccttctttccttcctctttctttcttccctccctctttctctttctttctttccttctttctttctctctttctttctttcctcctttctctttctttcttttcttttctttctccctttcttttctttctctcttctttcttcttttcctttcctttccttccttcctccctcccttcctcctttcctcccttcctccctcccttccttccttcctctctctctctttctttttttctttctttcaataacacagtgtagtaggttcaacatgcaactttcttgctttgtagctttggaaacttagacatactactttctttgtgcctctttttcttcatatataaaatggaggtaataataacacccaaattattatgagcatttaatgagacaacgcatgttaattgcttaaatttgtacctgagagataggaaacactaattgctagccattgttataattattggagataaggaacaaaggtgaaaatatcaagcaaaaatataagctacactaagaaatttgtgacttcttagaacacattgtgatgattctctgaataaatatatttactggtacatacccaacacaatattagaatattagggcacataagttctcttttaaaatagatttaaagatatatatatgtgtttatatatatatatatatttaaagatatatatagatttaaagatatatatatataaatgcatatatgaagatatatacatatatcttcatacatgggggtgataattgtagtatttgtcacagcaatagaatgaagacttcattataaaaattatttagcaatttgcctggcactactaataagcactcaaagcactagtttgctactattgctaattatcattatcattattatatatgtgagagatacatataagggcataattataattttatactatgataagaacagaagagttaacatttcaagtcttttaaagaatgaatacagtttttccagatggagaagagggaaagagcattcatggattccccatgtgttttacctaaacttgacttgttttcaaaaagtcactgagaccacaattattttactgagaaactgcttttgaattgaccatgtccacacaaactaatcaatcaacagataattgagcaccaaatctatgaaatatgcagagaaagtgtagacaggctcccagctggttttgctattctacattctctcttctttagcatacttttcatgagcttgacacagtaatctccctaaagtgcagttttcatcatgctgtaactgctagaggacatagagtggtttttgaatgcctgctgtattaagcccaaacgactctatctagcttcaaggatcctcaacagtcttgcaattcacagtatggcatcagcaccaacatcaccagggaagttgttagaaataaataatctcacacctcaatccgcacctattaaattaggttcctcattttaacaaggtccccaggtatgcacattcgagtttaagaaacatttctttaaaatatcctttaatctaaaccaaacaaaatcactaatccatatacaacccagtcttatcaagaagaattaaatcttttcattaatttctctgcatccaaagcaatccctttgctcatgctcttaactccactggaaatttcttatttccttcacatctactttctaactctcatccattcttgaagaccagtgaaaagtctcatatcttccataaaactaagaccatttcaaagtacactaaccttcttgaatatttcttgcacttaggacaacaccaattctattcttcttttatcattcattcattcattcattcattattcactgaatatgcattttcttaatgcttatgattatttacctgacattgttgcattggccacaataaaacaagaatgcaagactttccctactctgtcaattcccaatgagggatatcatggttcagtagagatgtcttaagtttcatagacaagaggtataagtgggtagatgtgagggtgcaggaccatattgcataaagccacataatttgtgcttttttgttaaaactacttaatggaaaaatactgttaaaatatattaaaaccttttgtagtttgaaacagatgaatattttaactgttacggacatgacaaagagatgttgtattttgtttcatgttaattttccctcctataggtaattgtgatttttttataggccagcaatatgtctttctccattcattcaacaaataacagaattttaaaatagctcctatttgtccttttctgacttcttaaattttagacatgataggcactaaataaatacttgttgattgaagacactctttgatctaaagttggggactaggtttacacacgtggaacaaccatttcagaaatgcagccaccctttcctcctactgttattcatgacataaggaaacgttcatgaagtcatagtgacactttggtttactaggagtgtcttttggatcaaaaagttcctccagggtgccatggaagtttctgtttctctgtagctaatgtttgctatcaccagagactgtgttggagtacagccaaccaaatggaattggctagtaaaagcttttgtgggtgagcatttggaaacaagcttcatgaccatttgctagcaaaacctcagcaggaggaattttaaccaacctaagttaatgtaaaagtttgatttgaaagggtctggaggggcaggggaaataaaatacttaatgaagtatgtaacatcccatattctttaatagtaaaaataaaagtgttaaagcaaactaaatatggcctgagagggaccctgtacttctatatttgaatccttgtggatgaattgtaacctagattaatagtcagacaaaattgaaaacctaacttaggagtatgagcctgtaacaataactgagtcttggccaatcacagtggccaaatttcagccactcatagactgctaagtgttcaaactgtgttcaaataaggtaaacaccaatctgtaaccaatccagctgtttctgtacctcactgccaatttctgtacatcacttcccttttttgtctataaatcttcttccatcacgtggctacactggagtctctgtgaatctgctgtgaatctaggggctgcccgaatcacgaattgttcattgctcaattaaactactttaaagttaatttggctgaagtttttattttatcaaaagttagcttttcttgttgcaaaactactcaccagctctttaggtagaaacagatgcttaggcagatagccagtctttgaaagggcgcaagctccaagcggcggcactggagtacagtaagattagatactgtgcaagaccgtcagtgagccccttggttccttcagtgtgattcaggagtggagtcacacaaggaaacttcaaaaccaaactaagtaaaaacacgatttccaaggaacataaactagaactttacaagatctaatgttacatgaaaaatgcacattactttgattcaagaatcagcaattactttatatttataaccttcaaattggttacaacgttcctttatcttattcagcattcttgctgaagatgagctttcccacatgaagtgcaattttgtcttcaacttttaattcctctggatacagaagaaaagctctgggcccttaattgagcaattattatttcttaagtgaacatagagtttgaggatggtgccaaaatcttcctttcatccagagaacaagtctaacataagcagcagcataagtgttgtctggcggcaccccagttttaggtacaagagccaagtcaagactgaaaggggaactcattcctcacctctactcactccctggcatctcctgaggttcttgaatgaatgccaattagggccgatttatatgtctccttggaggttttagataacttcactaagacctgtttgtttttctcatttagtctgtttctccagagtaggatttgccaacttgctgctgaatatgctgtttgcagttcattgctaggtttccatactaacataaagcattggtatttgaaaaattcattaagaagtagctcaccttaattcctagatctaaatctgtggcgtggttctatcaccttttctacaatgttgtctcagaatttaagaacggaaaataaagagttcatatgctaacatttcatggaatatgcctacacaaaggaattgctgcttcatggcttatgccattgtttaagctattctaattgttttcaagttttaaatacagagctggaatccaattctcaggaactcctaccatttgtcttagttttctaagacatttactgtctccattacataaagagaccttcaaatatttgaagataggttccatgcttcctttatatgtatatatatttttaattaaacttctcttattccttccgctactcctaaggttacagggcttccaaactgtatcattaatgagaagttagcttttcaataaccacattttgaatacagtctgctaatactgacctcaattatagttaaaaatatataagacctgcactttaaatataatcttttccaggtttgattagattttgattgctgtaattagccatctgtaatacataagacataatctagaatttgctctttacacatcagagtgataaatccagctatagaaagcatctttttggttgcctcttaatgaaaatattactagacactactaagtggtgattgaaaaaacatgctgaaatattactgtcagctactggagtaaaacttctcaccagagaactatcacaacttcaggataaaaatgattgctatctaaatacaaattttagcagccattaaaactgttagaaagagcttagatcactttgcttcttagagtttaaaaaatttttactatacagtatcaaattaaaatttagttactacttgcaaaattcaaaacatttatgaaagtataattaactaacattttaaatcagaattcaggacagtttgaatgttccttatatgtccacaaaagttttttctagtcttttaccaaatactaaagtgatgatttgtccaacaatgtagatgtttaatattcaccaaagtgtcatcaacaacttaatgcatcatgcttttccttctcattaaaactgctgtattactgaagcttgaccaaatttccttcatgcttggacatctgtttaagtataatattctacacttttcctcctctatcagattttgctttatctttattttccttccttctctgacctgtattcaagaaatagaaaatggctctttgatgtgccagttccaagtatgttcagataaaaggtaaataattcaatagacttgttgatgagaattgacatttgaacactggaggttgtttcctttactcatgcactctcttagtgaggataggggacccaaggtagggactggctggagtgagtttcaaattggtgaaaaacttctaaaaaaagaaatggtagagaaaagagcaaaaaaaattcttttttaaatcaatgaagtaggaaagtccaaacatatattcttatcaagtctcatacttggccaatagttataagcctctctgaaaacatttatatgtgtgggtggaggcaagttgcccattaaattgttagaggtgttatcagattcatcaggacttggttgtaaatttgactacacagtttggctcatagagaaatgaaaaggaaatatctgattaaagtgtgcatagctgctgaggcaactgaatgttgccatagcaattgagatgaaatgtgcaagaagtgagataattaaatctaacccctttagtagttttgatagtcaacgcactgccaatagaaaaagttatctacagtattaagataaaacacattcctcatggaatgtctccttactgtattttgtttcttttctaaatacattgcttttggtgtctaatttgaatgttctcttttaataatcaaatatagttttgaccttggtctgcctaaactttctgctggtttattatatcatggggatagacatctataaaaaatatcaatgttttcccctttagttcttaaaaaaagtatactaaagccaaagctgccacatttgagcttagaattcaataatatctagaacgtgctgccctcttcaggagctggtgcttaaaaatacttttttttttttttagcagattgatgagttataatatcaaaattgtattgataatctttagaaataaattccatgtaaaataaagtatttctgtgtttaaattttttttacattaagagcttgcattaaaaatcaatacatataacattttgaaaggaattattattatttacaattaaatacaaactaataatttccttaaactattgtcatagggagaattcctgaatcattacaaaatttgacttccatatttagtattcaaatttttaagagaaaaattgtctaaaaaagaaggtattttctatgtgaaaatctaagtaggacatccttcaaatcccagttttattcttcaacaacaaaaacaacaaaaaccaactttttaatttgggaacattaggatttatagtttgaaattttagctagttttcatttacagaaacaatatctttcttgggaataatgattccaaagatatcttaacacatcataatgtttattcaaaattacttcactagaaaaaatttctaaaggtctgaaatatcactattgagaaaattcaagcaaatctccttcatatatatctattaaaatttccttagccattatatagttttaacagagagatatgatctcagcgtatttttctccaaattaggtttattatactttaaaaaactgatcaatattaatagcattaattatcaggatgtgagaaaaccatattttcccttaaagagttttaggtaaacctgtctcatctctctcaataaaaacttcaaatgagctaaagggctgagtgaaaaaaaaatttattgacaatgttctcctaattctacaatatttcttttgtggaaaacaaaatagtttattcctgtatttgaaagtacttatcaaaacaagtgcttaatcttatggtagctctgttcatagtcatataatatatgttcaagaattcttagaacactgatttgtgttttctgcttagatttactttatttttgttttgctgctggtgtattacatttggcagttaggatccctgtggatggaggtataataaataataatattttctttactttccagggtatttatggcacaatgaaaaatttcatctttcccagaatggtaagtaaggagttctttctgtatttgatagtactgaacacgaacaagaaaaggtgaattattataataaaattggagtatcatctactaaatgtattgagtcatctgataattataatgtagtttatacttttgcaaataaatggatgctgtattcaaattctataattattccaaaatgttcaccaaatatactacaggatttttacaggaaatacaaggttttgctttctctgttggattgcagttgaacatagtatatccaacattttgttttctggggtaatttattttaaaatacacagatatagaaataaatgtggtttatattccacgagcagaaaaagaaagcattatctgtgatacaaattgagagttggtaagagtcctttggaattgttactgttacataaaaactgattgtaatttatgtttgaccggggctttgcagcatctgtgaattttaaaatatttattttctaaaagtatatatcataacttctaggcaagctagccactatatgattttggttaaacatatagtttcattgtctttatatttttatgacttaaacaggaaatatttagttttagtctttatcataacctctttacaattcaaatactaaaaattaatcttattatatgggaaaggtcagtgtaaaatgatatttcctaggaagttattactgtctcctatgatgctcttttatttttccagtggtttaagagtattccctataaaaagaaggaatttctcattgtagaaaaaaaagtcactttgacatcaaagtgttaggttaagtgaaaaagcagggtacagaactacatacattacatgttgtgtgcatgtgcgcttatatagacagaggagagagacttggcagtatatcttgggcttagaaaaaagacacaaaaggccaggcgcggtggctcatgcctgtaatcccagcactttgagaggccgaggcaggcagatcacgaggtcaggagatcaagaccatcctggctaacacggtgaaaccccgtctctactaaaaatacaaaaaattagctaggtgtggtggtgagcccctgtagtcccagctgctcaggaggctgaggcaggagaatggcgtgaacccaggaggtggagcttgcagtgggccgagtgccactgcactccagtctgggtgacagagccagactccgtctaaaaaaaaaaaaaaaaaaaaaggaaaaaagacacaaaaggtacacaaaagaatgggaatataagtagtttgtcttaattcttcattttttgcatttcctataataaatagatattgtttttataaccagaacaaaaacattatttgaataataagctattcaaaagagcatatttattattagataaatacgtacatataaaattgggaaatacttctttgtgccaactggataaccaattaaaaaaaaaatcttcagctgggcatggtagcacacgcctgtaatcccaacactttgagaggctgaggcaggagaatcacctaaggtcaggagtttgtaaccagcctggtcaacatggtgaaaccccatctctactaaaaatataaaaattagctagctgggtatggtggtgagtccctataatcccagctacttgggaggctgaggcaagacaatcgtttgaacccaggaggcggaggttgcagtgagccaagactgcaccattgcactccggtctcggtgacagagcaagattcagtctcaaaaaaaaaaaaagggccaggtgtggtggctcacgcctgtaatcccagcactttgggaggctgaggtgagcagatcacaagttcaggagttcgagaccagcctggccaatatggtgaaaccctttctctactaaaaatataaaaaataggggctaggcgcagtggcttacgcctgtgggagacggaggcgggcggattacctgaggtcaggagttcgagatcagcctggctaacatggtgaaaccccgtctctactaaatatacaaaattagctgggcgtggtggtgcacgcctgtaatcccagctactccagaggctgaggcagggggatcgcttgaacccaggaggcggatgttgcagtgagccaggatcgtgccactgcactccaacctgggcgacagtgagactctgtatcaaaaaaacaacaacaaaacaaaacacaaagaaacaaaaattagccaggcttggtggcacacgcctgtagtcccagctacttaggaggctgaggcagaagaatcacgtgaacccaagaggtggagattgcagtgagctgagattgcaccactgcactccagcttgggtgacagagcgagactctgtcaaaaaaaaaaaaaaaaaaagtagataactaggcaaatataaagaaattttatcaaaaaattgcttttaacctaaaataatgttaataaatcgtttattattaataataaatggcactattagaatatttttgatattaaaaattctgctcaagagcaatttattatagggcagaacttagcataaatgtataaattttagttatatcttactgtcttgacactttagctctctagaactaagccaaaaattttagaagaaatttaggaaaaaagtctctagcatgcatctaatactgttcacataaatgcttcccaagtttttctttccatcatattagttctcagtttacataaaattataacagaattgtttctctaattatgtagctataaactagaaggattactataaaacctaggagagactaggaggaatgcattgaggagttaaagagtattttcagctattcaccaacagtaagaattgagggaccaagattagctgtatgattttcagtaagatacatcatatacataggtttaaaattcctgagtggttaaagtagagggttatactataagatttttaaaataaaattttaaatttctttctagaccaagaattttacaataaaattacatatccttaaattgaatatacatagcataaaataacattgagagacttggagtcattagaatgaaaaagactgtaatgattaaaggggtaaatttcattcatttgtaaaattcacataagtgaaagtctcatccatatttcgttgaaagtcttttccaaattgtattgtgtaaataagggattatatattgtgtattttgataatattccttctatattactatttttaaatgtaccaaaaaatttaaccttaattttttcactttactctgaatgagataacattgtaaatgacctataagataaaatctagtatcaatctttcctaaagagcggggagccaaattcacacagatttgtatatggaaatttatatttctaataggtttagactgccaaattactaatttgttatactgggaaatcaaatgtttaaatatataatttccttttttgcatgtactcggtaaactctttagtccaacatatcatgacattttagaagaaaaatgaacaaaattaacctcttgtctataaccaaaatcaggggcaatgtaacaaattattgaataaataaaatactgctcattcaaactatttctttctgatttgtaagtgtgctaatttaaccaaacagacaaagttctgaatactatgtaaactaaattgaaatgcaaatatatattttattgatatgtattattaaagctgaacttcaaaacagaataaatcttcagcattccaattttttctaagatattgatgagaaaataaaataaatattttaatgtagttaatctgcccttcaacaaaatatatcctctcatttccaattctggttgtacttaatgaataaaggttgaatgcatatttatgttaatagtcatgatatatacacgtcaatgaacaacagtaaaacatactttatttctgaaaatgttaataatgatttattaccttatttcattaaggacaaaagctccacattatagtcagctatagccaatagtcattttgtcattaatcttaaaatttcacaagtttccaatttatcaagtgtcaatttttaggtcagacaataataatataaaagaattgttaattggccaacaggttgattacttttaagatgtgaaaaaagcaaagataaaaacagtcctctccttttccttcaattaaaattgcatgcaattattcttgtagattatagttctcttttgggatttccggtttcatacaactttttggttcatttcacaggaataatattcattttaatcagcaaaaaaacaattgatgagcttttttacaagagggagttcactctgagtgctgattactgccactacattatcctgtttttatttatttatttaatttttaatggtcttgcttttaaagcagttagttgaatatgttatctgttagtagccattgcctttgaagacagaatatctttcttgatgagtggttagcccattttgttttattctcccaactttcctaaacaatatcgtaagttggcttctgaaatgatttattgccattttatatcttcaaatatacaaatcaaaatattttaaaagtaaatagatatttttgatgtgttattgaattgtattacatagtttagaaggttaaactacttcctttacaattctaaaaaatatttagtagctaaaaaaataaaatttctaatacatatgtaagaaatacagggctgggcatggttgctcatgcctgtaatcccagcactttgggaggccgaagcgggcagatcacctgaggtcggaagttcaagaccagcctgaccaacataaagaaaccctgtttctactaaaaatacaaaatcagccgggcatggtggcacatgcctgtaatcccagctactcaggaggctgaggcacgagaatcacttgaacccaggaggcggagattgtggtgagcggagattgcaccattgcactccagcctgggcaacaagagcaaaactccgtctcaaaaaaaaaaaaaaaggaaaaaaaaaaaaaaagaaaaagaaatgcagatcgtgaatacccatgtaccaccaaccagtttaagaaaaacacattataatgccctttcaagctttcagtgtacccttctacggttctttaacccttctttaatccgagctaaacattatcctgaattttctctatcccttgcttttctttataattttacctcatatatttcatcctgaaatatataattgttgtttatgttttgcaacaatatgtaaatagaaagttgtatttatctatgactcttctactcaacattaagatcttgagtttcaacactttgaagcacatggctataattcattagtttacacttgtatagtattctattgtaagatttattagtcttcctttaacattaatgcatatttgggttgccttcagttttttgtttttttgtttttattattattattacacacagtgcttctatgaccagtcttgcaaatttataagtagatatgtgcaaaaatttatacagggcagtggttcttaacctgggatgattttgctccctagagaatacttggcaatatctgcaaacatttttacttgtcgtaactagaaagtgctactaaatgtccccagttaatgataaacatcctataaggcacaggatagccccacaaacaaagaattatctggcctaaaatgttaataggatgaggttaaaagatcagtctctagatgcctacttaaaaatgaaattgcggctggacatggtggctcacacttgtaatcttagcactttgggaggtcgaggcaggaggatcacttaaatccaggagttcgagatcagcctgggcaacatggtgaaaccccatctctatgaaaaatacaaaaatatgccaggcatggtggcaagtgcctgtagtcccagctacccgggaggctgaggtgagagggacaatggaggctgcagtgagctgtgatcataccacttaactttagcctggaggaagtgagatcctgtctcaaaaaaaaaaaaaagaaaaaaaaaaaagaaattgctgggtcatggagtatgaaaaatttcaaatttattagataattcacaactattgtacacagtaacaatgttacactcctactaggagtataaagataaatattatgatttctctatatcctagctagcacttaatattgtaagatacttaaatgtatttatttttattatttttagagacaagacctcactttgttgcccaggctggagtgcagtggtgccatcttggctcactacaaacttgaactcctgggctcaagtgatcctcctacctcagcttcctgagtaactacgactacagactcgtaccaccacaaccagttaattcttaaaattttttgtgtagacaggggtctcactatgttgccagggctggtcttgaactcctggcctcaagcggtactcccagctatcatctgctgaggttataggtgtgagctactgcacctagctagccagagtttttataaatttgtcaatgtgaaataaatactcctcaaagttttaattttcaatatttgattaccaatgagattgagcaccttttctcattttgctgacaatcagcatttcctgttctatgaagtacctctttttttttttttgagagaaggttcactgtattgcccaggctggagtgcagtggtacaatcacagctcacttcagcctcaatttccagggctcaagcaatcctctggcctcagcctcccaactggctgggattacaggtgcataccacatgcccagctaatttttaaattttttatgtagacagggtctcactatgttgttcaggctggtctcaaactccctagctcaagcaatcctcctgccttagcctctcaaagtgctggtattacaggtgtgagccatagcacccagccttctttttaaccaattttaaaaattaggccaggcgatgtagctcatgcctgtaatcccagcattttgggaggtcgaggcaggcagatcacttgaggtcaggagtttgagactagcctggccaacacggtgaaaccccgtctctactaaaaaaaaatacaaaaattagccgggcgcactggtgtgcacctgtaatcccaactacttgggaggctgaagcaggagaattacttgaacccaggaggcggaggttgctgagtagagatcgcggcactgcactgcagtctgggcgacagagtgagactccatctcaaaaaaaaaattgaattatcttctactaactgatttgtagataatatctgtactaatctactgttttttatttttgtaacaaatgtctctttctaatttgtgcattgttttttcatttctttaaggtgcccttttatgaacagagttcttaatcttaaagcagctaaacttcataaacttttcttttttgcttgtatcctgcatttcccactcaagaaagcattcccttatctgtgttttagcattttgcatttctacatttaagtatttaacctatttgacgttggtttttgtgtatgctgtgagtagtaatacattttaaaaacaagaaactatagtgttagtgtcatgtgttgaatagtttatatttccctactaatcttcaaagctagactttttatgaatcaagtttccaaatatataacctaatttgtggctccttgttttattctactggtcaatttgtctatccctttaccaatattatactgcctaaattattataattatataataatttaaaatatctaataagttctctcttgctcttcttcagcaataccttggctatcatggcctttttctcttctatacaaatcttggaagaagcttgtcactgcttctttctacactcacaaaacttgattgaaatttgttagtatgtacagatcaatctgaagggaaattacatctttcttaccacttttagtgtttcaatacaagcatatggtcaactcttccatttatttagattttcagtaatgtttttattttccttttcttttttttttctttttttgagatggagtcttgctctgtcatccaggctggagtgcaatggcacgatcttagctcactgcaacctccacccctcaggttcaagtgattctcctgcctcagcctcccaagtagctgggattacaggcagcaagctaatttttcatatttttagtagaggcggggtttcacaccatgttggccaggctggtcttgaactcctgacctcaggtggtccacctgcctcagcctcccaaagtgctgggattacaggcatgagccactgcacccagctttttttttttttttttttttttttttgagaccgagtctcactctatagcccaggctggagtacagtggcagaatttctgctcactgcaacctctgcctcccgggtttaagcgattctcctgcctcagcctcccaagtagctgggagtacaggcacctgccaccctacctggctaatttttgtatttttcatagagatggggcttcagcatattggccaggatggtcttgaactcctagccctgtaattcgcccgccttggcctctcaaagtgctgggattacaggcgtgagccaccacgcctggctgccttttttcaatgtttttcttttccttttaagacagagttttgctcttgttgcccaggctggagtccaatggcgcgatcttggctcactgcaacctccacctcctgggttcaagccattctcctgcctcaggctcccgagtagctgggattacaggcatgcaccatcacgcccagctaattttgtatttttggtagagatggggtttctccatgttggtcaggctggtctcaaactcctgacctcaggtgatccacccgcctcggcctcccaaaagtgctgggattacaggcgtgagccacagcgcccggccaataatgtttttcaaaaaggatttattcccccataaatttgttagatttactcttaaataccttttttacaaaatatttttaaattatatatgtgtagttatttatttttaaaaagaatttgtttccatacatagaagtacaattaatttttatatttttatttctatttgggaaacctaaactttcttattaattctcaaaacttacgtgtattttctcttggatttcctgtattaacaatttatttcattctagcctttatactttcatttttttcttacatactctagtaactagacctctagtccagtattgtatagagatgatgattatggaaaactttgtgttttcctgatttttaaaagaaagtagtttgaacagttcaccattaagttgttggttttttgtagatctcctttatcaagttaagggattcttcttttatttgtagtttgctttgagtttttatctttaataaatattgaattttatcaaatgttttccctacattgatttagaggataatataatttttctcacaaagaattgctgagcatcctctttcaccttaaagacatttactgaatggggtgaatctgaatttcagttttcatgtccctgctagcatagggggaaagtcacaaagcccagggcttagtgctggcatgcaaaatagatatatccttatcattaaccttatctacaaataaatgcatcgcatagaggagtgcaaggaaaattgcaagtcttacttcaatgtataactaaagaggaaaaaaaatctctcttgaaaattcatgatcataaaccaaccttactgtgttttcagcaagaattcacacactcttaatggtctaaagagtccaagataagaatctagttacactggtcctcatttgtgccttttgaatcaaaagaaaatccccctatgagagtgcaaccttatcctatccctctaagaattctcacagataaaattccaggagtatacgcccacagttagaaatcacaaacacactggaaaaaaaagggagggtaagtgagcaagaattagatgaaaaaagattaaatgcagaatcagactcataaaagacttcaaactttggaattctttcatcctttttttgcccttttgcttttttattctcaatctcttttgcatgtaaaactatattttaaaacattttatccttggctgggtgcggtggcttatgcctgtaatcccagcactttgggagggggagacaggcagatcacctgtggtcaggagtttgagaccagcttggccagcatggcgaaaccccgtctctactaaaaatacaaacattagctgggcatagtggcgggcacctgtaatcccagctacttgagaggctgaggcaggagaatcgcttgaacccgggaagcggaagttgcagtgagccgagatcgtgccactgcactccagcctgggctacagagccagactctatctcaaaaaaaaaaaaaaaaaaattatcctttagtgtttaatttcattgttaataacatgtaagcacttctttgtgataaagttagaaattaataatacagaaaagtttaacctgtaaactaaacctagttactgacatggattctaattatgacatttatgtaccaagctatacaagctttggtgaaaaaaaaatgtacaggctgggcaccacggctcacacctgtaatcccagcactgtgggaggccgaggcgggtagatcacctgaggtcaggagttcgagaccagcctggccaacatggtgaaaccttgtctctcctaaaaatacaaaaattagctggatgtggtggcaggcacctgtaatcccagctactcgagaggctgaggcaggagaatcacttgaacccgggaggcagaggttgcagtgagccgagactgcgctactgcattctagcccaggagacagagcgagactccatcccaaaaaaagagtagaaataagaatgagtccttttttgtttagcttaaacaaacaagtaaatattgtattaaagatagtaaaacatatgtttatagctattacatagctataaactttaatatttttgttttcaaactttaatatttttatagacagaaaccatttagcacaatactaaaaatgatacatattataaattattagaatatgttttatttgtgtagcacatttttgcccaaatctccaggactttcaactttatatttctgttttgaaatttttttagaaaggagttgtgttctcacttgatcccaagcccctgatggtgcttatagtgggcagtgggccaaagctgagctaattgtagtctgtccctataattttttaaactggaattgtggaacagacttttaggcaaagggagaatatatcaattgatgtatcccaagcaaggctgattctgagccttaattccagttattaaacttcctagggatccatgaaccagtaaattgcctgtgctgaaacttatttgagttgagtttctgtaacttgcagccaaaatggtcctgataactacacttacataaagaaaattaaattctgagatggtttcctacatgctgataatcatagaagacaatgaattaataatacctttaataccttttccaccaaatagaagggaattgggaagagtttctgggtgagttaatttgaagccttgccttgactagagtgtaccaccttcctctgttttattccagaggcaagtcgaaggaaaaaggattgcccacagttacttcttatggtaaggttaggaccaccagtattttgacaattaaggttctgtatctagagggattccattaggaagcccttcctggatataatattattttccaattactttcttcttgagcgttcacatgacctcaaaagcaatgaaagggactgacatttaggggtagaacataataattattgagcattttactctatgttaggtacctggttggtcgatttaaatttattttctagttaagtggtatgggctgaattgtgtcgtctcaaattcatgtgttgctgtcctaacacctagtacctcagagtgtgactgtatttggagacaaggtctttaaagagtacactaagattgaatgaggtcatcggggtggccccaatgccatatgactggtggccttataggaagggaagattaggacacggacacacacaaaggaacaacatgtgaacacatgggagatgatcgccatctacaagccaaggagagaggcctcagaagaaacaatcctgctgacaccttactcttggacttctagcttccaaaactgggggaaaattagtttctgttgtttaagtcgccctgtctgtggtatttgttatggcagccctagcaaatgactacattaagttatatgtattcaccttactcagtactagtcagtcatgaagggctggccaatctaaccctaaaatacatttcaaatgtctgctctcctctctcttccttccattactatcttagtttaggctttatttgttttacttgaaatattccaataaccttcagtttctcttcattctaataaaaccattcatactcatgatggcaaacacattagattgtgaggttgctgagagcaacatgtgctttgcactgtctacttaatccagatggagtccatggttcccaaacttgactgtgcatcagaattttgggtggcattttttaagttacagattttcaggctcctgaccatgtctattgaatcagaatctgtaggcatgtgggctaaaatattggtatttttaatatgttcacaagttgatcttatgagcagtatacatcgttgcttatttttgcccatctttttattaataatcatgtgacagtgtcttccaccattgttagctcagtgtttagtactatgtcattcattatcacagtagtttttggaataataaatttaattacacttttttgaagtaaaacagtgattcttttacattgattacatatttcaataattttcttgttgaagttatgtttatatataacatatatatatgttatgttatatgttatatcccatcttgtcagaagctataaaaatgtcacaagtatacttttatatgtataatagtaacaaaagatgacacctacccaatttgtttactataaaactgataagtaggtttcagcactaggatgtccccttcaatatgtccctaattaagtgaataaaatttggaaaaagctggcagaaacatttatttctcttgtagttgttttgtggcctaacactattcatatcgatataaattgtgtggtaagaccacaagtaaaagacaacatacagttcaccttggaaaaggaggaggtaatgtctgaaattttatctggtcccccatattataagctcaatttatgcttatcatttaataaaaattgaaaacttaatactctgaaaaaaaaacacactgcttttcttactttaaatataaaatgtctccaatgctgaagcagcgggtctttgtgtctactcatagagaggaaagcatgatcctagaaaagggtaacaaataatggcattcggtcctcccagataaactctgctgtagtctgtgctgtacttgaaatcaaaggcagatcttctgactatacttagacaacaaaaagaaaagttgctgaatatatctgccaaagtgattatttcaatacatatttgttttgaacctattataccaaacattatataatctggggagatcaaaagagacatgattcttgcatttgtggagcattcagcttgggtaatagaggtcctggtttaaaaaaaaaaaaaaaagtgtgatgtttacaggagcctaaaatggaggcaaagagacagagtgtgtgagaagaagtcatgcccaaatgacacttcctggagggaccagttactctgtgctcagatgtcaacagccaggagcactctgggacttgagcaagcaaataagcatgacatttcagttcagtctttactgtccatgcataccttgtaaaaaggttggtacagaaactaaatattatccttgggctacttctccttttctaaatgtatacattcatgtattcattcaacaagtattatattaaaagtttttctaaaataaggcctttttagctgattgaaaggcctcagtatgaagtgatatacgaactaactacctagtccttgggttacttttttctggtacctattttaaacattctggatctttcagattataatcttgaccacaagtaatgatttactatcagtgcttccaaatttgggttagcatcatcaggaatgggaagctcactacttcttctatcatgatattacctctgaaaaattctgactataagtggttgtgtttttaaatggaactgtgcctcagagtaccttaaagcatttttttttttttttgagatggagtctcactctgtcgcctaggctggagtgcagtggcacaatctctgctcactgcaacctctgcctctcgagttcaagcaattctcctgcctctgcctcccaagtagctgggactacaggcacgcaccaccacacccagctaatttttgtattttcagtagagatggggtttcaccatgttggccaggatggtctcaatctcttgacctcgtgatctgcccgcctcggcctcccaaagtgctgggattataggcatgagccaccacgcctggccagtaagatttttataaaattaaaataggcatagtaaagaggatttgggaaattgaagaaacagataaagaaaacattgccatattcccagtacccaagtacaaccactcttaacattgtaataaatatttctagtgtttttactatgtgttgctttgattctttgttagtttatataatttggtcatcacatgtaaacatgcacatacatatacatacacaatacaacttagatccctgctggtgggagaaatcttctatagaggataagttaacaggaactggagaaagattgacctgggctccaattcaagcattatcacttgctggtttttattgccttagacatatttcttatgtctctcagactcatttttcttatctataacattaaaataacctagaacctacttcttaggcttattgctagcagtaattaacgtaattaacactgtcgctagcacagtgtctagtaaataataaattcttaatgatgattaaattattatgcatactactctgatataatcatcaaatataaaaattttcaggctaaaaattcccaattctttcagctttctctcacatgaaatagttttaagtcctcttaccattcaggctgctgactcctaggagttctatattcttcccatctatatcttctgtaaaataatacttccagaactgagcatggtaatctaaacaatttgaaatagagttagattatattctccattattctatacacatcctaaatttattaatgcagcctaaatcacttcttcttttgtttgttgtttgcttttgtaattgtattataccactaattcactgccaagtaaagttcctcattttttcccccaggagtactgttgctaagtcacatatcccttaaactaaatttaggcagttagtgttttggtcccaaggcaagaccctacaattattccaaccaaaagatgtatttttagagtttgttcatctttttgttgttaaaacatttggctgggcatggtggctcacacctgtaatcccagcactttgggaggcagaggcaggtgaattgcctgactccaggagtttgagaccagcctgggcaacatggtgaaaacccatctctacaaaaaattagcccggtgtcatggcacatgcctgtagtcccagctacccaggaggctgaggtgagaggatcacctgagctcaggaggcataggctgcactgacctgtgatcatgccattgcactccagcctgggtgacaagtgagactctgtttcaacaaaattttaaaatggatatttggaccttgattttatcatctaatgtattttctcaccttccctagctcatgtaacctatgacctatttttaataggcatgccttctcatagctttatctcagtcactgatatgttcacattagacaaggccaaagacaaaggtctgtggtataccccttgaaaagccttcctccagactgacacagattcattaacattgccattgggtacaatcatcaatcagttatgaacacacataaaaatactatgcctaggtcaggcgcggtggctcacgcctgtaatcccagcactttgggaggctgggtcgggcgtattacgaggtcaagagatggagaccattttggctaacaccgtgaaaccctgtctctactaaaaatacaaaaaaaattagccaagcatggtggcgggcacttgtagtcccagctcctcggggaggctgagcaggagaatggcgtgaactcgggaggcggagcttgcagtgagcggagatcacgccactgcactccagcctgggcgacagagcgagactccgtctcaaaaaaaaaaaaaaaaaattactatccctaaacctgtatttctccatcttgttcacaaggacataaataaagtccttattaaatgctttgctagaatctagagatctgtatatctattgttctgatatactagctttactctgacagaaaagaacatctaagagtaggctgaacagcttactcttttggaatttagactttttcctaataaccaccttaaaaaatgttgatgacatcgtcttttataataaatattatataagctattccgcaccgctcactgccaccaagcaacatccatttcatggatcgaaagtttgcagactgacattttttgaacatacggcattcctctccaatgtctccctcctccccatttttcaaaggtaatcatttgaatatttcataatctcatttagaagttctccttgtaataattcatagcggtcaagagacgttttggcagctataccagtcaagtttccccagtagggcatacaggtgaagttttcatactttgtacctaagttcttgctgcaaatcttagctctacacgtttgtagttgtatgatcttgggcaacttattcaaccaaatagtaacatatgttttatagggctgctatgatgattaagtgaacaagtgcatataaatacttagtatatactttatatccttatttatcctcagtaaatgctatctacattataatccctttattttgtctttcaatttttagttaatgtccaatggtcttgacttcatttgtcacatatttattgagtagtacttggtacatacaaggccctagagataaagtagtgaacaaatcaaagtacctgcattcatggagcttacattccactacaggaaaaaaaacaaaaacgaagacactgaagtatgtaaaataatggcaatcagtgatgggaagaatgaaatgtctaaggggttcgagaagtctgagagaactcttagaaagggtggtcagggtcctctctgaagtggtgacatatgaccagagatatgactgaaccaacaggaagaaacataaaagaataaagatgctttgctttctctttttcatgaatgaattttatgtcttcaacttaaaaaaaatgagtccattcctttattgatcgccctcctcatttcatactaaggaaaagcattttcggttctctttagcatatttcacaagccatagctcattctgtgctttagtcttgctaaatttttataggtctattctaccttcatatatttatgcttgattatgtttccccttttactatcttttgcatatgctgttttaaattcagagcctgtcagtaagtccctgtgcagcacactggtttctttagtttcctccccattttcttgctcattagaatcatttgtgtttgcataggcagaacacagcttaaatcaaactctaagagcatatggttgcttttccccaaggttccaatcatttccattttacctaccggtttctgtcagaatgggtcctgagcaggagttccccttaatgcttactctgccttctgggaaatgaaattatcagcaaggccggtcaagaaattgtcactattttgctttctgaggtatgaaagtttctgcagatacttggagacttaaatccctaacactaagatatgttgcagctctgccaacacatctgaggtctgcactagaaaagcatcgtatctttccttctgaccagaaagtctgtagtgcagtcacatagcgctatcacttctgtgtttctcattttatgttcgtctagatttttatccagtgttcctccatctacaggttcttggatttacatgtacattcataacttctaaccagcaaggactatatacctgccttccaatcagcttgattgaattataattaaaataaattggattaaaaattaattgtttatatgaccaaattctatgcccagaaaaccagaacattccccttcagtttaatattaacaagcagcatgaaatagtagaaagctttgggatggaaggtggattctattcctgaccaagccatgtactagctgggagacttcctacaagctgcagattcatcatgtatcagaactgaaggacccttaatggtgaaaaatctggaccctctactcatctactgatgagcaaattgtggcctaaaaggttaaatgacttgcttaaagtgtcacagctagttggcaatagtatcatgactgcaagatagggttcttttccttaggtcagtaagtttcatcccaatatgttatcttccgttaatagcgcaaagatttacttctatgaaatggaataataatatctgccctttctaccttatagggttgttgtgagataatacgtatataataataatggttatgtaaggtggtattgtaatgattttaatgatttaatctgtaggtttcctggactttttccttctcatttaagtgatatgcatttgaaatattaatctgtgttgaaatgtgcttactttgttgtaggtttacaatgaattgcaggctatgtccccccacagaataaagagcttttggcatccctaagaccagggtggtaatccttgttctgttattcaagggatgcatgacaatacatcctcttaacctttctgattttagttttctcatttgttaaagggttaaatatttctatctcttacagttgtgagcattgatacagaaaagctaaatatcagtggctgtttttgttttacttatttatttattttctcttttcctcctccctctgtctatgagctgcttgatgccagacactatttatatttatttatctttgtattcctagagtctggcactcaatagctacacagtatgtttgttgaaggaattatttaccaaggtgaataacatggagtgggtctgagggtggcagcattttgtaggtcaatgttttcccatctctactcttaagactacaacattgagctttgtggaggtgctgcaggacctgccgtagtgacaagggtgtagctgaagtttaattctgccccctatcttgctttaatcagtgcagatatacttgttcctcattaatatgtagaactgtttttagaggaaaaggtttttcagctaaaaaaaaaggttgaaatgagatctgtagctaaacagaatctaggctttaaaaggagtttcaaaaatgcagctttaaatacttcttttactgttacgcaccttaagccaaccaacatctctacatcagaatttccttgttatcacaggactgatagcatttcaggttggttacagatgggaggaagatatcacatacacacctgcgatttcccagtgtatttagccaaggatatagaacttggatccaggtgaccatgggtatcagaagcaggtgcatgcagataaagcatatcttggcttgatttttcttttcctctggttcctctgggtcacacaattgccagggacactactgccagcattgaaagacacaattttaaaaactcaaacttgttactctggaagcatttatatttcacggcctaggcacttccatgcaaggaaatgtttgcacatataggctctcccacttgtagaaccaaattggcacaaagaagaaaacctcctgcaggcaggatggggaagagcagacaaagtcagagccatgggtccctaaatagtgtctctgcttccagctcccagtgttcccgtatttttgcaggtttgttttgaagattaaagcagggtaacactaaaatatttaataatgtgtaaatggttgggcttgggcaccaatagatcagaacagatgctggtcataaactaccagcaagccctgccagtgcctaccagccaaatgccagccttaaaataaagtaacattaaaatgtcctcacagtatctgatacataaatggtgcttgattaatgttcatcccctaccctgtttccttcttcttattgaattaaatccagtaaaaccaaaaaatggcaaactcaagagcacacatcttcaaataacctaagaagtcaatcgtattattttatcagtataatatattaatgagggggtaatttctaatgccagaattcattttttggtctacagtaaaatggatatactttaaaaaattaattataaactatttcctgcattagaacctagctgttaactagtaatagatgttagttacacccagtgagcctattctctgtctcttcaaagtttaccatttttcctgcaagaaagggttaattctctcaggtgctttgaagccgtgtttctctggagttgatagtggaaagggagaccactctatcacaaccacttgagtctttatctccacttccccaagacattccagagattttgatatcctccttcctgttaagaatctttgccagaatgagcattggaagtcggtgtagggtttcttaggtaagttagctttttataaaaagttcagctagcctttggagagttttactggttgggaaagcagagcttagaaggaaggacatctttgtagccaaagtgaaacaggactgtatctacctgagtatcaaagaagacagggcacagggaaggatcagagtagggaagggatggaaggacaagtaattggccggctttatcatttagtgagttctctctggcctcatcatcaggtgatgcttttgccatgcgttggaaatctgtaatagctcttctctttgtgtggctcttagaaagcttaaaggcaaattaagggcttatgtccagcatgcatataggcatactttgcctgtattcacctttcttgctatttatttatttattttgagacagagtctggctctgtcgcccaggctggagtgcagtggtgcgatctcagcgcattgcaacctccacctccccggttcaggcaattctcctgtctcagccttttgagtagctgggactacaggtgcacaccgccatgctggctaatttttttttttttgtattttagtagagacggggtttcaccgtgttgcccatgctggtctcgaactcctgaatttaggtaatccacccatctcggcctctctaactgctaggattacaggcgtgagccactatgcctggcctctttatttgctttttaattttcaatttttttattttttctttgcctctatcttcttcttatttttatctcttgttgtttgtaaatctccttaaatcccttttaaaatatgaaagaaaataaataagtaaataattaactctataaacataactaagagtgagcagatccttcaaaatgatcatttaaaacattagaaatacaaacaataatactagcatatgtacgatgataggacttttacgtagtcaatataaagctatatatttcaaaatgagcttacaaaattctttgctataatacaacacaggaagtaagatagaatattcaaaattgtttcatatgagcttatacaagtttaggtatttatataacagcattataaaagttgtcaactgtttcaggctattatactgttttatgctattaaagatactaaaataatagcaaatattggaagagttgttatgtgccaggtactatctgtattaattcatataaccctcacaacaacattataagacacaggtaatgatcattcccattttataaattagaaaaaagcagttaatttaaagttgagcttccataacatgcttaaaaatgcacagcttgaaaatgatgaagctgagatctgaacttgggtggtctcaatgaaattctaagcttttaagttatgttgcttttctaaaaataaaaaaaagcatcttaatattaacattaactagagttaagtgaccttacactttattttatgaggacttttcagatcttttcaacagatctttttcaaggtaatggagaagaaaacattaatctttaatatagcttttacttaaaaaagtagtatctgtgacttctttgaaagcatgtgtcaagtgttcagtagtggtgtttcaaaaacttttacagagcaaagtaatctcaaatggtatttaccatattcttgactgtagaattttaaataagaagtgaatataaaagattacagctatgaatagtactgattgtagccttggctaggtgcagtggctcatgcctgtaatcccagcactttgggaggccaaggtagatggatcacttgaggccaggagtttgagaccaatctggccaacatggtgaaaccctatctttactaaaaatgcaaaaattagcagggcatggtggtgtgtgcctgtaatcccagctattccggaggctgaggcacgagaatcacttgaacctgggaggtgcaggttttagtgagctgagatcatgccattgcactccagcctgggcgacagagtgagaccccgtctcaaaaaaaaaaaaaaaaaaattgcagcttcatgggatgcttactaagcatcaagaaaaaaattccgcttttcaatgtatgtgttttgttaagggtccaaaaatagtaaaaatgtttcattttttggtatggacacagattaagttaattggtgttaattatccaattttatgaattaactatatcttttatctttcaatttggcagaagtaaaaagggagagaagacaaaatttttgtaagctaaatactatgaatatgagaagcttagttttacttttttcattgagaagtgacttgcttagtgggggaaaaaaaagagaaaatttctattacgaaggggatccaatcatatttgccaacattagtttccaggttgtacagggaattatttgtgatgattttcatttaaatggagtctattccatcagttgacagatatttgttttactaaagttttaatagtaaagttgcatagataattatttaataaagtggtaggcaggagtttgtgtgccctaagacaaaattaagaaaattacagttgattcaaagacgtataaaactgttagaaaaaggagaggagtatttcaatgagactactacaatgtgcacagagggtcttttcagaaattatatattacttaggattttaagctaataataaagaatattatgcaaatgataaaatttatagaaagctttaaaactagcatgtttaggccaggtgtgatgacccacacctgtagtcccagcactttgcgaggctgaagtgggaggattgctcaaacccaagagttccagaccagcctgggcagcatagggagaccctgtctgtacaaaaaaattaaaaatcagctgggcatgatggtgcgcacctgtagtcctagctactcaggcagcgaaggcaggaggattgcttgagcccaggaattccagagggccttgagctatgatcatgctactgtattctagcctgagcgacaaagtgagaccccgtgtctaaaaaaacgacaacaaaaaatccttccaaaaccgaactagcatgtttaatatcaatgattctcatcttgtggagatgagaatttaaaatgagttataagctgcatgtagtggctcacacctgtaattccagtgatttggaggccgaggcaggaggatcacttgagcccaggagtttgcaaccagcctggacaaaatagagagactctgtctctacagaaaaaaaaaaattggtgggtgtgctggtgcatccctgtagtcccagctacttggaggctaaggtagggggactgcttgagcctgggaggtggaggctgcagtgagccatgatagccccattgcactccagcctgagagactgagggagacttcatctccaaaaaataaaataaaattaaataaagagttatattccataggaaaatgtgttggcctataatcatgctaaaaatttgtatatgaagatagaaaatacaaaagaaaattaggaataatgataatatactaataacactcaccaataagaaatatagcataaaatttggcataataaaaagtattcttaatttagccaggtacaatggctcacgccaataatcctagcactttgggaggctgacacgggtggatcacttgaggccgggaatttgagaccaccctggacaacatggtaaaaccttgtctctactaaaaacacaaaaaatagctgagttgtggtgcacacctataatcccagctagtcatgaggctgaggcatgaaaatcacttgaacctgagaggcagaggttgcagtgagccaagatcgtgccactgcactccagcctgggtgacagagtgagactatgtctcaataaatgtaaataaataaataaaaataaaatttagaaattcttaaactctggaagtcattccaatttgaagcaaatattcttctttgaaaagtataatcttaaggaagaattttttaaacatatctggggccatcaactacttctggtaacttttagtgaaggcttagcttgtttgccttaaaacattttgtgtttggcggtttctgctatattgtgtttttatttaactacatctattaaactgtatattaattcagaaaagattgtttacttccatttgtttgattgaaaaagtctgtgatatggtttggctctgtgtccctacccaaatctcatcttgaattgtactcccataattcccacgtgttgtgggagggacccggtaggagataatctgaatcatggggatgggggtggtttcccctatactgttctcgtggtagtgaataagtctcatgagatctgatggttttaccaggggtttctgcttttgaatcttcctcattttttcttgccaccaccatgtaagaagtgcctttcacctcccgccatgattctgaagcctcccccgccatgtggaactgtaagtccaattaaacctcttttccttcccagtctcaggtatttctttatcaacagtgaaaacagactaatgcagtctgatttatttcatgtgtcatttcttggtgaagtatagttatgggatattaggtaatatgaaaataatcaaaatcattatttgtttctgtcaaggcacctttcatgtagggaaactaactgaacaagtcacataaaaatggctgggtgtggtggctcatgcctgtaatcccagcactttaggaggaggagggtggatcacctgaggtcaggagtttcagaccagcctggacagcatggtgaaaccctatctctaccgaaaatacaaaaattagccgggtgtggtggcacacgcttgtaatcccagctactcgggaagctgaggcaggagaattgcttgaacctgggaggcggaggttgcagtgagctggggtcgcaccactgcacttcagcctgggtgacagagcaagacacttgtctcaaaaaaaaaagaaaagtttaagataaaacatcaatagaagagtggtgggaagtggtgacaggtggggagaaaaaagaaaactggtgaaagtgaatatagagaatagactaagtcaatcagtacaaataaaggggcaatataatttcaatatgacctatgaagtaagaacacaaatgaggtaatacatatacaaccctttgaacaaagtaaagcactattactactattcaatatatttcttcatatgtatattgacagtataattcacacttttttcaacataaaaattattgagcaccagagctcaaacattaaaatgtttataggggccaggaagaaaaataatgggtgaaagatacagtcctcttgatctatcttctattttccagtttatagaaatgtgggtgatgatacatttcaatttcctttaatgccaccattaaaatagaacataaaacattacacaaatggagtgattcatggcacaagatactttgccttggttttgaggaggtaataagaaatgacagagaatacagggagtaagaaagggtgatagtttggatttttgtcccctccaaatctcatgttgaaatgtagtccccagcattagaggtggagcctggtgggaggtgtttgggtcatgggggaggatccctcatatatggcttggggtcctccccacagtagtgtgttcatgcaagatctggttgttgaaaagagtcagggacctctcccttctctctcttgctccctctctctccatgtgacaagtctgctccccctttgccttcaccataattgtaagcttcctgaggccctcagcagaaacagatgccagcatcaagcttcctgtacaatctgaagaaacatgagccaaataaacttcttttccctatgaattacctagtcttgggtattcctttataggaatgcaaaacagactaacacagaaggcacgtttagtttagaaggtaaagcctctcctcctggatgttgctatgagctaatatacaccaaatgctgccagatctttccattttttcttcagaagttggaaatccatatttttttttttgagatggagtcttactctgtcacccaggctggagtgcagtggcacgatatgggctcactgcaacctctgcctttcaggttcaagtgattctcctgcttcagcctcccgagtagctgggattacaggcatgtgccaccaagcccagctaattttcttgtatttttagtagagacgaggtttcactgtgttaaccaggatggtctcgatctcctgacctcgtgatccacccgccttggcctcccaaagtgctgggattacaggggtgagccactgcgcctggtctggaaatccataattttatggaaatctcctaatttttaagagttgacagatgatagattaaaaaatgaaacaaaaccaaggacagtgcgacccagtgtgtatggtgcaaacaaactacatttgtgggctagattttatacaggccacagcagtttgagacctctattttatgctttgctaagagctgggcatataaagtttagagagattctaaggagcttacagtcacatggggaagagaacaagtaaaccaacaaatacagtgatgtgtaataagttctatgataatcaatgtttgttttgatgatccttcaacactgaaaaattccatatcatctaagaaagataaaatgatgtttagtataattttcttagacagcaaaatactgtactaatacattttgaaaactttttttaaaagcaggaatgttgctgggagcagtagctcatgcctgtaatcccagcactttgggaggccgaggtgggcagatcacgaggtcaggagattgagaccatcctggccaacatggtgaaaccccatctctattaaatacacaaaaattagctgtgtgtggtggtgggcgcctgtaatcccaactactttggatgctgaggcaggagaactgcttgaacctgaaaggtggaggttgcagtgagcgcctggtgacagagcgagtctccgtctcaaaaaaaaaaaaaaaaaaaagaaatgtaaaacaggaatgtaaacaaaaagaaacagcatttcaggtgtcagcaaaaaatccaaacatctccttttttggacatttctattagtttactctttaagataatattaataaaaaaatttctggtgatctggcagggaaaaattggttaaaaaggctttttggttgttggaggtagtgttccaggctttgacaacttagtgagtcataagtgagctacgatagaaacatggtactttttagcataatgtataatttgtcgaagatgtttttcctttgaataaaaccaaaataccagggtgcaaaacataacccttgaaaagttgaatgtaagtcctgttgattccaatttctgaggttccctggacacatctttaactcatctaagttgttgggacaggaaaggtataagggagaagagtgttctagggaaaatgtgcttgacagccaacatttcagtttttctgaattcaataattcacatgcgttactttcctgctttccttgagatatttcccacctatctaatgcacgcacacacacacacatgaacacacacaaaaacacacactcaacaggatgattagtagtactagaaactcctttgacaatttgtctacatttttgtttctttttacttaaataacacacacacacaaacattgttattctggaaaatactcaaattttcattgtaattactaatttatgcaggcactaaaatttgtttacatatggcctacaaaaatatttcaattaattgacaaaacaaatttattgttatgtaaatttgtgtgtttatatgtggtgagtacatttatataagatttctaggttattcaacttgcaatatctatatcagcaaaagcagtgctgcagaatatggacaatatactgaactaaatattacaatggtattcatcattataggaatctaactctcatttattccagaaatactttccatcagccaactacagctagacactgaaaaggtcactgttcttcaaaaagcttctgagaataagtgaaatgtttcaaaattacttcagtatgattggtgcataccattctgaatagtataatacttcctatgccatacaaagttgggagccatttctagatacacaaatgtgagcaggcagcctaggcacatggtgaaaccctgtctctgccaaaaatacaaaaactaacccagcctggtggcacaggcctgtggtcccagcttctttgtggaggatggggtgggaggatcatttgagcccagggaggtggaggttatggtgagctgagatggcaacactgcattccagcctgggtgatgcagcaagaccctatctcaaaaaaaaaaaaaaaaaaaaaaaaaagaatgtgagcagggagggcagtgcttcctaagaggaagttctaagttctagaaaggagtttgaggggtcttttttctttttaattaaaatttaaaatttaaggcatcttttaaaaataggaacttttaaaagaccattatctccccaagagtcatgagctattttggtagaccagagactttacaaaattgtattagattgctgagagcttctcatacctgcctcccaaggtttgagtattgtgggtaattggtacaaaatggcacagtgttatagctgggtctgtggatggttggataaaagtgagaggactgaagaagttggaggctcaaagtttactgcatgccacaaaaacacattgagataccattatgtgtgaaattatgtcctctctagtaaattaatgccaaaggaaatctgttgataggaggggtaacaaaattgaaataaaatctgaatgaatccactcaaacctaatataatgggtcagtggaacagtggcacacaggaaaaaaaacgggatggaatttccaaaaaaagaaaaaaaaggagatgagcaggttaaaaaaaaatagatacatattacctattatgttctgtgtaggatatacttcagtgaaagctaattttcctgcaggtttaaaaataaaattgataacttgtcataaatttattctataacctcaccaaagttggaaaattattccttgttttcattatttttctgagtaaaagtgcattttcagagaaaaaggaacaagaataaaatgtatttgagagaaaattttgtgaagtaatagtctgtgaagaaatagtatatagttaaaatttcagaatgccatgcgtattaagcatagtctataaatccttatgtcctaattagttttgtgtattaacttataaatagttttgtatattcttgtttcctttccgtgcgtatttctcctttgtttccacagatgatttatttctctggggagggagtatgtttaccattctccagcagcacctagagcactgaattgaggaaagcaggttcctatgactgctgaataactgcctttattatccttacattttgaaaaatatgtcagcctacaatttcagtaaaaacgcaaaattaaaaatgaatatagaaaatcatgtgcaactttcccctgacattaaattatcctgttgtgccaaatgtagcacaaatggccttctaacaggggtcctatgcaaacagtgggtgatcacggaacacatcagcagcaacaccaagtcacactggtgatgtcaaggacaatgtattctgaattccattttgtatttcttatgtgatattgtgccagaacacaaatatatagatgcagacatatacatatacatgtgcatatatatattttttacagaatttaaataattcattcaaataaattatttaaatgatttaaaaattcctttgtcaaacagattaatggaaccttgttattcaaaagataaatcattttatatgaagtggcaaagacttcaagggctaataaaggttttatgagagataaacttttaatgaattaatactttctcatgtgcttattttctatatacataaacatatacacatatgcttatgatgatatttatatcaacatttcctgtctgatttttaaggaaacagtatttacaatatttaacataaagtgtttgtagagattttatttttagcagctgaagtataattcaccaaaggagaaagtttaaataatggtgctgtaaatgttattatttgtgtaataagataaaacagaccatttttaaaatttgtaatttatatgaatctagtaatcattagtcctgaacaattttactcaggtcattctctaggcttaaaatttattctgcactcaagtctttttgctacataggtcttaatcagaagatgttttgctctagaaaatgatggtgaactagtatttatataacaagaccttacgaccctgggaaaaattttaaggatttttataaggctcagtacacattcttcagcgaaattttggcatagtttcaattttagactccactgaaattcaattggtttattttataattaaaaacaagaaaatcatagtaacaaaaatatataatgtatagcactcttgtttataatagaaacatccaagaaacatgctctaacttttctcattaccccaaagggaattgcatctttaatcacacatagcacaactgctttctaattttgtttaaagtatttcagtacttacaaaaaccagatcaggttattgtaaatctagagcaaattagaatcattggcctctgcttagctctatgcaagagttctatgtaaatcataaatttaatggcatattaagacacacatctgtttcagttttgtagaagttaataatctaacttcagagtatttaaacacttctttcactaactgaaaaattcaggcaaagacagacttccctcagtatataaggtacaatattttacttccaaattttgataagctgtaaatattcttaaggaaagacagttttctaaatattcaatctagtatctatttttgaccttacatgatttcctcctgtacggaaatagtcaatataagcaaataggcgagcattatcatctcaaatctacacctgcataaaatattttgatttatacatatatcaagtttaaaatcgttttgcaacagggcattggagagaaagtaaatattgaataattatatgaaaatgtcaaaattcattcttttaaatatttttcagattctttatttgattacccacaaatttatttttaaatgataaatgatagtcttcttgggattcagattatttgaaaataattcacattcttgggttcctcaaacatttacatttcatagccagcatttttactctgcttttctctaattttattttaacaaactataaaaattgtttttatgttatatccattacctcttaccttgacacgtctcctcatatatagcagtaacccagtattataatgaattattgtgtttcagttgtcattagataataaataagaaattagcttttcttgctgtggattctacattgtttgaacaattaaaaatatatagtttgaattgggctactaattagggtagtaaggatattgtactaattaagttgccgtcattttcgggacaactaaagttgcccccataatgaagggggcactcttaatgcactaataatcctcgttagttatattgtagataggtgattttggtaaccaggacaaatgactaagagtgtggatggtccagtgaaacacatttccatcactaaaataaaaccattcgaagaatatattatccaggtgatggtttagcaacttctttttaatgtacaataactggacaggttatttatgtgtttgtatttctaacctaaaacaaatttttccccaaatttttcattaaatattacttaacaaaaccttatcattactgaatcctttcagtgctcctttgagatatgaatgacattttaatatgattctaaatttggatgctaatttgaaagaaaactgattcttttctatcacaaaagcatatgcctattacatcattgtttggtctaggatctaagtgattgatttcatactgaccttaagaatgcattgtaaagagtttcaataagttgaaacctgaatgatactattcttttattaagaaactatgttgatgggaattaggtttataacacattattttacattgcaaactgctgttctactttccagatgctcagacatatttatttttattaaaatgtgcatgacaaataaaggcctttaaaaaataaagcagcaaagtggagtaaaagatcatagttatattgattagagaataaaatcatgaaaaacattagtaagagttaatttatagatcagaaggatcaaccaaagtcaaagtcaaacatctcatgttatacaatgttatgctataaaagattttcagaaatgaaacaggtccaggagcgatggtccgtggctgtaatctcagaactttgggaggactgcttgaactgaggcgttcaagaccagcctgggcaacatagggagaccccgtctctagaaaaaataaaaaaaattagccaggtgtggtgacactcatttgtggtcacagctacttgggagactgaggtgggaagattgcttgagcccagaaggtcaatgctgcagtgagccatgattgtgctactacactccagcccaagctggagtgagacactgtctcaaaataaatatataaataaaataaaaatacataaataagtttttttgtgtttaaaaaatactaagggatcatagagtataattactttatgctgtataattatgaaaactttaatgtatgaaaacattataagtgttatacacacttgaaacaatatggaaacattataagtgttatataattgtatatttgactcactttctaaaatgcagagaggttgtatgtgagtttgcttcctgactcttaaaagcctttgcaagttttgccatactacagtgaactatgacatgaataatcaaagtcatattcgagaggcactaaaaattcaatttggactattctgtgacattgctacttggttatctttaaggatttagatttgatagagttacttctactgttaaccatctctttgcttttgttctgcacctaagcaatacatgatactttatcaagaactgcccattcaaagagttgtaattttagattattcttagtttaccttcaacaattttaaagaaagtttaaataaatttaattcatcgttgacagtggtggaggtttgtgtgcactaaaaggggatcaggaggtattttatttttgttttgttttgttttgttttttgagacggagtctcactctgttgcccagtgccctggctggagtgcagtggcactatctcggctcactgcaacctctgacccccaggttcaagcaattctcctgcctcagcctcccgagtagatgggattataggcgcctgccaccgtgcccagctaatttttgtatttttggtagagacggggtttcactatcttggccaggatggtcttgaactcctgaccttgggatccacctgccttagcctcccaaagtgctgggattacaggcgtgagccaccacacactgcaggaggtgtttttttaaaccacgtactgttaatgagaaaacaaggttatgagtatttatgatggacaaaattactagaagttatagacagctttgtataaaattagtgttcttttgcttacactttgtgatctgacagaagcattgataaaagacctataagacccaactatataaaattctcaagatgcagagattaatgagagttataggaacaatctatgggaaagaaaaactttgagttgtttaagactcagtggaacaataattatgaagaatatcgttttaaatttgcttacttttgagtatcataatggtaacgacataaaaatttcctaaatctttatatacaattatgcatatattaattaacacgtgtggtgcacagaaaaagtcatgttaccagttgaactagtggatgctttttttaaaaagtattaattaccaaatgacagctattaataattcgtgattatatacttctaaattataccattaaacacaatatgccttaattatatttacattatactttaaactgtcattacttttggagactgcatctctacattttggatagggtttggccttcttggacaaaatttgctaagcctatagagcagggagaatagctaaaaccttactggctttgccaaatgctttcatatgtttttgctcttacggaaaatgagttttgatttcttttcagcctacatgcatggcaaggcaaaaattgaaaacaaagctagcaactttcaacaagttctagttaagtttggcattcatatattgctctgatctgctctagagctttaatgtagtttattttctagagtaggaaaaactagtttcagcaccaagcatcatcaacaagtaatgatgaagaaaatggaactgagttaggtttaggatataatctagctaattttatttctatttctgaattagaaatgagagtcattccacgtgttttttgtttcttttgaaacaattttgaaacaattttcttttgaaaacaaattttgtttcttttgaaacaaaattagagtttcacaaactctaatcacaggcaaaaatacactccccataatagatacaaccgtccctccttaatagttttctataactgtgttgctcaaacttaatggcagtttttggcctactctcaagcctcaatacctcttcccttcaacccctgacccttttagaagtgtcttagctatagccattggccagagtagggcagtgaaagtgatactgtgttctattggcttacactaatcacaatattctgcacctatgtccattttcatactatttcagattctttgttactcaaactgctgttattcttatgtatattttaacaagtgcctgatcacttccctataaacaaagatacttagatgataaatctcagtttaaaaattagcataacgtctgtaccagaaatatatgaacccactgaataaaataatcttcagtttcttaaggttactaaaattaaaaacatgagtttctacagttggaaaaaacatgtatggttaaaatgtttgaagcccatcaatctctctaaccacataagctaatgagttccttctgttttctttgaatgaaatcaccatgagtggttatatgttgatttaacataaaacaaatggaaatgggtgtttcctttgtcctttgtagaatttattttaaaaaacaattagcaactattatgaataagtcaatgattttgccattacttaaataacaatatagattgagtaattaaattgattggattgcagggaatgcgtaacatactccaactctccttaacttgcacacatctgtagatattattaagcttctcatttcatttttttctaccataacacctgtattgttataaattatgttatgaattgtcagagagtgccaggtaaattatgttttttgaatgtagatatactctatggtgtgtgccttttaagtgttcctttgtaatggcaggtttgtggctaacagcttaatcttgaatctagcaatataattaaacactatttcaattcttctttgtggatatacaaagaaggttgaagtattacctctaaagaataaagaaataattaaaaatctttaatatttaaaacattgtcttacacaagcagtattcttaaatgtaattttaaaacatagcaagtctattatatttttaggagaaaagtgtggaactctttgaactctatagaatacacatcctattgaaataagatttgaaacttctatggggcatttttctagtttgtataattttaattcacttttgataaattcttcccccttccaagcatcctccttttttgtgatattgtctctttaagaatacagtgaagagtgattcacttatgtcctgagcatcaaagaatgtcaaatatatcatgcagatagataatgggtttttccagagattatttctgagagagttaaataaataagtaaatgagccaacatatggccagcttaattcaggcaaaaatgtctattgattacttactaagctcactaaataaaaacttcagcctaagttttgcttcccaaaagaaaataggattagactgatgcatgcactcattggggcttttgtgaatggtgcccagatgagtgaaaaccttcaaagatgaacaaagaagggctaaaatattttggtaaatgcaagttactatcagtttgacttattctcttttgcaatcctgaatgaaataattttatattcctaagaagatcataaaattacctctgaggtctgagaattagataattctgccttcttttcaacgacttgaagtagcctgatttaattttgctaggtagatctgttgtatgtatgtattttgacatatgtaaaaacttaggtacgttataaggttttgcaccagctctgcataagtgtactttatccagactagtttatatcctgcgtggttaatatttgaattatgttatgtaagaaattccagatgtaagtgtgtatgtagtttaaagcaccaatgctctaagttgctccttttatcttttgaaatagtgagaatattaaaacatcaatacatcaggtagaagaaattagattatcaaaggttcttttttaatctgagaattacaatgaaaccaccaaaagaacatgttctagttatttggacacacgtacatttaacctatgatttcctacaagtcaagaacaaacttgaccagtagttggattggatttactttagtactacacctatctggctttctgacaaaatactgataggtatttaggatcttcatgtattttgaacaatctgctgttgacatattaataacattgtttggaatgattcctgaagtatgatgcttgcaacattcctgcagcaccaaaaagtacctattgtttctgaaagcaaagcagcttaagttttatcctactttctaggttttaaatattggagaatcatttttttcttgaaaaaaaggtaaatatgcttatttaattgatggctgcattcattagtagaatcagtggtttacaaatacatctgaaaacatagctgcttccagctcagaaattttgcaataaaaaaaaaatccatgtttgaattttgtggcatgcacaggacacttaactggcttttaaacgtttttccagcgtgattcgccctgtcctgctctgttcctttcagcttaggtccatcgtaggctctgcctggctgtttgctgacattgccaaccgagaggggcaaggaagtgtgttcagaggacaagagcaaaggcagtttcaatgtaaggaaatgagggaaacagacctaacagctctgtgactatacttgagagtaaagagccttgtagtctcctttccttcctttgcttatcctggtgagtttaatcaaaaacaaacaaaacgctcttgtgaaatatagtcaataaagtcaaagtttagctggctctacgtaactacaaagaaaaaaatcatcgcaatttaaaaaaatgtaactttcattaacgagcgcgccggaaatctcaggtatcaaagacgcattaaccctggagcgtcccccgcgcgccgcagccggacggaggcagccgcggcgaacagacgttctttctcctccatgcagttacacaaaaggagggctacggaaactaaaagtttcggggcctctggctcggtgcgtggagaaaagagaaaacctggagacggggtgggtgaaagacgcatcccgggcgcctctccgaagtccaggccgggagcaagctcctgggcctagaggggagggggccccgagccgctggtcatccccctgcgctcagcctcggagcgccgcgcttcgcggcgctctcccaaatactcttcacccactccagaaataaaataaatgtttttaaagtgcatgtgtgtggacaggatggagagcgcgcgccggcggagcgcgcggaggacccagcgcgcagtgagtggagtttgggggtgggctaggggttagcggttgaatgggtgtgttaatggggggagctggaggcagagctcggggacctgggggtagggggagcgcgaaccgactgggaggggagagaaggggaggggcgcgagctggcgcaggccgcctccggggcgcgttccacggccgtgcgcgcgcgtccctcgccgccaccgccgcccggacagccctgcggccgccccgccggcggagccggggccggcctggtcctcgggcggctgcttggccaccgccaccgccgtccgaagggctcgagcccgtaagtatcccctttcgctcctcctccccgccgcttgggcgcacagccgcagcagctgctcaaatggagtggaaaacggccattgggcgacaatgagttatagattatctgctccacgttttgtacttagctgcctgtaatcttcttttgagtttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccggggccaccccagcgtcccgcccgctttgccctccggtcccgcactgtaagtggagcggggaggctgagcggctggagcgagttcgggggaagtggacggtgggggagggcttggacgagtttttgagggttgctgttccttctcgtcagtggttaggtggtgtggggaggcgaggatgacagtaaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgttttattagtaaaatgaaaaggccacttaattagtttttaattagtctctaaaacaatagaaattttgtgattaaaagactcatttgtacacgtaggtaactgttttttatgtgctaaataaatagggaaaaagtcagcggaggatgctgaaaattaaaacctcaaatgaacttgacacaacttctgttgcaaaaagaagcttggaaaagttttttttaagtgaagattcaaatttttgtgaattctatttaaatagataattctgtttaaatattgttttgtttcaaaatttttgtatcttgtcaaacagtaaactctagtattcagttggtttattttaaaaaatatagtttatttgttcttgcttttttatgtttacagagagaacatatctttgaatttcttttaacaattcaatatccatgaatgaaaaaaagaacaagtgcttgggtcatttgggttagttatcaagtgcagatgggtcaagggggaacttttatcttcaatttcttgggaagaattagttttatttatttgacttaagaatttacaaaacttaattctaagatggaaatgaatttcaggggagacttttttggagatgtaagctcatattttttatagttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggttaaaaaaaaaaaaaaaggccacattgatgtaattgctattattgcacttaagttgctgttaactagtctgctttgaatgcagagtgttataaagaaaacaacattatcctttacagctattagtgataatctaaaaattgtcttgaaaacattgctcttcactttatgtgagggtgatcttgaattcagtaaatctctaaaggtgcaaaatgtagtgaaaagaagatttttcaacatttagatgacaaaattggactacttagggaaaaattaatgtgttgtagaagaacttcagctgccattttcaatcactgggttactatgtgttggcaacagaaaacgaatttagaaatggagatagctctgggagcaggtagttggggaaatcagaatattgaatcatgtggggtagaacaaaccaattacttcaagttttgacttgagaatttccaataagtataattttttccaggcttttgactgtctgctttattaatggactaacatcaaagcaggcaacaaaacttccaaatgttataaaaactaatgtaaatatacagatctcacatgcagtaatacaagtctaaatttaagacaaacagttggggtttttactgctgcaattttcacaatcagcagaaacattaacaccaggcttctgggtgtttccttttttgaaatgagctagaagagagctttaaaactaaggtttacttagggttaatctttatttgatcattattgaagctttctgtgtttcattaaatttaaaatagcgttttagtatcttaatataagaatatgtgaattgagattgagatgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaaattcagacacagggattacaccttaatctttgaatttcagtgttgaaattagttatcttaaaagaagcctatttaaggctaaaaagtctttggaggactttttttgcggtagatttagtactttaataaaaacagaaatatattgttaaaaattgggtaggttaggcagatgttaacttcctgaaatatgtgaccaagtcttaattctgttttaaaatgcattaagtaacatttatatatatttttaaatctgataaaaaaagagatggagataaaaatgaactattagttcttggctatgagagatgggagaagttgaaaagatggttaactttagacttagcatcaattcaagcacatgttaatttgttagaacaaaaccagatacaatcctgtctttttttctgaatgaataagaaaaatcttcagccatcatactagcgaagaaggatgcaccatgaggttcctaataaaaatgggcttaattttgctattttcaattgttaggtagtacttgttaacccctttcttggtcacacatatgtacatacataaacacacattttatagtctgtttctctgtatatatcaatacttgttgtttattgttggctaaaaattaggaagttcaaaatgtaaaatatgtatgattaagatatctcttttaaaactgattttgaaaatggtatgacataaatatctgttttgctgtcaaatatatctatatctcctgcctgtggactgagaaatgcttgtactatccacactttgcctccttttataggtatttttacatcagtccacacctcaagctagttattactctggatttagatgacagcataatctaacctcaattactgtcaaaaatggcacttgactgctgggggtgggttaggtgaccttgttttgactaatgctttctcttgaagatgatagtaaatagtgtctatttatagagcgaacaaaagagaattctgttttcttcataaagtaagttctaattctaatcatttattcttaacattgtaagtactatgacagcagttctccatataatgggcaaaccattacaagattttagataaaatttttagttgatacaatatttctgttttatgcagactacgtttacttaatcagttttcagcttcaatttacataacaaataatcatgtttaaaatgagtttccctgtgtctttactttgaagcaaagtatttctatgtggaattattactcctttattaaactggttaccatccatacggaaattttctctgcattaaaagcctaccattttatagtgtttgctactgtggttattgattagaaattacagaacacatttcttatgtaccattttctccactcatctttgtgttcttaatgtcaggatgcttatggcgtattttagttcttacaattcctgactttcctatggttaaaatctaagacattttgggaaacattaattttgataatattctatgcttatgtatttttgtcctagtaattgtacatttttttttagtttgatgaaggcttaatgtattaaatgacagaagatatactgaagattcgtgtactgaaaataatacatctctccaatattaaagagatgagcataattctaaaacacgtcactttgcctcatatgcgtcgacaaataaaaattacactaaaattataatgtcctagacatgttcacttttactaaggacatataacttttttgcgcttttcagagttctctctgtcacaaagaagacaatgtttgaatattaggtgcttcctcttgatagctcaatagatgaataaataggaatgttctcccactttgctttttctactacaagtgctatgatacccatagcctgcacggaaatgacttttcatattgttacgggttttaaactagatctacagcctgaatatctaaaaatgtacatgaaacaaaatttgattactttttcttaagcagaaaaccccacaaaaaacactgctgatttgctgttgctgttcctcttacctcatttgtttcattgggaaaagatataactgatacctcagtatgatatttctgtatgttttagcatatcttataattttcctttgttcaataagaaccttagttttaaaaagtcacttcttataagcctgtcagttcatttctaggtaagtcaaactggctttgcctcagatttccagtcagtatttacatgttatcaaggtgatatgtttatgttggaaccgagacattttaagggagagaggggcatcagcgttctgcagcaacacgttttttataacacgttgcccccgagacttagaaactgttcttaactttctgttttttgctcccttggcagagatacatcacatcatatctctgtatacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgaccactaaacatatcaaagtgtattacattcctctacatttaattaatagaccagattagatgagttgcatatgtgcttttctaaacagaaaaacgatcgctttggcttaatgacttttacttgcaataatggacatgagttcaatgacattaaaacacgggaactactaataaggacctactattacatgatttagaaaactgctgactaacttgggaaaaaaatgaatgcaggcagaatagacagtacttgattgaaacctgaattctgtttatgactctgtgccagctgaatttctaaggaattgtaagccagatacttagggaagtacttgagagtttttcattcgggtgtttaggtaagcaggatgataagcttttagaggcatttggatattttttagtgagtagaatttttcatatttcctgcatacacttatttgtgccaggaaatttaatgataggatattatattacattttattaaaaaatcaattccagtcttttcatttttccattttggtatagtaacattattttagaatttgcttgttggttggtaaaaaatagaaaggttattatccattatgtatctttggaaagagatgtaatagttcatttctcttattttatcaagtaataatatgacaaaaatatttattttgcattttaaaaagcttcgtttcttaatgaaattccttgtttcagatttattattttagtagctaatctttactaatgtgaaaagtcacattgttactgtgacaaagaataatcctctaagtaaggaaacttgtttaataaagagatttgtggtactggtatgggcttttttataagtagtattctctcagcgtggccccgtattatcttaacaagtgtgtgccacatttatacagagcatttttataatggggtaagaatattagcaacagcaattatatttcaataggattaagatggtatgttttacaaaagtatacaaatgcttcttttccatacaattattggtagatactctttactgccaaatttatgtcattgtcttaaataatataaaaagatatttcttatcgtagctggtttttaatataataggcactgcaaaatgggatctgatgttatagttcattaccttttttccccctaatactaaaacctccttcacagtgaggtaagggttactggagatttcattccaggaaaatggttatgtgaggcacagtaactgtcatagagtgcataacttctgtgaggttactggaaaggcacagctagggtaagttctacctgttttgtcttaaatttgaaggtagactactgagcgatttttaaaatactgaaatctgaatccattgaaaagaaattgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaaactattttttttgagatacatgtttaagaagggaaaaaacccatttgttaaaattacttaatcactgagtttttatgtcatggtttagaaaatttattaatttttagtgctctttaaatcagattgttggtttaaaagatactgttattttgaccaaatataagtcaaagcggaaaggtagttgttaatactcgtgtcagaggccttaactaaaaagttagctatgttcaaggaaaagacttagtccaacattttactatttgacagagcatcatgctgtgttatctcttagtagtagttagtggcccacagtagctttggctaatgcaaaaatacctgtacttttgaaagtatttgaatttcacctcgagaaaatctttgtttcatctcgttgctctgtaggattcagataacagctacaacacagtaaggtattcaagaatacattccaaaagcacttttctatcattgtattctctgtaagaattagggttgattctcatcagagtctttattagtattattactgcttaaaatattttatagaattatggtgacagtttgtacaaatagggtgacatagaattataatgaacttgatagtcaaacataacctttacctactttaatactgtagttactccctcatacctcatgtgttttattttttactaattttcttatattgtgttactaataagaagtacctaagtcctctgacatttcagcttggaaacctgtcattggtttcttaaaattagaatagatttaaaacaatgattatttaggttaatattacatgattaaaacatccgataacgaagcataagtatcttagaattcacattttctggagttgcatttcttaaaaacatttgggattgatttttaataagtttaagagtatttctaaaaaaaaattagggagtaagaatgagctcttagaacaatactaaattgaatagcttgtagtgcaagcatcacttaagtatttttagaatattgaaaatcttgtagattacatacactaatggcctcattctccttattgcttgttaattctgtgaaaatcaagaggagcatatcaaggttgcagttaattcaccataatattagcttttaattgaaaataaacgaaaatatagctttgatttgttagcttattttattcaagtcagtttttcctatttataaagaataaatcaccataaactcttatgtatgtataaaattgatgttatcagatgtttatacaattgatgatattactagacatttttgcactattcttaagaatactttttattttgtatattgctttaatacttttaatatttcctcttatagaatgttttcttcagatgttttaatagtttgatattactcatttctgaatggatggttgagggcctttttcttttttaaaaaacatttttcactacttgccatgcaaactatttgatctcctaaagagaaccaggatataaatttagtaattagtatcaatgtataggtttttttatttaatgtggaattattatatggtgatgttctttggagtgttttcatgtgacttaatgtgtatttaagccctccatagttaaaaagatgtttacagtactttcatgtttggcattattcaactctttccaaagattcttttaatattttgtctgattatcatttattttaacctacaaatgctctttttatgcttgcctacttttattcaacctacaaaataaaactttattacatgtactttaccaagtccttaataagcttcagtattcagtattgccaagcacttattaaagcttcaacattttcttcctttattttgttaatggtatctcatgaatgttgaattcttagttttttggggctttttttttttcaagtatatttagggggtacaagcacagcctttttacatgcatgtactttatagtagtgtacccatcatccacataataaatgaacgttataccctctaagtaattttcacccctcacacttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataatacacatttttttaaaaaattgaagatcgttctcaattcttagtataaaaatcagaaatttgtctgggtctttaaaaatatagtacaaatatctaataatgtatttggttgtttagctgaaaggcagatgtttcagtctttggaattcaagactatattaatctaatactccttaaaccaacattttatttatagggtgtaataaaaatcataaagttaaatttgaatgagtaaaatcttgattttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagtccttggtgagaggcaatggcagtagacagatatgagaagttttgtaatggtgggttagaatttggcatttgattgaatgcgaggtaaaggaggagcaaagaatcaaagcccagaaccaaggttccagccaagtcttttatgtattccattagcctgctttagtggaagggagaaggaatgagcccattttctgatgatactttgagatgcatgtgttaaaagtccaaagtaccagctgctgagaaggttgatgctttgttggtatgtatatttttaaatgtggtatttgtaaaaaaaatatattttttcttccttttaaatgtttttaaatgttttcgagtgtatacctgcatatgtttttacactgcatatgtttaagtgatactaattttttttaaatactcacataaagtgaaaatttttattatgcgatattcaggctacatgatctaggtttttatttgtattttagatgagatttctagtaggtaatcaagactgtataaaagctatcgtaatctggttagaaatctttattttgctaaagaatacttttgtcattattagacctgttgagatactcttcattgttcagggccattttagtaacattcttaacagctctttaaacaagtaatttgatattctttggtttccttagataccagcctgccccttttcagaaagcttagggatatctgtgccctcgaagatttaaaaaatttcattgcaatttatcttcactgcagctttctcttttgttaccatgaacttctaatattatatatttattttattggtacgtggggaaatttccctgcttcacctgttctttaaaagagtaacaatcatttcctcaatagcttttcagctcttcatacccagcaatagttcttaggttttatagctgatactttgtatcatgttaattatgggtgacaaccctgaacaacaacccaaagcatctatcagcacctatccatcagtgattaactcagagtaggctctcaatgtattttttgaataaatgcttatcatcgattataatgaagatcacaaattgtgctggaacctaaccagttatagattccttgcatggatataagaatgataagagttacaattaaagtgttataacactgagttgtgtgtcctaatccgaaagtattcttgcttccatatagtagagaaaattttttgtgatgcagttacagtgcttaataaagcttcatacatggaaactctcagtaaatgcttattgttgtcattattggtgtaaattaaatctgaatattagttcacatatttaagtggcccttttggtatccgttttcactcttcagattttttttctctcattttttggggggaagactcttctttttttcaatgctgctcaagattttctattttttaaattagagaattttctattattgttgctaccttccttagatgataaatcagtagcaagctgactggtttttatcaaaattgatgttctgatattgagaacaggaagtgttgatgttgacctgtctgtctgaaaaaaaaaaacaaaaaaccccacaatattctgcttacactttcactgggcaattatgtaaaaaagatcagtagtttttccttgttttacttttataatctgatgcctggtgaaataaccacacagaaaacatgcaagtaggaatcttttgtagttctccatggcctataatccctgcccccaaatcatgccaagcattaggatccgcccatgtattaacagctttaagaggaagtcagtagaggatccttgtcagaattgtcctggtgtgtgatggcttgctgcttttttatgaaaggatcagtcatgccgaagacatagctatgcataaggtaatcagcatgaaataaagggaagttaattaaatatggttgtcaatactgtagttgtgaattttatttaactagttaaggaaactaaaaatatgacatccttaaaaagacatttttaatgtttataagataaaatacgtaaagaaagttttgacaatcttaacaagtccattgtcaaactattaccaggctgtgtaaccatctagttacttagcaacctaagtgaagcaatagcatttaatattttgtataaattttcagcaaaggcggcccaaatttttagcattagagacattttctgatatgcagggagctcttcctccacagttcctttctttagtgggtcattacataccacaggtggattatgtttatcttttaatggtgaaatgatagtttttctttggtggaggagctggttatctgtcttccaaaatgtcttctggtgacttgtattaagatcttattaaaatatcattgtgttcttgcattcacagcagaagactactgtaaattgcattatatgaaactgaataatatctatggtttaatttaaagtagaaataaaatctaaattcatacattcgagctgtagggtttcaagattttaatttggtgaaatgccggaacaatttcttatatttaatttgaggagtattacatgagaagtgcatcttatcaaattaggaaagaaacatatactatttacacagtctaattattaaagcatgttaaatttcacagttaatattcagatatctttctgtaaatgagttgctgagatttattgtcaatgttgtttgatttgtaaagtccattaagttgcaaatgctgatttgaggaatggtggcaagttaggatttcaaagtagccatgtttttttcagtaggctctgtaaatcattaatactaaaaagaaataacctgcaatgctgtgtgcattataggtaatatcagaaactttttttttttttttgcaaagcatagctgaagtttaattcccagtgtggaatgtattagtttttcgtatagaggtgagatagcccacaattggctgttgaactggagtgccgttgtctgtcttataattttggaggagaaaaaaaaatatgattttaatttttacattctttgttttgaaagatgataaaagtgttttctacacatgtttcccgctatcagaaaaaaatcactgttaagaggatattgctgatggaaacaatgttttctcaagttcagaatattgctagggaaatatgtagatgtggaaggctaccttgttaagaagttgtgcaagaaaaaaatctttaatttttatattttgatttataatttaatttttatattttaatattaaaattctaatatttttagtgtactttgaaaatgtccaatttgtacatttatataatccctgggttttatttttatttttaaaattttatttatttttacttctttttaatatgaggtcttgctcggtcatctaggctatagtgcagtggtacagtcatagctcactgcagcctcagacttctaggctctagctatcctcccgcctctgcctcttgagtatctagggctataggcctgcgccaccacactttgtaacacagtttttatttaatagcaaaattagcaagtatatttaatatagtttcatataatttcacattttgagataagtttgaaattattataaattgtttttgtagatactattaaattcctaaacttcatggaggaattattctactggatttgggcctgagttgcagattttgtttctgcagtaattatgggcctttctatttcttcatttttataatgaggagactctggttttaaaaactctttcttgaggggtttaatgatgaaaatgataaggtattgtatgtcaaacaatgataaattaaaacttccagaagaagtagtcatttttgttttctgccttatagattgacactctttaatatttaagtgtttaattaaaaaatagtctggcatagaaaaaaatcttgaaaatctctatttaggaggtctccgagttagttcccagttttttttttttaatttaactttcttacaccaacaagcaaagatgaaagtttccagttttaaaaaattctgtttcacacgagtttctgaattccatccactttgctttattctttccactattcatgttagtttccgtaattcagttcatttattcatgcctgcctcccttcctctctccttcccgttttttctctccttccttccttccttcttccctccctccttccctccttccttccctcccccctccctctttccttccctccccctcttcctgtctccctccttccccctacctctgtccctctctccctcctatgtttcttattgtcaaaaacatttattatgtgctagctctttgtcaggcactatgcatgggttatactcactggtaaggtagcactgaagtgatagacatgaaagccatctttcatcataactgtgttcagttagctcaccatcttttgaaaatgttacattgtgatagggatgagcactctgtactatggacaaaaatgacactgtacccctgatgtgtggtggaggtttagggaaccagtcagttagacagtcaagtgatggacccaactgagtcttggaaaaggaacagtagttagccaagggacaagtggcagaggagattccaggcagaaggaacagtataactataccaagaaaggtatagaagtgagagtaagcttctatgacccaagaacataagagcaaattaaataatatttaaaaaagaaaaccacgaagttaaaaaaggatggtcttcctcaagtgtagatatatttgctaaaaaataaatatttcaaaaatttaaatattttccagaaagtttgttaatatatttgatgtgtttttttaattaccaggatattatactagtcatcagaatcacaaagtgataagcgaaagtcatggtccataaggagcacttactctcttaattacattacataaattcgtgacattacttgtgcatttgtgtcatttctgtatcttctgaatcattgtattacttgcagtttaagcctcagtgccttgaacaaagtatgtacccaaaaaattttttaggcttggtttgaaaagatttatcttgaagaaagataaacatagaaaatttcaataaaagacattttatttattcatttatttatagacaaggtctttctctttgttgtccaggctggagtacagtggcctgatcatagctcactgtagcgtggaactcctgggctcaagcgatccttccatctcagcctcccaagaagctggaactacaggcacatgccaccatgcccagctattttttttaattttttgtagagatggagtctcttaatttgcctagactgaacttgaactcctgggctcaagccatcctcctgccttggctccccaaattgctgggatttacaggcatgagccactgcacctggctgcaaaagacattttaaaactagtttaaaagcttaattgaagaggactcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctctctctctctctctgtctttcagattttcaattaccattcccctttcattccagccccagttgcaactttcttgttgttaaaatacatacaatagggctgggcgcagtggctcaagcctgtaacaccagcagtttgggaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatgagtcaccgcacctggccagaccctgtctccaaaaaaaaaaaaaaaaaaaagacatactagatttgttgtgctaagttagagtgaaataataatacatgtacttttggagacattttagaaacatttctgagatcaacctttgtcaagtcagaaccccaactgtgttcttccatgtaaaattatttttagagtttgttccagttttatacacatttatggtttagggtgaaattaggaagattactagaggctggcaagatggatggaaggtgataaatcagctttgagatttttgcagatgttcagaaagaaagatgttaggacagagggattgaaagcaatgggaagaggattaaggtatttcagggtaagaatcaatagaacagtgaatgtgtacctctttaaaatgaagtaccttttgtattgacagagctatattttacccaaacttaagatgaataatgctccagaggatttttggtttcaaaactattggagactaggctaatttcatttgtttgtgtgtgtatccatgcatacatgcacatatatatttagtaagcttggtttaaagaaaatctgttacttcatagtagatgtgattttcttttaccatttcacactaatgcatttctttgttattataagttagcaattgaaggttatatgtataattcatgctaaattagtatattggtctagaaggtttttcaggagactaataatggagtagaggcttctttaatacatatgactatataaaacattattaatattaacagatgttgcactttaatcccctagaatgactggtaccagcaggagatttattaagcctgaattgtgtgaaattgtgtgtgcataagctgcaacttagactgtaaaaatgctactgaaaactgttaaaaagatttagctataatttggcagagaagtattaactgtgctaaaagaagtatgtgtgtatggttggcccttcgccttaacctttttatcatttatcttcttgtattaatgtcactgaattattaattcatgagccaggatgggaagggtgaaggcaccatttaaatgtgtggcaaatttatccttatcgccagagacatgaaaaaagtcattttgtgttatctgtaaaatggaaaggacattttaaaatttcatttacagtaatccacttcacttccagtcaaacacctagattattactaccataatataatgttattaaaaatttgtaaccttctccactcttttgtcttatatatataatgttgatagaaaaatttagccttgatttatttcagtgtgatacttgttaattgtaggttaaaaatgttacttttacgaatgatatgttatagtttgacttaaattttaaggaacagtagacttatgaaaaataaaaaatatttactgtaataataacaatcaggatattttcattgaggggagtccgcatatagggaattggaaagctctaaatatatgtttcaaagaaatgtttgcatttattgtgacttcataattatttggaataagattggtgatgttggccttgtggaacttttagcattatacaagaaacttagcaaattagaatttagcatttacttgttgaatgtaatgtggatctgggatatatccagtatttcatatggataagtagctatggtgacaggaatttcaagagtttgaagccacttttaccagcagctcttcgaaaccatcatgctaatggaagaatacctcaggggtcttgtccaaacctcatcacttttcattctcccgttatttactattttgattggttttatatactctcatgccaaacaaagtagtaagataagttactgtggtaatgtcctttgttttcttttctagaatttctccccgaacactctaaggtatacatatggctctgttatacacacactgaaaacacgaattgttttttttgagatagaatctctcttcgtcacctgggctggattgcagtggtgcgatcttggcgcactacaccctcagcctccccacttcaagcatttctcttgcctcagcctccagggtagctgggattacaggtggtgccaccacgcctggctaatttttgcatttttagtagagatgggatttcaccaagttgtccaggctggtctcgaactcctgacctcagccaatccaccggcctcggactcccaaagtgctaggattacaggtgtgagccactgcacctggcctgaaactctaatttgttttgatcagtaaataatgctactttgtttttcttattctagtatggttaatttacctttacattaacatttaaattaatttcttaaaataatagactaaagttgatttgattattttggcagacatgaatagttattagttcattatgtgactgaactgcatccagttatcttggtcttaggattgttcatctataaacaggggttgggcaaactatggctagccatcagttttgtaagtaaagttgtattggcacacagccaatgtcatttcggtatgcattgcctgtggcacctttcacactacagtggcagacatacatagttatggcacagaccatatcactcttaaagcctaaaatattttctgtctggtcctccatagaaagagttacctaacttctgatctgactgtctcaatctgcataaaatgttggttctaatccttacaaatgtagtggaatataattgataattttaagctcaagagattggaaaattcagtagtttttatcatcattggaaatgtttttttttaagcagatttttgcttttctttatatgtggagtagcaataataagtgatatttttcctgaaagttttctgaattgaaacattttaaaaaccattaaaatgttgcaaaaatacattagtctgttaccacatgaaggactcttggcaagtaattcaagcttctagtcatttttctctgctttttataacctatgtttcttttttattaaatgtcactgctttattactactttaatgttatttgaaattttaataggttataaaattatattttaaagttgaaaaagctcttttctaaaaaccacatacctctcctactccatgtttgagtagttaagaagcactaaaacataaattttaatttaatggaagaccttttggtttttaattttttcatacctaacagccactcaaaatgacacagtctgttactgtttcttaataggtgtgtccatgaatatttttcttaccgtctcatctaaatctcctcatatttttttttttcattttttttgggacgaagtcttgctcttgttgcctgggctagagtgcagtggcgctatcttggctcactgcaacctcctcctcctgggtttaagcaattctcctgcctcagcctcccgagtagctgggattacaggcgcctgccaccatgcctggctaatttttgtgtttttagtagagacggggtttcaccgcattggccaagctggtctcgaactcctgacctcaggcaatccacctgccttggcctcccaaagtgctgagattacaggtgtgatacatctcctaatattcttagaggaatcagctacaccaaacacagagtttcaggctgacatgggaagccaaagaatctattctgttcattcacttagactctagctttatctttagtactattaattaagttaattatttagaaataattggtatattccttttctgtacaactcaagaaaatccttttgttttgagttttacttgtagacacagatataaatggtatggaacatttggcataatcgggactaaccccagctaaggcatagaaacttgttctttcttaaagaagtccctgatgttgttttgaattttcgttatctgtagttttcccaggaaggcagagtgtgaaatatgtgagctaaatgcttcaggttattataatattcctgtcaatataataatctataagtagatttcaaaaacaaagattttctgaaacagttgcttctttttaagatatgaattagaataattgccgagacatattttgatagaagagacaagtccttagttaaacatattgcagaagcccccagatggcttccttaacattacttaaggtagaatcaggaccataaatttatcattgggaaaattggaaaatgattgaatcatagatttataatctcttcctacccttatatagttgctgaacttgagacctagatgcttgctactgcagtccttgtaggggcaggttgagccacgattctatagtgtgcacttgatctggatcttgacctcttcattaagatgactgattgatctaggtacacgtctcaaggaaacacagatccagaaactgctgttagttacttctcttagcttctcatcacatttactaccattaagttttgggaggtttagtaattattatttaatgcttattttggatcttggtcattttcttgcatatttaattctcataagattattaatttcttgaaggtggcagctatatcttaatctgttttataatgcctttagaacctaacacaggaccagttaatacagaaggtaaaaaaaattaatgaataacactcgttttagcactggatatccattaaaaatgtgtaggaagtactcactggatattcattgacttgactggacatacatgaaagtatagtgctaatgtgatctactttatgttaaaggcaagaaatgtaagtttagataacactatattgacatagtttgcaaatgaattgtatcatttaattacaaaggcaatgtgctatagcacttcacaaaacttcagcttcttactgtgtattctttatagttaatttttcacatatatctatattttattttatttttttgagatggagtctcgctctgtctcctgggctggagtgcagtggcctcatctctgctcactgcaacctccaccttccgggttcaagcgattctcctgcctcagcctcctgagtagctgggattacaagtgcccgccaccacgcctggcaaatttttgtattttagtagagacggggtttcgccacattggccaggctggtctcgaactcctgacctcaggtgatccacccgcctctgcctcccaaagtgctgggattacaggcgtgagccaccgcgcctggccaatttttcatatttatttttaagatcatttgatgtattttactcagattacctcattacctctaagaaacctctgatggtgatattgatgatctaatatatgacagatcctgggtcattattatttcatttagtggttgtatatatagaccaagagggaatttgaatattgattcggggaatggccagtaacggtgatttatgaacaaaggatccagtgcagtgagccaaacataagattgcatcttatgagtgagccacgttgagttttttctgttatacttacccgaatgatgattagtccataatcttgtagatgttaatattaaaacctttgttccatgactattaaagatacattgctagttatattggaggaaatatttatgtatttattctttggacttactatgaacaacttctctagtagtttggttgataaaatttatcagtgtaattagttatataatttaggcactttagtaatataaatgagtaaattaggatagctcaactggaaatagtaaaaattaagttaatatttagctgttattacctaagggatgtttagctcatgtaaacattttaaaaatcaactcgctattcttttggtgtttcctcacttttgtatctcaagatgattttgttctgtattcatttttttattctaaaggaaaagatagtaaaataaggttatctggtctacataattagtaacagtagtgattttagaacatgggcttatttctcagcccttctgcttgcttactttccttgagtaggttaagttttctgcttttaagataaaatggatatatttcttaaggttgttgggaaaattgcatggaagagtaagcacactgttatctacctagtttagctgtaatttttttgggagcctaactgtgtgcaaggcagttacaggtttttactaggacgagttatttttaaagtacagtgtaatctccctgtggatgagaaattttgtttctttttttcctcagtacacaacatatgtaataggtgctcagtaaatatttgttgaaggaataatttggtgaatagtggaaagaatggctttgtagatagccttgattgggatctaagctctgctgcttattagctgagtaatttcagttgagttattttacctctcggagcctcagatttctgacctttataatactgatcttgcttttttggtaaggattagtgatatgtatcttacagtatttcagacaacacagaagttagctttttcccaatttgaggtaaataaaaagttatttttaaatggcagtcctctccaattttaagacattgtatttcctccgaactttcttttcttctttttgatatggagtctcactgtgtcacccaggctggagtgcagcggcacgatctcggctcactgcaacctccacctctcgggttcaagcaattctccttccttagcctcctgtgtagctgggattacaggcatgcaccaccatgtccagctaattttttgtgtatttttagtagagacggggtttcaccatgttggtcaggctggtctcgaactcctgacctcgtgatccacctgccttggcctcccaaagttctgggattacaggagtgagccaccttgcccggcctgaactttctaatagtctagagtcctcaggcagtttttttgaattgaattacaagtaccatgactagaaatatttcctgagtgtctactatgtctgcgaaacgaagaaattttagtaaagggtaagaccagtgatgaatattaaggggacttctgtataaatagtttaattaatgtcctctagacttgatagcagtgcctgcagaaagaaaatgaagaaagagggtggtgactagtggctggccacgtggttttaaaatctctgtgagcattgccagccccagccctatccatgtgaagaaaagaaaataaactcaaacctcaaagaatgctgaatgtctgaagcttctaagaaagcctttctgattagggatagcaagggtttgcttagctgacttactgaaggaaaactcccaggggtaatgatgtgttctctgatgttaagaaggggaaatctagtctgtaaagattacacataaaatatttctgaaaagtgaataacctgattgaggttcagctaaagtgaaataaaactataatttattttttcattttctgagcctttgcacagaaaatgaaaaggcagaattgggttagtgtcatccttttttgtgtttgtttgttttggtaaaatacagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatatttgattatttattcgttctattcttagctgattgtggtttgttaggtatttcaactttcattaacatttgtttaatggaaggttgtttaaaacttgggtcacagcagtaaaatcttttgatttagtttccaaattgcacttaaagcttgaggttttggaaataattttatttgatgtaaaagcgattgggcacaggttgtagaatgataaaaataaatttgacttttttttttacttattcattacacaggcagattgacttaagctttatttttgtaaaagaagccatgattttatacattctagaacctgtttccatttgtcagaaacaaccacttacatggtctcataattgaatgatatgtatttttaaaattgtgtttcacattctcaaaccttcagaatacactgaatttttagtatataaaaattttcataagatattctttcctggccaaagaccacaatagaggtcttgattgtgtggtttcctcctcctttttcccttcacgaacagaggttttcctatcttggcagctgtttcctacaaagcagtcatcagtccctgatttcttccttcctcctccttcccacaaacaagggctctttgaatagtggatgactgaagacagactgatcttggatcactttaagaaagtggaaacgtgtgcaagagttgagcatgtgggcaagctgcctgtaggcactagctcattcaaatcaaacaatgaaaacttggacagtaaaaattctttgcttggaatctagagtggtccaaaggctgacttaattttacttgcagcacttcatccacgcgtttacattattctgattgcttgatcagatcatcgaacagactgtaagaatataagaaattgttcattgatggccttttaaatgtgacaagccatgagattatctgactttttaaaatgctttatgtagaataactttcaggtttaaggcaggcacattgctacagcagttgtaaactgcaggttcacttttggttttggttacctttgaatagtctatgggagctcagagtgaaaaatgtacagagccagccagctagttttgcagggatgcgtgccatgtgtctccatcagattaattttggatacatcattctttttgaggaagtttgcattttcctttgtttctttggacagataagcatctgaggtgttcttaaatggcataatactgatgttggtgatgcctccctctcccctgtgtcttcagtgctttcagagagagagctaaaacttgggccaattctgggtcatagagggatccttagggaagcatttacatctctgaaactgtgggcctgaatgatttcagattaatttcttacattatttttgttgtgttcttaataaagcaagatagtacctttataggtaataagtgtttcaaaccatttaacatctgcctgcttttccaatcaggttacattataatgaactgatagtagaatgtagtgtactgctaatagcatcccgtgtgataagctacatgaagcatgtagtaaatgcacagtaggtcagataatgtgcaagaactcaaaagttatcaggaaaattttgttttctaaattttctttatggtttagtgacagcatcgaaatgatgtaatgagtttgttttactgagttatgtatgcaacctcagaaagggagggaagagttccctccctgctgcactttgtaaaactctttagttgcagcaggttaaggataactggagaaaacttggtgtaagagtattatgtagaataaaataataggaaacgaacatgaagaaactgtaagatgttcctttaacagaaaagtttgtgatttcctttccctcagaggctaaatgaggaggctggatatatttgggaaatgccttcattttatgtgcattataaggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataattctaaaactcctaagttaaaatatgtagtcttttatgaaaacttacattttaataatagttcatctttttatgttgtttatatctttagctgtatatgtgtgtgtatatgtatattctttgtaatgttaaatttgcagaaatataactatttctttgtacttaaaaatagatgtggaatttttcttaagcactattgcattaaacatttttaaaatctaggaatagtaatgagtgtatttttcaagacagacctgatttttaaagaaataaatatacttttgaagcctaatgaaataattggaaccatcatttattaactatatagatttctggaatccattgttttcttagtcttaaatattatttccacatgaaaacaacacacatgcaggtgttttttagagcaggctagaagttaatatggagctaagatgtataaattttatagctagttgatagtggcagttattggcacgaaaatgtattaatcttgtaaagtttgtgaagggtataaaatctctgagaaatgcatataaattataatggattttaaaaaattccaattcttgaaaaaatgtttaagaattaaaaaattgattttatatgtacttttaagtgatctcacttataccgattattaaaatgataggtggagaaggggcatactgtcaactaatagaagtgtattattccgttgtctgtgtaataagcttcaaaatgttaacgttttaattttgctgaaagaattttacttgaattgcttgttccaaagttatattttatcatgttctccttgtccctccagtcccctacgttcagtatattgatatgatgtaatataatttaaataaataacaaatttagaaatacttaaaataagagtttctgtattcagaaagtaaatagtgttcacttggatttaagtcacacttggcagttacaatctttgggttaatattttattttcagatgacattgctctttgctttagaattgaagatgcatcatatctaacatcatatgtaatctgtgtgaatgaataatactatcataaacagtgaacaggaattgtgtttaataatataaatttctggcttggattgttgtgaaaatcttgtgtgtagtctgatgattttacatctcgtttttggggaagaaaacctaactgaattcctgctgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatccaggtcactgcaaatgctgttaattcattcctttttatggctgagtagtattccatcatatatatatatgtatttttttcatcatatatatatattttccatcatatatatatatattttccatcatatatatatgttttccatcatatatatatgttttccatcatatatatatatattttccatcatatatatatattttccatcatatatatatatattttccatcatatatatatgatggaatatatatatataatatatatataaatacacacaacacacacatcacagttcctttatccactcgttgattgatgggcatttgggttggttccacgattttgcagttgtgctgctgtaaccatgcatgaaggcatgattcttactcttgagaagctcatggtcttgtgcagggattgaaaccttaaatacttgttggtgccttgagaacattcgacttgaggtcagacaagaaagtgcttgtcagaggacctgtgattaccattccagtatttagcttggtttttccagtcttctgactttcagtagaaatcaaacattaggatttttaagtaatggcaactaattaagattttgtttaaaaaacaagcgtgtataccatagaatagccatgggttatgcctttccttttagatctttttttttcctcctgttacagttgtattttaccttggtacatgattttaaaggcttcacataattttggatttgctttacatcggtacataatgagacatacatttccaaattcataaggacttactctgtgttcaggcaaacattataaatgtcatattttgtgtacacatacaggggcaaatcactaagcatttttaaagtttgaacatggcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcattcctccttttttctttcattctttgatttacacacgcatataacaaaatctgtacatatatacacatatttgtgtatatatgtgcacgcgcatacacgtgcacacacacacaacatgcagtatgctagtttcataagggcagggatgttttgttgttgttcactgatgtcttcaagtgcctgaacaatgcctggcttatactaagcactcaatccatagctgtcacataaatagaataaatctttgaagaggttcatagtctgtataatgagggaaaagacaatgagcagttgtaataagagtgtgataagtgccataataatgatattcacagaggcattgggatgagcgatagttggatggttgcatgtgtgttaggaaattcttgtagttggaagtgatgatacggcagaatcacctggaagatctgcggtggggcccaagcattagttaacattgctgacaaattgcagggtgatgctgatggtgttgctcagcatcacactataagagccactgcgtattctatgtgcttaggggtggttgtggtgagggtaggggtgcatgggtgtagacatggtacaactttttcaaaagtatttttggaaaaaatgatgagatgattgatcatgattcagaagttagtatccagttgtttcttgggagttagtatctgtttctttgcagattgttctttattcccctgattaggcttcttgggaataattttagtcttcagaaaaggattttttttttcttttagcgcttttttttttttttttttttttaagatggagtctcactctgtctcccaggccggaatacaatgggatgatctccgctcactgaaacctccacctcccgggttcaagggattctcctgcctcagcctcccaagtagctgggattacaggcacctgccaccatgcctgtctaacttttttatttttagtagagacggggtttcaccatattggccaggctggtctctgactcttgaccttgtgatccacccaccttggcctcccaaaggactgggattatatgcatgagacaccacacccagccttttttgctcttttcaagagtatactcagaaaaaaattttgaaaaatttacaccaaattggaaaaaaacgtatttttcctcttagggataaatgctctgtttagtagagctcttaaaactcttgtttcaatttgtctctttcactctaataccctggttcttttcttgttgagaataactacatggccaatgctgtgataacactgaattgacttactgtggggatttcagatttcccaatctaacaaaattaactacttttgttcatttcagtatatttgattagttgaagtctaggaggtaaatttttagcaaggtacttggggatttggctgtaaacctaatgggagtcacaactcccattaaattaataggaattgtgtatttgtgcctgctgcatagcaaatgtaactttattttctaaattcacaaattatgtaaattaacacccagctaaagcaatgaattttttaaaaattactattattattttttgagatggtgtcttgctgtgttgctcaggctggagtgcagtggtgtggtctcagctcactgcaacctcggcctcctgggttcaaacaattctcctgcctcagcctcccaagtaactgggactacaggcacccaccaccacgcctggctaatttttgtatttttagtagacacggggtttcaccatattggtcaggctggtctcaaactcctgaccttgtgatctacttgccttggcctcccaaagtgctgggattacaggcatgaaccactgtgcccggccaaaaaaatgattttatttaagaaaatacttaactgtattgctcttaggacactttagatattctttattttgtttcatgagaatattgtaatttgattgcagcagctttcttctccataggtagcgataattcggttttaaaaatataaatcttaatgcctttacaaattgtatgatgttgttatcttctcttgcaaaaatcaaattattataatattactatcagcattcaagatgaaggtaaatatgttacaaatgtgactcaaagttgccgaaaataaaattaagcttaatcggatacactggcatcttttcaaaagtaaatttgaattatactttggtcatcttatataccaatatttagtgtcagaatatgccatgtttcataaatgaagataaagttcaagtgcttgattgtcgatttttttttcttcccacttttcctcatgctttcttcttgattccatcctcttttgcctctttttcatttgtggaaaaactttgtttatccacagtcttcgttgattcaccagtaggtctgttgttggcggaaaaagtattgcaaacgtgtatgtcattcacaacagtcacccagcagacctcaaaaacattatattgcgtggctgtttaatttcggtaaacctccattttctgacagaaaagaccatatcaaatatttagtaaataaatttgtttttaaataataatttgctaaaagtaaaaaggttattagctcatgcatactagagtaaattttagaaataccgattttacatgcatattaggcatttacacagttatttttatagtttgaaagaaccaatagtgtattacagggagtttaattaaaagcacaggaggcatttaaagcaccttaattttgtggaactgtgattctgttaatttctcattactcattaatttcagcattgaagctcttcattttttgaattaatacactttaattttttaatatacgatagcttgtgatattagagaataagataagtgattgaacacatctgaagaccacatcagaagactattgtagaacatgctgtgtctcaaaaaactgatttatctgccatattactaagggagtgtcttactaaaacttgataccccatggtactctattttcttttcccctcctctgcaagacaaagaatgacatatgacagccatgcaagctacacatattagacatcaatttggattagtgagtatctcatggcatctttcaaccctattcctgaactccttttgtcaacttgacagaagtgattccaggagaatacctagtcccagcctcgggatctcctggctaaaatgtaaagctgagaagggaatacgtatcagcacttcaggaagcagaaacaacatttataatctcttcttatcagcatgggactctcctgagtttgacttttatgtctgccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttcttcttctttcctttttgttatatagctattttcttttgtgagaccttccattattttatgcttaaaaatgtatatcttgatctcagttaaatatttattcattacatttccctgtagctcttaaatatttttatttaaattttgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttctccagttggaaggaagggaaatggaacccattgcactggtaggaaggctcattcagggaagtaaagaatgtgtattaggatccagagagaggaaagattcaggaagagatgtgtacagccgcagaagaaagatgatggaggtcatgctgggctttaaacatcttatttatctagaatagtgcccctcaaaagttaatgtgcatataaatcactcagggatcttgttaaaatgtagattcttgcttcagtaatctgggatggaccttctgagtctgcatttctaataagctcccaggtgatgctaaggttgctggtctgtaagataatgtctgtattagggagttttggttattaaaatgtttggtctagaaaatgagagtttacatgacagtgacttccgctgttaaaaatcgaggtttgttttaaacccaaacaaccatagttgaaatatagaaataacatcactttcagttgtataactcattttattaaaaaaggaactaagctaccttgaaactttactgaacatttttatattttgtggcacttctaatcctattttatatgccttctattgaccttttatgtggtgagttgctttgaaaaatccctgagtaacaatgcagcctgaccctttctccctaatatttccctctattccctattgatctgtcatactttcattctatcatacacagaaacagtgtttttaacagcattttaatacaaatgttttattatttaaagtaacactataaagtcatgtaatgcaaagtgtatgtttgtcttatttagaaaaagtttatttttattatactaatttttcaaagtcaacatatttaatcaactaataattgttgtttttgcctaagtattaattccttggcttatcagcaccataagagtataggatggaagtacttgattgttaactggtcattaaaaatggctaaatatgttttatctgccttaggttatctagtgatttttccactttttagtattgtatagaatcaaagattttcttcttcttagtggacacaatctccttttcccttttctttcagaggcaaagatatagggtactgatatgatttgttttaattttacgataataccaattataaagtaaatttatttcttaatgaattttattagactcttcaggctcttaaaccactcaaaagtaagttagtagcaaattttaaaaatagagactcctatataggtacctgagaggtcgaagtatttttattttgatttttttggtggaattaaagaattttggactttgaatcacagcttggatattagtagtgtagaatttttcattttacagatgaagaaactaaggcctgcagattgttcctttgtcaagctctacttaactgccagtccagttttcttgctgtagaactttatatttagcttcagatcattagtatattttcctatctcagcaggctgttactcaagaatatttaaagtatactttatattgcttaacattgcattacttaatggtaattatcaaacgagctaattatgtcagttttcttaatgtttattaccattttagatgaaaaactatgttaagatttgttttttagtgaaaattatgtagagtacaggaggaccaatcatgctaacacttcaactttcaaataatcttccaaagtttacagccataagcatatattttttaaaaagcacaatttatctttgaagttaccagctattgctgagaaccattaactgtcagaacaccgaaaacctgtaacaattataacaagaattgtaactcttactatgtttagttatcagtccacacagattatcagtcatcattaaaacagttaaaaggcatgctcctcctgagcccctccttcaggtatgtgttttggacattatcttttcccttttgtttgcttacaacaggaagctcgtttaatcctttgctttgttttagaggtaagcaaatagcaaccatccctgttagctttcaaaagctcttacttttgttgcattaatggcactcactgtagattgtgtgatcttgctttatttaccagaaagcttgcctttgagagctgtcactccattctttcaacaatgttgttaattgactgatagcactgattgagtggaaaaccttcagtgacaaaagactggatataggtgtgagtccatttgaaaggctggtgaatctttgcttcttaatcccatttctatttgcactgaaatactaaatacagcctagaagaacaaagcatatttaaaagcattcagaaatgttaagcaacaataaaaccccgtaaccatttaaatgacagcagctgactatttgaattaactttgtgtttggcttaatttggggccctaattattcctaacttacgtgagtagatttcaattatagtatcctgcagggatttgtagctaaggcaactaaaagaatcattttacataaagtacttttgttcaactgattagacaagttaaaacgtaatgatgtaaaattgaaacccttctggcaaggtccaaacaaatggttctagtaattttgtccaaaaaagattaatctaagtttgattttaaatactattttggtcttttaggacgattgactttcctgtaatactgataagtatataaaaatgccttaagattgcatgttttggtaaaggagtaagactttaaaggtgaggacaaatttgtcacagtggatggacaccttcctaagtaatgtttatttgctttataatcttcgatacacagtttgacagctttaaatgcatagatttagaagataaatacatacaaataacgtgaatgactagtacctatttaattctgtattttggaatacatttcagttgaacacagatcagaggctcatttatggatttgaaatgctatataccaagaagggacacaacatggttgacattgtgctatagtcagtggacagactgtttgactcgtcctgccgaaatactcctccccactacaaacagccacattaattttaaacacctttaccagaatgaaagctactttaaacttaattactggtgctggagcacaatattaaaaaaagcattagccagcatccatagatcattttgaggcttaaccatagcatttcactggagtcttacagctgtctaatatcagtctattgtagtgagtgaagttaagaggcagcaactctgttctatgtcttgtcttagcactgctttaagttctcttcgttgtcttctttctccccctcctcctcttttaccccttctttcagtttttgaatatctacaacatgtgagtcattgtcttttcacacttgatattttcattatttcctttaagctagtcaattctatgacctgtttttcactaagtgaaacaaaatctaaaaggcatggtgtgaagttcacagacctcacctttttgacttcaaagtgaggttttcctcccatagcacaaatgaagctatataactgcttcttgaaaacaatgtcaataaattcattctttgacctattcagttcctttttgttctttagtatactttttgaaagctagtaacctttaggaggctttttctaatctaaacaggaatcctctgaatttatatagcaacacagtacaatacagtaagccacaagtagttattgaacactggaaatgtgactaatgtgactgagaaaatacatttttattggtcagagcaattttataggtacttctttcctgtaaggctttgttgttgttgctgttgttacctctttacacctcctttatatgtttcagctaattcattgaagttaagcacaatgttttatttatttctgtatttttcatagtgcttaggcattcaaaactattttaaatgattgagaagcacattcaaagagacttagtaccaaagctacattttaaatatatacttaatttatagggcagggatttcactaatgatcacccaaaaaccaatatggttagtttatgaatatcgaaaacaaaggagtgtccatgcatgcatagtgtatatcttgcaggaattcagcccttaggattaacagctaagtatactttaagcatattttaataattatagcaagccctagttatttactgcagcctcaattcttattaggagattttgatagttgtttaaattatttggatggtaataacctacactgaagtcagctaacgttggcttctcttccctaaatatggaacttccttcttaaaatccattgatgaacccagctaatattgccatttgctttttatggtttgagaatatgttttagagtataagtaattatgaaggtatcagttaaaaatgatgagtaatgaatatctctagtcatttcgaaaattcttgtgatcttgtcttgtgaattctttagtaactagaaaatcctctgtgattttagcttaaatataaggaggacattttatcttcataatgggtaatgatgtattttattataatgatattttatatagatttatacatcacacctgaaaatatattacttttttggttcttaatgacttttggctctttttcttaattactttactgttaatattaaaatgtttatagcttgtaatttataaaaattcgtagcttttttggggaaattgtcataaaatgccacttaaatttgtgtgtgtgtgtgtgtgtgtgtgtgtgtatgtgtatgtattctggctgtcagaatttcttattttccacgtacgtttgcaaatgaatttctgatttaccattctgtctctgggtctaatttagaaaaagaagtagtaaattctatgtttagtagaaattgaggtaaatgcagagtacaactataggattttttttatatattaattttgaagaggaaagcatctgacttagaatggcgaattaaaaaattattatattctgtacaatgatgaactattctagcttcaagtacttggtaactaaaatgtttgctcagtaaacgtaagaatttttcattgacatattcagcatggatttgaggtttcagaagtgctagtttctaatcctaacatctaatggttcattaccacctcgttttaaaacaatagtgatatctctcaaatgaaagcattattttgtcagactttattcctgcatggtttacatttgttttagaaagtcagtccactttaaaaatgaaagtttggtaccagtgaaagtagctgaaaagaatgtattgctgtttgataagtcaaatagaagaggagtgttagaacagatgaaaaaccttccaggtaaccgcctggtaagagaaagatggaaagatatagcttcttttcggaagagatacttatgaatctaatctgagatgtatgtgggaaaaaaatttttaaaaagctgtattctgtaagcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacggcaaaaaagtggaggttggtgtttttaagaaaactggaacattttattaggttttatctttgaatctctttaaaaactttatgatttgcaacctatgtgaataagcagtgaaattttcaaagactgtaaaaaatgaaagcaaataaagtattaataaagaaatattaaagatgatttttttgtttcttcgagctttgtggtcttactggaaagatttactataacatgatataaggttaaggtttttatttttctgtcatttttttctaagaaattgtttcataatatactatgatgtttgagaacaaaattgagaattttatgctttataaatttgtatcacaagatgttactaaatactgctcaaattaaagcagtatttgagcagtatgctcaaattgaagcatttataactgttacctttcttgaaatttaataagttggatcacagaattatcctttaattctgttaatcatgttttctttttttgtcataaatatatttttaaaagagtttatggcctgccttttgcctattctatgggcagtgaattttcttaataaattttccaatgtaggttgcattttctgtttctgttttctaatcatctttgcattatggcaagataaatgccaagtgctcaaaatgaagattttatgaaaatgttttatagttttccttggactctgaaagttgtcatggcatttctacagccattcacattacagggatactgccgaaccactggatttatcctgtcagctttgatttaggattaggcagtgtagtcatttgtattgacttggtctctgttttctttcactgacataccctgtagtgaaattacatttgtacgagtatttcatgggaaagacagaaagtataatatactcaaaggcagcaacttttggtgtaacgtccagtggttcaaattctgactctcatcagctatgtgaacctgtacaagttatttaacttgggttttcttgcttattataaaattgggaaaatgcctctattttagaactgttgatgcttagaaatgaaatgtttaaacatttattaatcagtgattgttgaacatttgccatgtgctcagactatgcagtgtgctaggtatgggtattatcttaaaggaacttaacaataatggtggtaccttatgacacctaaaggggaatccagagagagctgcataggtggcatactcagctgaaactcaaacagcagagatatctgaatgagcaagaggtgaccagctgagaaaagttcttctgagctccaggagagtgtgcaaaaatattgccactaagaaatggggtgaattgcaaataggtcaatgtgtgccgaaggtgaggggtgacaaaagatagctctggatgaagttggagccagatgactcatgtggaagagttagaatttgatcatgtaggtgagagataatcattgaaaaatttcaaaggtgattatatatttttattctggaagtatttctttaggctggatggggttgactattgaaagcgttgagaatattgaacaagttcctgtgggaccagggaattaacataaacaagtgaagtagacaggatataaagaaatgatacaaaactggaaagtgcatgcttgtctaaagtaggcagaagccaggcacagtggctcgtgcctgtaatcccagcactttgggagactgaggtgggaggatcacttgaggccaggagttaaagatcagcctgggtaacatagataagaccttgtgtctacagaaaatttaaaaaattagccaggcatagtgacatgcacccatggtcccagctacttaggaggctaaggtgggaggatcacttgagcctagtagttcaaggttgcagtgagccatgatagtgccattgcacttcagcctgggccacagagcgaggccctgtctcaaaaaaaccaaaaaaacaaaactaaacaaaatcaagtcggcaggtgctattcagcttcaggtgattattttatcagtattttgatactttttcttcctcttctttttctttttcttttttttactttttaatattttttccttgcaagcaggaagttatgatacattttcaatgcgaatatgttgtcaattgagctgatatttttccccaagaaaagtcggacattggatttgaatgttacatccccatattttgaaatgttggcagctaattcaaacagacactgagggggcaaatgaaatatacctgtgagctgaattcatcctgtggtctgcccatttgtgccctttttcttaaaaaataagattgttggagtaatccaagcaagaaagaatgagagactagaaaaaatattgaatgagagtagataaaaggaatgaattgatgaaatttccgaagtcatattcacagtagaagtgaggcaatttggcagatcgctgatgagggaaagggtgatttatatagtttgttcgtggtaagggacagaagctgatgtttgggaataaagtaaactggactttcttgcaggcatccaggggaggtcatattgcccagctggtccttgtggagtttggaaggtggtgtggaaactggtcatatatagcacagatgcataatctgaagcagcaggtgcttctgggactctggttacttgcttagttgtttggctcatggattccctttgtatctacctgcttctgcctaatagcaactagctgttctttccctcaactctttttattttttcccccttgcagttttgttttaggatatctggggtacttcacccagtcttgtgccaccctgtcagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagcttctgaatagaaaggattttgttcttgatctatagagatgcaattgaaagattatattgtgatttgaatataacacttcttattttaaatttctcggttcttgatacaagacaatattaaataaattattggatacatgaagacatttttaaaaatccattttttggcatttttggagagaatatcattgccttaatgatattattaatataatcatcttggaatttttatcttatttatacagcaattaatcttctttatccttactactatcaaccaaatctttcctttttgttaaattgatatttttagaatggcccttgaaaatgtatgggaatgtattttatctcaaacgtgaaattaagatttatggttagttgcgattagggaaataggaaaagttaaaaatgactacatttggaccagtggagataagactaggaatcatagaggataagagttaaatattatataatctctaacactctgaggtataagcagttagttctggccactaaaactcagtattattcttttggggataatagcagtgttggtttagattaaggcttcatacataaaatttgaaattctgtaaaaggtacatcaaaataaggaaagccagatccaataacacataggacacagaattaataactgagcctatagtactactattccttgatttgatttattcatgaagtcatttgttatttcattcagcaaatgctatgtttttgcagtttttactaaatgcaacttttttggtagttggtggtgcaaagaactgaaactaaggacaatgaatatcattttaccgttcctgtaaaattcctcttagggcaagaacaaaggtggtataaaaatgtttagaaccaagacttaagagaatgtatttctttcctatttttgctgtcttcctaaacatgacacatccttacctctttagatgttcagcttccaccgactgcacagggtcagtatttgacttggtgttatttcttaaagtatcagaattggggttgagtacttccgtcagggactgtgaaaatttagcacactctaaaaaatgatagcaagtataaaggtcctgaaaaaaaatcatttgcaaaatgtaaacataaaagacaccaaaatgtagacatatttaccattttttcccggatgtaatataaagtgcgccatttgtaacttagagtgcttatttcctattggctgtggtttattttcagtctactatggagtttttatgttatggcatgttaacatgccattttatagtcgtatggcagctattattatttatttttactacatattggacagtgttgactgagtaaatgtaattttgatatatacctctatgaaattaattgtttagaatttatttaagtaattatgtttgaacattcaaattatttgataactagagagattaagaagatgctactattaaagattgaaaataatggacagtttaagatggtaaaggaaaattttgtcactgagtttttaccttttaataatttgagcatcagattattttaaaacatttgccaattcagttctaacatgattttgtatacatgtatttatttgtatgaaaagaaatagtgttgtttaaatcgtgtcaattcagtgctattttctctcttattgtgtagtattctttgagtgttgaatatttgaatattgtagtttgttttgttcttctatattagaaattctcatgtaagtaaaatgaccatagaataaaaccttttttttttttttttttgagacagggtcttgctctgtggcccaggctggtgtgcagtggcatgatttctgcctactgcaacctccaccttctgggctcaagcagtcctcccacctcagcctcctgaatagctgggactacatgtgtgcaccaccacgctcggctaatttttgtatttttttgtagacacagggtcttgccatgtttcccaggctaggctcaaaatcctgagctcaagcaatccacccaccttggcctcccaaagtgctgggattacaggcatgtgtcaccgtgcttggccctgaaataaaatttttaatgttatttaattaataatcatttcatgtcatttagactttaattttttgtgaggctttttaaaataaaagtatttttaaggactttattaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttctaacttcaaaattttccttgcctttagttttctttttattctttattgttttcattttatcttatgaaactactttcagcatgtgataggtgattgttcttaagtatgcagttgtccaattgcataactttggcctattttgataatttttgttacatgtccttattaatttaggatatgtacatatttcactgactttttttttttttttttttgaggtggagttttgctcttgtcgcccaggctggagtgcaatggcacaatctcggctcactgcaacctccacctaccgggtgggttcaagcgattctcctgcctcagcctcccaagtagctgggaatacaggtgccagccaccacgcttggctaatttctgtatttttagtaaagacggggtttcaccacattggccaggctggtttcgaactcctgacctcagatgatccacccaccttggcttcccaaagtgctgggattacaggcatgagccactgcacccagcctcactgatattttaattggatgataaagtagcaaagtatttttatcatagctagttttgcaaaggttttaatgatttcataatattaagttaatttaagaaattcatctagcactttataagagatgtcagaatatcatggcaggttccatatgttccatatgtttgactaaaggtgttaccgtgcagtgttatactaagagaaatttatattttattgattatgtcggtatcaattataaactatcttttaacatttaatgctgttctttatcaataaacacatgggccatgcacagtggctcatgcctgttttcccagcccttcaggaggctgaggcaggtggatcacttgaggtcaagagtttgagaccagcctggccaacatggtgaaaccctgtttttactaaaaatacaaaaactagccagttgtggtggcgcttgcctgttatcccagactcgggaggctgaggcaggagaattgaacctgggaggtggtggctgcagtgaactgagattgcaccaccacactccagccagggcaacagagcaagactccatctcaaaagaagaaaaaaaaaaagaaacacatgaatttgcttggtttagtccttaaacatttttcattatgtgttattttgttgtagaaaaatttataattgttttttgttaattacatccgtcttttttgtcatcgtagaatgcggccgaagatactttataataaaagaaatattacgtttacgctggaattttgttttgcttgctgaagttaaaacaagcaaaatttgtaacttaaggtaatagaaaattaatatggtaaaatgtcagattataatgtggacacttaatatgttagttattaaggaatttaaaaaagagactaagatggatgagacagaaaaaacttcctaaatttcaaaaatagataattttaaagaatagattagacatattgtttttacgttatgggtaaatttcccagaaaaagaaattaaaaaaagcacaactgattcataatgagccaaccccttttagggcatagctcttgctacccttttaatttgtggcctataaattttagcccctatcaactctgacagttactaggtaagtactcttttcatttagccaatagctctgtattgatatctaatattaagataacaaatagatcttgattcaaagctagtcttacatagccttgttatatcttaataagagcaggtaccatgactttgtcactatatatgaatgaatgaatgaatgacagaaaaaatgaatttcccagcagatgactatgttaatagaacatgagtaagccatttttttgttgctggatttgtattttataaactttagggaaagaagaataatatttagtttttttgtagtacttttactcttttaccaagcaagtttacttaccactttcgcctctaccagtgtctcccatgcactgaaacacatctgatacagaggagataataactgttggaggagtgaataagtgaatgattcctaccccattcacactattgtaaacaagaaaagctttttcaaaaccaaaatgtgttttgaaaaaacaaattccccataaaaccaaatacataagcataatactggtttctaagtactaagtcaagaaaaacgaacaaacactgaaggctgagaatctgatttttggcatcatgtttatactttttcaagggaatattctgtatagactttttaaagacaagggtttttaaaaattttatgggggagtctaacagtacagtgaagttagatgatttgtttgtgattaatagccggtgctagctggtgtcagacatgaattagaaacctggttgtttggttcccatgctgctgatctttgcaggattggttgccttctcactttgggccctgtcatatatgaattgagggtgggcaacagacagctcaggttcttcttcattactgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaatacgtatatatttagtgaggacctatttctgatttagaaaaaaattgattgtaatttctacaacattgaaacagtgtctagaagaatcctttccccacccccaaatagctgttactgacatgtccagaatattgcacctaagaatgaattgacctatgacatattaaggataaattttttaaaaaattaagtgaatattgcattgtttctatttaatttgatagcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaaaaccttacggcttccagtataccactttgtaggtagcagattgtctgtgtattttgatgtctctgccctttttctctatttactatttaaacaaacaggctttactcttacagagacaaagttagcaaaagtaccccattgtttttcaggtttcttctacattcccaaagctgtaaccttattttgtttttctaaaatttaatgtagttctaactgttgacaaagctagttgtgacactggccaacattttctttattgagagttgatgaatgacagccatgtctgaaatctccagtcagactcctcctgatataaagataaatgtgaaatattagaactggaagtattttagcagctttcactacatcgaagctattttttgtcacttttatttggggatatggaatgttcacataaattctattttaaagatgtttaagttttttaaaaatatcctcttcacttaccaccatagatgaggagcctacctattctagaaagaaaaattgtctctaattcttaatttattatgttttctcatgtgagattagtagtttcattactagttttgagccgatggtacatttctcctgagagatacccagggagtgaagtggactttgttagtaacctttgctacttgccctgcagacaaggagaacttagggagacaattcatcaccctaaagggaagcagaggagagggctgacatcacaattgtctatgaaatcttgatcattttaagcagcattgaaaattttgttggaaatggttttattaaaaatgttctgcataattgtgacatttaaagagaaaacagtttgtatcttctaagttaagaaaggtaaaagtgacagcagttttgaagaagaaggaattgagcattttctgtgtgatgaaaactttttgtgccaacagtcataaaatagggatcttattttctccattaaatagattagaaaaagggagctaaaaatgttttggtaacttactgccaagatcacataactgttaagttagagctgagattaaaatcgaaccttcctttctcaagtccatggtttacactgttaagccttgatgctcgtagcagaataggaaagaaataacatttcatgctcttttcttctttctaaaacatgttacattttttcttgcctctggcactcattcctaggcttgtcatatcactgactttttcgcatcctttaggccttggttctaattaatgtcaaccccagagaggcttttcatagccattatatggaaagcacctcccaattacatcatcctatttattttctccttaacagtcttagtacctgtaaatactttatttttatgtctctcccactataaactctatgtataaaggacagggacctgtcattttcctttttgttcaaagttttgtttcatagaatagtacttggcatatattagtatagtaggcagctattggttcaatggatgaatacaactttttatatattctggcatccttttaagtaatagagacaagtactatttcctcaaagaatgtttaaaataaataattaaaaatttaccttcagttttaaatttgaattgttactgtggcaggcaaaagttattttaaagaaataagttatatataaatttctctgaaaattattgaaaattcttattgaaatggtgttttactgagatgacatttgtaattttgtatcttgcaaaatgcaagataatctttcattattcatataggattcatttctgcaagcatagcttaatgattcagttattaacttcattgtatatcttaccccaaagaaactaatctctgatatttgggatgtatggggtttttttggggtgtgtgcataaaatagatactctctggatcttgtccataacatgcataggaatcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagtcatcttacttgcttttgggtaataaattacttttatgattagtgtttgattactaaaatcttaatgttttgaaatgtctactttcctaaaactacagccaaaaaagcctgtatataaagtgctttgctatactgttgaacaaggtagcattgttattgaaccccatgggaaaaaaggagtgctgttttgggtgtctataaaaacgaaccaaacttcttccctggagtattctgactgctgttgctatgtgctcatgggcctatgccatgtggctcttttcagatttgtatcagcaagtcagaagttaggaggcagctctactgatccatgagagaaaaaacaatattgaagctgatgaatgagttttatatttctgtacttgaaaatatttagttaaattactgtgcaaaataatgtctgattatctgtaggttaattcttatctacaaacatcagatttttaaaaagaagattgtgaactacttttgtttacatggaattgctaatactaattacctaaatgaaataaatttataaaggaaaaccaaatacttcattgcaaagtcaagaataagtaatattcaaaaaaattttaattcataagatattctgtagttgagtgaataatcaggagttaacttatccatttgtgaagaacttagattttatttcgttttctgttctattttagattattatctctttatatcgtatggtaactctaccttacagtgttagttgttcttaaaaatttggagcttatagactctttggagaatctgacaaaagctgggcaaccctcccagataaatatgtaggccaatatgggcacaaataattatgccattgtaatccacttaataaaaaagctccactttgggcaaggctgtgtgtgtgtggtgtgtgtgtgtgtgtgtgtgtgtgtgtgtgtgtgataaaaattattttccttttacattgaagaggttttattgttaaaatccgtgccactgctatgtgctaggcattgcagtaggcagtgctaatactgttgaaacaaaactactcaaagttcttgcctccatggaacttacacttggttaagatgttgcggagacatgcattgactaaattacaaatagggtatgttctacaaaggtggttgctttgtgtggtggctactttcatttttgtcctcctgtttttccatttattccccatagcttagcaaagtgaactttgtgaaatataaattggatcacttttcctatcaaaaactctcagtggcctcagtaggcacacaactctaagcagtttggccctggatcctctctccagcttgccatggagctacccttcggtaagctctcctgggttcagccatactgatcttattttagttcctttaaacgtttcagtgtctttatacatctatagtttctttgcctaggatcgttgtctcctcctcttcttatgataacttcttttttagaacgacatgtaatttttcctatctcagagaagctacctgcccaattaaaacacccttctcccctacaacattcatacctacaaaactctgttaactttgcttcttctttagcacttattacaaacatgaacctgtttatctattttacatcttttttggggggaaaggtccctgttatttgcactagaatgttggctctatctgggcaggaatactgtttttgttttactcagccactcacaggtaggatactgtccgtatttagtaaccaaagatgcattggaatgtgtaatgtggatattcatactgcatataaagtatatgcaggggatttgaaaggatgttgtgagagcagtagaataaatgatcaatatgtggattatcttgctacagtagagatggtgtaaagaaaatagtttagagatgaaacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctccccccacccccaacaggccctgttgtgtgatgttccccatcctgtgtccaagtgttctcactgttcagttcccatctatgagtgagaacatgcggtgtttggttttctgtccttgtgacagtttgctgagaatgatggtttccagcttcgtccatgtccctacaaaggacatgaactcatccttttttatggctgcatagtattccatggtgtatatgtgccacattttcttaatccagtctatcattgatggacatttgggttggctccaagtctttgctgtagtgaatagtgctgcaataaacatatgtatgcatgtgtctttatagcagcatgatttataatcctttgggtgtatacccagtaatgggatagcggggtcaaatggtatttctagttctagatccttgaggaatcgccacactgtcttccacaatggttgaactagtttacagtcccaccagcagtgtaaaagtgatcctatttctccacatcctctccagcacctgttgtttcctgactttataatgatcgccattctaagtggtatgagatgatatctcattgtggttttgatttgcatttctctgatgaccgatgatgatgagcattttttcatgtgtctgttggctgcataaatgtcttcttttgagaagtgtctgttcatatcctttgcccactttttgatggggttgtttgattttttcttgtaaatttaagttctttgtagattctggatattagtcctttgtcagatgggtagattgcaaaaattttctcccattctgtaggttgcctgttcactctgatggtagtttcttttgcagtgcagaagctctttagtttaattagatcccatttgtcaattttggctttttttgctattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaaagggatccagtttcagctttctacatatggctagccagttttcccagcaccatttattaaatagggaatcttttctccatttcttgtttttgtcaggtttgtcaaagatcagatggttgtagatgtgtggtattatttctgagggctctgttctgttccattggtctatatctgttttggtaccagtaccatgctgttttggtaactgtagccttgtagtgtggtttgaagtcaggtagcgtgatgcctccagctttgttcttttggcttaggattgaagacactgtttttattgtctagtcaaatggtaaacataagtgactacattattgctggaagatgaaaaataaaactatactttacagttcacatatttcaacaggtgatacctcatttctcattgattttaggtattgtcactagacaaattagtctctctgataaccagagagagattaatcaagtgttggtgcttactggacttttgtgtttcagtttggctgttgtaatactcacatgtcagactaagtagaaggaggcatatgcccttggaaattattttaattattttagatcattttttctaaaaagtcattgccaagagaggacacttagctatacatatctacatggatatttttctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctatgaatattatcataatctttgaatagagaatgaggtcaattaaggtgtaatcacttgattcttagtcccaccctgcatatggaaatatctaattcttaccaacaaacacatccaaagtgccaaagttgctgaaaataatttgatttattttagttaagcattaataaagtattgaaatttactattgactcatattccttctgatggttgaaagatgaaaaatgtacaaaggtctctaattatatatgtaggtaaaaaagatggagtgtgataaatatttgtcagtaagtatttaactccagatttctatgtaatgtttagggagttttatcctaaaaatgtgtaaagagtttcttagatcttttcccactcataaactttcaaaatcacaaaatcatgatttgttttggttgggtagctactccaacattctttcttcacattcttccgtggcattgaaaacttgccatttcagtcttcatggctccctttggaaacaacttaattatgtgaaattgtcatgtagctttaagcccttctgaagatcataggtcaagctgaaaattaaaggggacccttgctttatagtgtcagttgtaccttttggaaccttggcagaatattgattaaacattttaccaataagtttcagattgatttacatattgtgtaaaatttatcaaaagtaacagtcaacatctgatggaattatgaagttgatgggattatgaaggtaactagaggtacctgcctcttttcctcttaatgaaattagtcataaattaaattgttactgaaacttaaaaccaagataaagctgaaagtgtatccttgagtttttctgaaatgtttctccacttgctttcttcctgatctgagttttctttctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacacttgccttttatttgtagcttgatatgtagtctgtccttttgttattgtttttggagggggcttagggtttatgtgtgacttaggtgctgctgtgaaatggagagcatcacctatatctggcatttgcatttttgtaatattgttttcaaaatgttccagagaggtacattttcttccaccccgtctctctaatgcacagttaacagtatgtccttcacttgaactttctcccttgtaaatcaattatgcatttgctatagtagttcagctttttaaagtgcataaggagaatactgtataaaaagtgcttgtaaaacaagtctttttctaagagtctagaccttgagaattatgtttttgtttttcaataaatggttaaggtattgtaaaaagttggacattttaccagagttaccatatttgagctaatttttagaatattttttaaagagttaagttatagtgctttccacgcaagactttatatgaaataaatacattaagaatgtagagtttttgatgccttgtcaaaagtggaattaaggttggttttattatatgctttgaatgtgtttctgaaatattttttgaagcggatacttgtaagttaaataccttttatcatttatttttatcataattttatatatactctgtcagggaataatatttaagaatcccaacatttgtttttatggtatatctttacattgtaatctgtagtattttaatttcctataaacctcttaataatactagacaatatgtgaccttttacactcattcatatgtgctataaaattactttttcctttgattctattaaatcctttcagaccactagagaaatccctgatttgtacttaacagaggttttcatgtattaacaagtagagttacctggctatcaataagtacttgtttaactagagtgactaagttaaagacttgtagaagttaggactttctgaagctaataatccaacaccctaatttgtgactcgagggatcagatgcacagtagttcaagacttgatgtttttgttcagggtaaggtagtaatttagtgacagaatccagataactcaaatcctcagactagagaaaaattattaagatttcttgacatttattgttattccctacctttagcttttacacagctaaatctacttgtggaagttcagcttcaaaaagttttagccatagtttcaaagctgttgactgtggttgaggtttattaacaaccttggttttctaatgtagtggaattcaaagtagatcaaattccttccctgagccaggattctctgagtgctcttcttaaccactcctgcccaaccgctcattctacaatattgagccttaactcctgttcctgtctcctggccatcctttttaatagttttgtattaaattgtccatgatcaacaacattttgttttaatagatattctcacttcaaggtggcataaaatagtatatatttctcaggattgactttcccaattaagagtatttgccttcatctctgtgcattaaaatttattgctgcaattgacatgactaaggtggcataacagtgctgtgagcataatctagagctagtctgaataagtctgaatcatagctcttctgttcatgaccttgggccacttaccctttctgtgctttgttttacatatctttaaaatgaggattaaaatattactattaggattaaagtaattataatattattcataaagtactgagaatcttgcctgatatatatagtaagatgctacatcagtgttaaatcatagaaggagccagtaaattgtttcagtattttaatgtgtgtacttgaggttctggagatattccaagaacaacacacattcctagtttgacctgaatgaaccaggaatatttaaatacatagcatttatttttagagccacattttactgaaactaaacctaggaacaatacgtggctttttttggggaggggggaggttgttgtttgctttaagaaccttgctttgttaaaaaaaaagcctaacttgcctttttgggaaggcaagttagacgtagaccttaaaagaaatctagctactgccatttataggtggttatatggataccttacctttagaagttattgagtgtgacttatctgcttaatagcgattaaatccgtttaaaatgtttaccaggtgttaatcataagtcaaggttgacatagccagttaaatcttatttgaaagaaagaaaaatctctgtaaatcatgtttacagattttttaaaaactggctggcaatgtttattataaaaatccataattttccatttgtttgctatattagaatactatgcagttgtaatgaataaacatttatagtttctgctcctaaaaattggactacagtttcgtgagtttagtctcatctggtaagctttccaagagattcagggaagccatagctttccaagtatgcaaatctcttacattcaaagcacttccctcaggcacaagaagactatttcagtggcatgctttgctcttttcccttaacatatctaacatgaggaacatagataggggacagcctatctatgtttgaatagatgttgaagaaattatatgagaagaattgatagaaagttttatttttaattgtttgctttgtaatatatttatttggtgactgtaaaaagtagatttcagaagatttatttatactatcaatgcatgttttaaaattattcgtttgagttgtaaataattaatgaaaaaggcattttatgtggcactgaatcaacctgttagtttcagttgttcaccctggatttctttcatttaatcgtcttcttcttactgcaaaggaggacatttattcattactttgcccaaataatactaacacactagcagatggtcactttccaactggtttgtcttcagaaaagaaattaaaatattatagtgccagagagagatgttgtaatgtgtccctttcaaattaacaggtcattcttttcaactattttgtaactgtaaaatagctcaatgtcacataaaaggctaaaagctagagtaaatggtgtcatgggaaacatgaaataaacacagtgtaatggtttatagtcttgtcttgaacacactaagaatatttcttttctaaaaagacacaaattatatgctacggtagtattttggttttactggattctagtttaattagttcatatcaaaagttagcacttgttttaaaacgtgtatacattctgaaagaagatacttcccccaaaacatttaaaaataccttgaatatattcttaaacaaatatgttagcctagcaaacaatgaaatgaaaaccaaatatgaaaataatgtatcttcttcctttaccccttcaatgaatgatctgtaactctgataaaaagattagtttagagattattgaattattttaatactaggaccagactgaaagtaacattgtgcatttagaaatgcaacatataaatgagtagaattggagccccacatgattgggaaataagctggagaaactgaagtatgcttaaaacacagagtaattagcgagcaagctcaggaaaaaaaaaatctcagaatacttagaagtagtgtttgaggaactagaatcatcacagtttaaattatttgttttgacctttctctgccactgaattgctgtgtatctttgggcagtcacttagatcatttccttgactagaacagtagcaagttggcttagacaactcttaagccctttttttaaagtgttatagctatttggttggtgatgaattacttaacccagaatttaaaaaaaaaaaaaacaacttaaaatgcatttgcctaagtgagccaggtagatttataatgagaaagaaagaagtttttataatattatttattcttcttctgaaaaaaatcaagtgataatagaaacccaaatacaaaataactgaattcgatttgcattcctcctaattactagcactgtgaacaaaaacaggtcgtttaaatatgttgtatgggcttggtgcagtggctcacacctgtaatcctagcactttgggaggccgaggcgggctgatcacttgaggccaggagtcctgaggccaggagtttgagaccagcctggccaatgtggtgaaaccctgtctctattaaaattacaaaaattagccgggcttgttggcacgcacctgtaatccctgctactcaggtggctgaggcatgagaatcacttgaatcctggaggtggaggttgcagtgagccaagatcttgtcactgtgctccaatctaggcgatagagtgagacattgtatctaaataaataaataaataagttgtattttggatcctcaataaataagttgtattttggatcctcatccgaacaatggaaattataatttttctggttatctcactgtgtctaaagcgatgtcctactgtgttgcctttttcaaagagtgatcatttgactattcctataagagcccttattggaatgctttctagcatattatttgcctcagatactccatctgtgtggggagttctttctcaaatagttggacactttctgtctttttaagggtaaaatatatgagacagccttttctaatttgtacagagatgaaaaattaagtcagccttaagttctttcttaactgagagtttttcttagaaagtaattttaagatattgatgcaggttattttcctccttagcttaacaaggttcaggttcttgtctcagtaccaggaagaagtaggcatgcggacacttgaagagtgagtggtgtagattttattaagcgaaaggaaagctctcagcaaagagaggggtcctgaaaccaggttgccgggttctccctttacagttgaattcgagggcttctatatctgcttgatggggctgggttttctatttgtataaggcatgaatttcttctccctcccaccgccccccgccccattccgtccagtgcacacgcgggcccttagtctgagccattccacattgatttatttcccttactgtgcatgtgttaagggacagaatttttcaccacgggcatgtttaggcaagccccctgtgcacaatgacattggtgggttggatgttgtcctgggacccttccctatctgcctaggcatttggctgtctcctgcctctatcaatatctttttgtccttccctctcaaatccctactttaaccagcgaagtggaatatttgtcttaaacattgtggtgttattactcatcccaccccatttcttcctatatttgtttgaaatgccagtatactcatattgcataatataggataaacaggtttatatgtggaagtgtgaaattatatattgttatgaatggtaggggaattggtagatctgggactcaaaatgattgctagaactttatatatatatatttttggtaaggcattaattcactgagtacttcaaatattttattttatttttgagacggagtcttgctctgtcacccaggctggagtgcagtggcgcgatcttggctcactgcaagctccacctcccgggctcacgccattctcctgcctcagcctcccgagtagctgagactacaggagcccgccgccacgcccggctaattttttgtagtttttagtagaaacggggtttcaccatgttagccaggatggtctcgatctcctgacctcgtgatccaccagcctcggcatcccaaagtgctgggattacaggcgtgagccaccaagcctggtcgtacttcaaatattagtcccatgttcatgtttgaaattgtttaatcaaaagttgttacaaatagtactgaaaaaggaaagaaacctgcccttgtgattgttcttgctcatggttatcctctctgttctgtctgttcatcctgccagggtaagctgagatctcccttcctccataatgtattttacagctccagttctcattagtctttactctgagttcctacaccgcttacagtatgcaccacataattgagtatttacttatatatccttccgtgtatggattggtgatgtttcatctgtttctttgcttcccctgtagacctcagactatacaaggtgaagacaatattttgtttaatctttccctaaatgttcctaagaatgtgttagagcacctaagtggtgctcagtgaatactagattgatttgtttttttccttttctccatttcctttcactgagtgtgaaaattgctagaaatcacacaccatcccccctttttttcctgagtctatctttttaatgggcctctcttctttcctggtatgccaagatagatgtactacaaaagtctgtatatagaatttgtacaatttgtttcttgattttaagtatatgaagaaaaacgtggacatagagaaatgatgattcataatatgttctaattagaaatgtgaaagttggttaaacattaaaaaatcagcttggtgttacagatgtgttttttttccctttcttaattgtttgaagtttgcagaatttactgttttctaccgtaactaagagatatgctttctggcagacctattgaagaatttggtttatgccaaatatactactaataatttaaatgtcccacatagttaggatcttttggtattcatcagagtaaaaattaattttatcttaaaaactagagtaaaaaacctttttttaaacagtaaaaaatctgctttctgcaaactgtgtccagataaccagagctgtttagctggataatgaaacagtaaatgtgaaagcaatttgaagaacatacacattaacattatggttagaagagtgagggatggaatgccttttgtatccatgacatatttcaaacagaaaaatatgcaatctgttttcatagttcataagatgctccacaatcccctctcaaccagttctggtagataattaagacctaacacatttattgtatgtaatgaataatttctctaatgcatctagaattcaacagaattgggaaatagccctcaaataattttatgtggggctttattttcttgtggaaccctagttgagaaaggctatgcaatctcttttaacctctatttgaacagaatcttattttgtcacgtatatgtttgaagaccttaacccttctagattatttttacttgacccaattacttagtggttaagaatgtattgcctatacaatacagtccaaatctggttggccctatttgttttctaaagttttaaatgtagctatgttttattgacagcatttttgctacttaattatgtcttttcttgacagctcaaactatctctgtttactcttatttagaatgcagctggcaacagcagttggtttgtgaaacccaggcatataattaacttccccagttaaggtatggtttgtttcattggaagagaaagaattttgggggtatgtttctttagtctgagaagtaatgcagtttattttcagtatggtatattttatgtgacagaacataagcagagaattttttaaaaaattataacattctaacattacttgagcactaaagtgctacaaaaaatactttgttattatttgaaccacgaaaatcagatattagcattcagcgtaaatgtcaaattaacacaggccagtaggaacatttgtgatcatgttcttctcacatctacttgcatggataatgaagctttgactattgctttgatgtagatttttggaggaaatcctcctcctatttccaagacactttgtagttactaattctaagagagtataagcgaatccatttatttaaaataaaataaaaatggggggaaagatatttaagcaataaatttcataccatgagattttttatatcctggttactttaaaacccagtaagctgccctgggttctctcctgatactgcacagaacttttgttttacatcctcgtcttcctattattagttcaactatattgtttttctctttccagcactctatctggatttttgtaattattactgtcttcctattactagttcaactatattgtttttctctttctagcactctatctggatttttgtaattattactgtcttcctttatcagttttaaaagttaagatatgtggtatttttgagatcagaattgtagccattatattgatgtgctgcagatattaagagaaaaagtccttagttgccagctttttgtatactcaagtgttatggattcttaagaataaatgtttctttgttttcatatgaaattgtcttttttttttttttaggatacatgtcttactttgtcacccagtctagagtgcagtggtttggttcccttcagccttgatctcctgggctcaagtgatcctcccccctcagcccccagaatagccgggactttaggcatgtgcgacaactcccaactaacttttgtactttttgtagagacggggttttgccacattacccaggctggtcttgaactcctgagctcaagctttgtaatcccaaagtactggaattacaggcacgagccaccgcgcccatcccaaactgccttcctttttgcccagcccatgagaacaacctgtgctagtgaatgatttttaaagaatcttgctacttttttctgcctgggattatgtgttgactgaatatagtttcctaagagatactgttgatttttttaaactaaacgtctaccagactttctgctctgttgttccaaaattggacaatttcctgcctggtattttatttttaagttgaaaatgggaaaattgctaatgatgttgaaagcaaaaatggtattgaatgctttctgactaaacatatattgaacaaagcaaaacactatgtatctgctctttcatataacattcggaaactcttgtgacataatcagggctattttctgtataagatggggaggtaggcttataaatatgctacgtaagtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaattatggcagaggcaaagtagttactttgacaaccagattgaggattcattgcgatttattatttactacttgaaaatctcactctgatttaattaagggttgagatttccatgaagtctgtcttttctaaatttgagcaccctgttactgttgtttatgtgtgcactgaaataatctcaaactgatgttactccaaaactgtgacgaattaggcttaacatgtagttttttgaaaatttagacaggtcagataacagttaactgaaattaactggatcttatattgggcgatggtaatcaatgcttactagtaacttagtaacattgactccctgggtatcttcaaagcagcctggttgtaataagtgaattttatcttttttgttgaaagcagctttaaataatttatacctgatttgtatttcagtgtatcattttagatatacacgttatttctttgcagttacttaatggtacacttttttgggtggggagacaaagtcttgcttttgtcaccaggctggagtgcagtggtgcgatctcagctcactgcaatctctgcctcccaggttcaagcgattcccctgcctcagcctcccaagtacctgggactacaggcatgcaccaccacacccggctaattttttgtgttttagtagagacagggtttcaccatgttggccaggaaagtttcgatctcctgacctcgtgatctgcccgtctcggcttcccaaagtgctgggattacaggcatgagccaccatgcccagctggtacaccttttatattgcccaaattatagtctataaaatgtgattgtaatcagataattcttggccagaaaacgaaagttcaccttcttagagtgagttaaccattaggtaattttgtattttatgtttttttcttcccaagtattcctgaaatgctttttacctttgcagatgtaactcagttgactacttattcagcattaattaataataaaatatgataggcttttcaacctatgatttttatttaaacaaaacctttcaaataaaaataattttaaacctgtatttgatttctatttaaaatggagtgttttcatatactcttttaaattaaaatagtgtctgcttagctcgtttacattctttctgtcagaatgtctgcctcaggattctatatataattaatgtaagaaaaacaagagggtaatcccttggtagaaaactggtaatggattaaaagaccatagctctgaaattccagtaatgtgacacattttctctgaaagatgcacttaggcccgatatctagagatattaaaaagtgccccctattttaattagctaaagatagacattcctaatatattttgttgtatgtttaatatggaatattataagtaaattcatacactgatactaaatacgatttgagaagaattactgctttggtgagaagagagctttgagtgtcacttgaagcttcaaatttcttactgaaccaattgataaaatgtacaaaatgtgtattgagaatgtgcagaacagccacccaggtagtttgatcagtgtctttctacatagtgcctaacatgaactagtttaagaaacttgaggaatccacataactatccttggttccaattttttaattaaaaagtttagactagagcagtgcttttcaaattgtgatttccaacccattatcagtttgtaagcacagtatttagtgggttacaatcatcacttatgaaagagagcaaatatcagagcacagtttatataatgagtattatttcatgaaatttgcattaattatatgttcatatcttaagggtacattgttttgatataacatgtcatacttaaggaatgcagtaaaaatatataaaaggaaacaccgggctgcatgatcctaaaaatctctcccagttccaacattcccgagtgaaattttaaacatgtagctcttccttaagtagcattatatcattatgttatttcaatagaatttgtcacatgcagatgcattttgggagaaaaagaggagaaaggtgcaagacttgatattctgagagactaatacctatataaattgtaattattcctaattgctatgtgtgataatttaggcctgcacaaaattgctgagagcatatcaaacaaatgattagttctcattgtcaggcccagaaaatacctcgtgactaatattagagtacatcctttaaagatgagtatgatttcattcatttgggatagagaattcagggaaagagtctggatactttggctgtggctagacagtcaagcggccttctatgccatacttaggcatttggaatttatcttaaaagaccagggaaagctgtcaaacccattcagcctgctaggattagctctccttttagaacgatgaaagtagtaatgtgattgttgaactcaagtagagaaaaattcaaggtatggagacaataagttacaagaatttcagaaggtcagctataaacgtagaaactcctcttttgataaagagtgaaatacaactctttatcaaaagcttgacagtgctcatacaacatacgaattgagtttcactttagtattttggaaatactggaacagctttcagtacctttgcaaaatgcccaagtaaatgtatgtgaaatgttgaaagacttaaatgagtccggcatataggaaaaccttgttttattgagctttgtagatattgcattgtttttttattttatttatttatttttttgagatggagtcttgctctgtaacccaggctggagcgcagtggtgcaatctcgctcactgcaagctctgcctcctgggttcacgccattctcccgcctcagcctcccgagtagctaggactacaggcgcccgccaccgcgcccggctaattttgtttttgtatttttagtagagacggggtttcaccttggcaccttagtagacccaggatgttctcgatctcctgacctcgtgatctgccccccttggcctcccaaagtgctgggattacaagtgtgaaccactgcgcccggcctgctttttttataaattgaaggtttatggaaaccttgtttcccacaagtcttatcagcaccatttttccagcagtatgtgctcacttcatgtgtctgtgtcacattttgttaattcccacaatatttcaagtttttctattatatctgttatggtgatctgtaatcagtgatctttgatattattataactatttgatgtgtattattgtaattggagtgccatgaatcatgcccattccagacgatgaacttaaggaatattaggttttctgactgctccaccaactggcccttccctgtctctccccctctcatcaggcctccctattccctgagacacaaaaattttgaaattaaccaattaataatcctacaacggcctatatatgttcaagtgaaatgaaaagttgcacatttcttcatattaaatcaaaagatagaaatgattaagcttagtgaggaaggcatatcaaaagcttagacagaacgaaatctcggcctcttgtgccagttagccaagtcgtgaatgcaaggaaaaagttcttgaagtaaattaaaagtgctacttcagtgaacacatagatgataagaaagtgaaacagcttttgttgcttatatggagaaagttttagtggtctggagagaagatcaaaccagtctcaagattctcttaagccaaagcataatccagagcaaggccccaactgtcttcaattctatgaacgctgagaggtgaggaagatgtggaggaaagtttacagttaccagaggttagctcatggggctgaaggaaagaagccattgttcccataacatagaagtgggaggtaaagcagcaagtgttgatatagaagctgcagcaagttatgcagaagatctagctaagatcattgatggaggtggctacactaaacaacagattttaaatatagacaaaacagccttctgttggaagaagatgccctctagactcttcatagctgaagagaagtcagtgtctggcttcagagtttcaaaggacagactgtcttgttaggggctaatgcagctggtgactttaagttgaagctaatattcatttaccatttcaaaaatccttgggccattaggaattatgttaagtctgaggaatacagatgtacccacccttctctttgcctttttatcaagactcagtgtacaaggattgtatgtgtgggtcacctcggtctcctctgctttaatgctcctcatctctggcaataaattacttctctttgaaaaacttaacatttattaatgtgaattttgggatcttatgcacataatttatacgagcactaacttgtcatcctgtctctgaattgaatcttttgatagtttcctgatatagtttatgctgtgtcttctgttagaggaggctttaaaaggagggagctcttgatccctataggagaagcagagcagatagaagggcattccaagtggggagaatactgtgaagaacgctacaaagacaggaattcacataccagattttatatagtgaatatttaagactcaattccatagtgtaaacagattaactttgttatttaaataaattatatggaaaaaattaattttggaattttctactatagcagcttggtgccacaggtaccatttgtttcttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaatttattgctattttgagatcagatttacccatattttcttgttagtattattgttattctaacactgaaattattaacgcatttatgtttggaggtcttttgtaactagaacttagtcctttgcagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagctctttaagggatagaacaaggattccaagccaagtcagttaactccttgtccggaattacttttcactgtaaaatagttacccattttagaattaaacacttcagatttaagtagtttgatctcaataatatctgtacagattaaattaatatcttagggggaagtaatacttaagaggagcatttaaaaaatgtagttattgacctaattatttccccacccaccacactccctgtaggattttcataagcagagaattatattctaagattgtgttcttatttcattagcactgtgataagccataagaattgtgttttactatctttaatctgttctactccatatcaaaacattcattgacaagaggagattgtagtctattcactgattttgtccaaaccagttggaatagtggtcagcaactgtcttccataaatggctagatggtaaattttttagactttgtaggccaaatttaagggtgttgtatagatatttatataatgagagaaatgaatatccaacacatttattgacaattttcagatcttattacttgacactgacaatttcatacatttttatgtgtcatgaaatattgttcttttgattttgtttgaacattaaaaaatgtaaatggaccatgggaacactagtagtccaacccttatttagaagggactgttgtgggtatctggtagatcagatttgaattccatttgtaaaacatttgagtatttactttataataatattaaatataaattaacatcacagttttctgaggaaactgaagttcatttgtaaagaaacttcttcaagttttgccaagtcagtaaatggcagaactagaattcaaaaccttatctatttttcagtgcctgggttctttcatgtgttcattgttacatcttctgtgccaggcatggagataggcacagtgcatactggcatgaattagatgagttcctgcttctacatagtccttagtcatgatgctgcacagatttgggaaatgtaattttctaaaacctgcctgtcattataaatcagattcatctacacttactctcattttctgataaaaagtatttgcttgtttttgtgacttatcaatcctgtcttgtatttttctttttttcttgaatagtacaggaacttttttatctggtaacattcagcttcttaaggatgaaattaaaactatttgaggttgtaaggggaataaacatttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgattagttgttcccacaagctctgtatatcttttggaaatctatctttatatctgtgagataaaaataatcttcagttattaaaaaagagtcatctgtgttagtagtgacaatgtatattttagaaatttcatgtatgtagcatcattgagaatcaaatatgaaacattgtttaaaggaaaaagagtagaaattaaaaaaaaactttgattgtataagttattttttgagatgagaaattatttcaatatgttttttttttctctagaaacctgttggaaaatgccttgttactccagcagaaaagcatgtctattattaccaatagaattagtgtgttcagaaaaagaaaaggcttaatttacagccttttgaagttttagggaaaattccttttttaaagcatgcaggaggaaagacatgacatcacagccttaagtgggtaaaaggttacatggctgatactttttaagtgattgaattattagcatgggtaataatttgtggaaggtgaagaggtgccactagtttcagtgtgttaatcttccccacttaaagtgagaaataaatacctcataagaatatatatggggatatagtgtctttcctttctaagacacttgcttgagtcagcagtggttgcgtgtggtcacctttggattagtcttcggattcagagaaatgagtgggtggtttcagtgcagtttcaatgttgttaacccaaataagttctagagttggtattaattggcccccttatagaaacctttgaggaggaagctgttgttacacaggtaactttatacctttagagtttattgttgcctagtaaaaattaatatggaaatataataaaaattggtagggaactctttcattcatctacattgtggtcactcatgtgattcaatttaaatgtatcttttttttttttttttttttttgagatggagtttcactcttgttgcccaggctggagtgcagtggtgcagtctcggctcactacaacctccgccacctgggttcaagcgtttctcctgcctcagcctcctgagtaactgggattataggtgcccacagctagctaatttttttgtatttttagtagagacggggtttcaccatgttggccaggctggtctcaaactcctgacctcaggtgatccacctgcctcggcctcccaaagtgctgggattacaggcgtgagccaccgccccagacctgaaagtacctttttaaaaaggaaattttggttaagagttttttttgtgttagtgctttaaaaaaattgcttatatttaaatacaacaacgtattaactaaaaagacttaaaatccaaatttttactctgtttgatctgggaaacctgcctgggaaatacttaaaatgaagtctccaccctaatgagttttagcatcagtgacaaaaaaggagtggaaacctttacctagcaatgttggagtgactcactggatatgggaacaaatagctcatttctgcatttttgcttcttatttaattatttttaagaataaatacatactcaggctggatggaggtgggagtgaattaatgaaatttctaataacaaaaggatagtaaaaattataagagattacattaaataacatagagttggaaataaattatacctgcggagatgatgaaattgtcgtttacttattctgtaattgtttgctagtttctttgttgacagtgaatacattatacagagttacttaagaattttaatttgctaggacaatgcgaatgacttcagatattaaatttttgttagaaacttattgatgttaaactggttttaactagttataaaaaaaaataataattgtaaagagtatttcctgtttccctgtgagggtgggagggggacggagactctggaatgattttgaactctagcaggtcgtcagtcatttaagagcatattttcatagttgagtcccactgattaggggactctgatgaaaatgtcatctttgtcctgtttgtattctttatctcttgatatctggatttttgaaaaaacattttctgatgatgttcatgtcttaaatttataaactcaaaactttaatatatatataaaagttaaaactgtggtctttttgtttcttttcctcttaaaacaacttttatgttcttgagtatgtttaacatcttctggtacataagaattatagtaataaataaagcataaagtaaaataaagtaaaaataaaatgcctactgtgtccctgaataactaatattcagtttttgttgaaaagctcagagtccagtaaggaggtaatataagtacaaagacccttagaatgtgttacctgctctgatagaggagctcataattgttcattcattcatatatccatttatttaacatctttattttgtcactccataaagaacaccgtaaattggtcctttcctacgttttggcattatagtagtgaaccagataaatgacacttgtcctgaaggaggtctcatcccccatgtttgttactcaggaacagggattattgtatttttgttcctagtatcccaagtgtctagaagagtgctaggcacatagtagttactcagtagatgttaattggaggaaacaaaacaaatgacccaaacctaagctcaggttctcctttccctgttttcaagacctggtgtcttgaactgggttttgaagagtaattgttgcctaacagaaaaatgagtggaacatcctgtgcggaggagatagtttaaacagaggcactgaataattgggtaatattgaagctcagtgtgaaagtcactttttttttttaagtaaatcggaattaaagtattctgcctttgtgaacttagaagttgtaactatatactgagactaatagcatctctttgtggcatatattatttttaatagatgtgcttatcaggaatttttttaagttaagtattaaacataatattttataactgaaatatgttttcatggtacttgtgaattattaattagtggtagataatttagaagtttttaggtaggagaaattaatttctttctagtaaggaatttaaccccacagtgtttttgactcataatgtgtactttctttttaaaatgtcaaaaggcttttcagaagtagtagtatttgaaactatcagctaatggttttctaaaagtatatttttaccttagagcatctagagtgtccagaattttgtgactcttagcaagtccccaagttgaaaatttttaccttgtagcttgcataattggatttaaatatgtattttcattatgcatgtatttgttagaaaatattggtgtatttcttagtgtaacactattttgtatttaagttgattttacttaagatttcaaataaactgttaacattcttcttagaaaaaatttttttgaagtacttcattatttaaaatatttccaaaataatcaacagcttatttagctgggcatggtggcatgagcctgcagtcctaactactctggggtgaggaagaggctgatttcgagcccatatgcttgagcctagaagcttggggctgcagtgaactatgattgtaccactgcactccagctggacaacagagtgagactctctccctaaagcagacaaacaaaaaaacagcttctaaaccaaaatgacacataaaactaaggcatatcacttatttggactgagttgatgattgtgtagttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcacaacaaaatgtactgtttgttgtcagagcagcatattttcttgcagaaatgcttataagtgatgccaaatttaatgatagaatttcaattctggtcttacaaattcccatccggtagcagtgcatctgtttattaggaattacccctgaatgtgaatgatttcagtcttaagttgctgcacctgttgccgggaggtatttattccgatcagtagcctaaagcagagagagttatatcttgacattttatagcttggggggaaaaactgtcttttcaaaatcatttgttcagagaggagaaaatggagcaaaacagttcattttactctaagcaccgctatttggtggtattcacatttgcacagcacaaagctgcaatattgattttttgctcacagagcctcccaccagttctctcttcaattgtcagggttgcaagatggattagattacattttgctggttgggatgcttatttttttgttgttgttgaaatagaaatagactgaaaatacggcttggaatgaatatcacagtaatagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaataaataaatgttttcaggaatgggtttttatgtcttttataagatttatttagtgaaaatgttgggttttaaaagttgatactaattgcaataattttattaaaggcttttcaaagttcctttaaagtagcattgttggtggaagaggttgagctatatcccttgaagttttcaggaaaatagtgtaaaatggtcaaagaaggcacaacaatttatatttttcttaaaaatgtgtgtaaactttttattttccatcagttgttttgccaagattaaggacatgcccgtgccacagcctcaggagctcctgacaacatgtgcccaaggcggttgggctacagcttggttttatacattttagggagacataagtcagaaatcagtacatgagtgatgttcattggttcagtttggaaaggtaagacaacccaaagggtagagttaggattccaggtaataggtagattcaaagatttcccgattggcaactggttgaaggggtttgtctattaataaagacccgaatcaatagaagaaagtgtctgggttaagataggggttgtgaggaccagggttcttattatgcagatgaagcctctaggtagcaggtattaagagagaatagattggaaatatttcttaccatatttaaagaggcagttctggccaaacgtggtggctcacacctgtaatcccagcattttaggaggccaaagtgggcagatcacctgaggtcaggagtttgagaccagcctggccaacatggcgaaacctcatctctactaaaaatacaaaaattagccggtcatggtggtgcgcacctgtggtcccatctactggggaggctgaagtggaagaatcacttgaacctggtgggtggaggttgcagtgagccaaaattgcaccactgcactcctgcactccagcctgggtgacagagcaagactccatctcagaaaacaaagggtggggggcagttctgtcagtcttaaggtctctgttttaatgttaaggatagtcagactgtgtcagaattccaatgaaaggaaagtacaatgaggcatgtctgaccacccattcccatcatggccacaactagagaacttttccataattgattcatgtttattttctcttttccactaagtcattgattaaaatagttaacctaggaagatgttttcctgtgatttgtgtgaactctgcttagtttgtcacatggacttttgaaaattattttgacagtacctcacaatctatatggatgtgcacagcacatccatgttaacaatgttgttatatttatattttaagaaaacagagcaagttgtttattaattatcgatcacttgaaatgttggaatagcatgtgtacttgattaaaaggagcttgcctgtttagacttacagattgaggaaattttataagactttgaaatggctttaattcttcagaaaaggttttaattaaaacccagagaagtaaaatgactttgcccaaagtcacaagactgacccatatactcatacttcagtgttcagtgctctttccatgtgtacctacagtatagcatttgctgtctttatatttatggtacacatgtttacatttctacaaatatgattttcactactattcatgtagttttgtgaacctttacaataattatttcttgtcagttttactaatatattctttggtgattttcagattgtatgaagacttataaaataaatcttgttattttatcagcaaaatggcttgagtagtcagagttgatcagagaagggttctggagtctaagctccctgcatgggttagaatctaacgtgtggtaagattgagaccctaaatttactactatttgatgccttagtttcatactctgtaaaattggtactataacagcaactattccattgtttattttttatgttgttgaacataaaacaaagtgatccatataaagcatttaagccagtgccagcacatagtaattgctttgcaagtaatacttatttctctcttcatatttgttttttaaagaatatatatatattcattatatatatatatacattatatatacacattatatatatacacattatatatacacattatatatatacacattatatatatatacacattttatatacacacacacacacacacacacacacacacacacatatttggttggaaatacagactttagataagagaaatgtataaatatgtaacccatctgtcttatgacaattccagtgatacatatataataataaattgacaatttaaatatttttttggtgggggagatggcatataattttcattgataagtagtttgccttgtttttaatgttcaccatttgttttcactaccaaaggaaatagacattacaaaggaaagcacattgcaatttatgttgtgttaatcactagtttaattcaacaatttggttccacatttataagaattatgtatcatgtgctattgtaggcattgagattataactaagagccttactacagtctagcagggtagatatatatatatactaaaagtgaatatgcactgtatcacatgttaataagcacattagtaaagattaatatatctgcatatataaagtttaatcaaaacaggtaagagaaagaatttagaaaagaacattaatgatttaaatcaaaatacattgtaggattaaataaagtggtatttgctattaagaactcttagtgcaatttctgttgctataggaaaatactcagactgggtaatttataaagaaaagagttttatttagcttatggttctggggttctggggtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactctaatcctgcaaactaacaacaacaacagttaaagggcttgggttttaaaaaccacagtgcttcataatcagttctatgttttgacaaaatagtaagaattgcgagtgtggctccaagccagtcttttaataatgtgttccaatattcctagcattttctaataatagatttattctgttttattatagaattgtaattgcaaattgcctctgtatttaaaataggttgcatttcaaaattttatttgatgtcgtttgtttgaattttcacatagcttttgccacagaaatgtgtcagcttctgaagccataaaaatattttctattaaaataaatatggtactactagtttaagctgaattatttgtatagatatttcagtacaaggtcaggagatggagaaaaaagcagagtgtgtgtgtgtgtgtgtgtgtgtgtgtgtgtgtgtgtgtacatataaaagtttatgaacttgttggggaagaaatatattttggaagtttggcctgtgtaccatttgtcctgacatttacccagctctgtttctgtatcccttctgcattagtagtgcacctctccacatgctacagtactctccatatactataaaccttgttagtgaaaacctaccaagtttggggtttgccacaatctcctgaagatttctgagttccaggttaggtattcttttcttccctcttcagtccagttacacctttagttttctctgaagaactgagagttcagccaggtttgaaaattgctgctttttaaaatcataccagtatgtcacccagtactgctttggaagaatatacttacatctcagaaaagatcatgttcaggtctttgaatttgttgagttggatgggagcagtgctagctcctttgaatgtccatctgctgattcctttcagtgtcagttttaaataaagggtatttaaatggaaataagttattgtgccataagcatcttattgtcataaatatcttagttattgtggggaaaaaactgctaagatgaaggtattttttaagataatgcaatagcaattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacagagtgtttctcaactgaagatactttgccccacagcagtacatttgttaacagtccatgaacccacattgacacataattatcacccaaagtccatagtttacaataggattggcttttggcgttgtacattttatgagttttgacaaatgtattcaccattgtagtatcatacagaataccttcatgtgccacataatgactactttttggttagtgatgaactgcgtgtaccatggtggttccatagatgctaatggatctgaactgttgcctagtgacctcttagccatcatcaagtcgtagtgtgacgcattatcttttctattttaaatgtgtttagatgtacagacacttaacattgtattataattgcctgtggaattcagtacaataatatgctattcaggttgtcgcctaggagcaatagactgtaccttatagtctaagtgtgtagtaggctatactatctcagtttgtttaaatactctcattgctgttcctgtaatgataaaataggctgacaatgcatatcccagaaagtatccctttgttaatgatgcataactagtttcactgccctaaaaatcctctgtccttggcctgttcatccctcttatcctcctaactactggtagccacagatattttccagattggcttatttcacttagtaatatgcttttacatttcctccatatcttttgttggcttgatagttcatttctttttagaatggaataatattcattgtctggatagacacagttgatccatgcacctacagaaggacatataggtagtttttaggttttgtcaattatggatagagctactgtaaacatcagtgtgcagtttcttgtgtgagtataagttttcagtttatttgggcaaataaagtacaattgctggattgtatagtatgagtatgtttagctcaaagtggctataccactttccatttctaccagcaatgaatagaagttcttatttctccacactcttgccagcattcagtgttgccagtgtttgaaatccattctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagttgccttttctttaaaatttagatgtaaggaaaattttgcccacgttcaaattcagtatcattcaaattcaagacagtataaaatttgacataattgtttgattgttggaggtactgtagtttgtattaaggtgttaaagatggttataaattggtgtttagccactttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaaaggtaaactcataatttctactttattgaatttgagcagttttttttcttcactgagccccagtttattatagaaagtagataatacatcattggttaattttgtgttttaaaaatggtgtgtttgagaatgtgttataaactttaaagctatataaatgatacctcttaactggactgttgccttcccacatataagtataatacagaaaactgctgagaatggatatcattttttctgtattagatacgagacacctaactcttggcacctttttttttttgttttaattgtggtactccgggcatctttattagaattttcctatatgtaagatagtataaataattattgcttatatagaataacttgtccttttttaaaaaaaaaacttaaaaatcccaaaaccctaatagtttagcagattttcccctttatatttctcaaaaaatgtgatattcagtcatgtagtgatgggagacatgtttatttctttaatgtagaaagtttgtctttgaaaagttcacattaaaacattagaatttttccattaaatttgaaagccccccttcctttttttttttacatgtgatgatagagatgggcatagaaatttcagtaccattaaaatatgttttcattgtattttgctcctcttgtgtttttcactccctttcttccatgttatctcttcagcagttgagaatcaagtaaataaatacacttgtaattcaggctgtggacatggtaaaaatattgtattcactctccattttctatttcctgttcatttaaaagtgtgaaactaaaggctctagtagtaactgattatagtatactgtcttaagtattctgagaggctcatcctaaaaagtgagaaatgaaatgctttcttaaaatgatatttgttttaatattttatagaacagtcaccatttagtactctttaaagataattgttggggggggcaacttaaaaatatataaaagttataacactttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagacggtgaaaatatgtgcttcagttagtccctattgtagtaaggtgtattttgtataaaataggccccctgcctcccattttttttttttttttttgcggggggatggattgaaattgcccagggaaagtaaggttatggcctagatttatggaactagcctggctccttcaaagcttttaaccaaaaaaattttacttaagcacagttaaaggtagcacctgactagaacctcatagcctacttacattatgatgtttcttttatttttttttattttttatttttttttgagatagggtctcactcccttgcccacgctggagtgcagtggcatgatctctgctcactggagcctctgcctcctgggttcaagcaattccccagcctcagcctcccaagtagctgggattataggcgcgcaccactgtgcccggctaatttttgtattttcagtagagatggtgtttcaccatattgtccaggatggtctcgaactcttggcctcaagtgatctgcccgcctcagcctcccaaagtgtttgtattacaggcgggagccactgcacccagcctatgtttcttattaagtaaaattcattatatttttggttgttatactatccattcaaattccttgaagtttatttcagaactgggtggcatgtaaataaatagtgcagcaagccattgtttatacaggtttggcacttaaagagtagtcaacaaagaatgtaaaggagaaacaaatgtaaacataaagttgaatagttgccagtgaataaatgatatcacccacagagattatgtaatttgagtacgcaaaacctgctagacaacatctgcatttgaggagcagaggtaaaattgccataaaaaaaaacggaacagacgtgggagaattaatgttttagaagccagtagcaaagtacaaaagagatacttgaattttcttgatgatgatgaagatttttattctattttgacagctcaaataaaagaacatgttaggattttcgagataggagagtttcaagatagaaatcaagaaatagcaattagccttgccttgcatagaccagcaggaattaggtagtactctggtcacatggagccagatgatgaataaatataagacctgaatttataaagtagggataaacttctaggatttttattctatgagaaagagaaaaaaatctagctttagaactttaggtatagtttaattaacttaagctctataagcaacaaagctgatttcaaagctcagtgttttctgaaaggttgggataatggaagtaagctctaaatgtaggcaccagaataatctattccctttctataccccattcggtaacttttctgttcttgaatttcccttttctaaacttatcaatatcctaacctattatctctaagtataataattacactttattttactttttaaacttgagagcatatggagtggtgagaacttcttgtgtgccagaggctttgaaggaatgtgttgttgtatatgtatgtgcattactttgttctgtggttctttacattacagtggatgcagagtgagactggaaaattgagtgcatacttccacattcagttagaagtaagactacatggaaaggaccatgtatgccttagtctggaataagcagaatgatcttaccctctaccatgacacctcccattcttgccacgaggcaagccatataaatagggactctgtaggggatgggagagtttataggccatggcttctattttaagggagttattgagattgttagagctacggaggagcttgaggctcatcatattctaattccctttaattacacttggggaattgatgtcattataattggtacacttagttcacatagctacatgtatattctcacttttaaaaaaatctccttgagaaggagtggcaatttgatattctttttacttcgcaagcctttagaacaaggttggattattttccacaggggctgaaacctcaaatcgcctgtacctagaacctcattcatttaatatcttactggcatgaaaatgtattcataaataactttgaagttcagttttgctatctagacttttaacatgtctattattttcaaatatactaatagatactaattttatataaaatatttaaacaagggagatacttaatgcacacatacacacacacacacacacacacccctttactatgggaagtggtgaatattggaagcctctcagaatttaatcaagaaaattcattacaatgcactcacagttctgccagtgtactctggcagacttcatgattatagatttcggcttgtgtatactctcgttgacgtacagtcctctcaactttttacattgatcatccattcttcataaagaagctttgtatccaagtcagagctatatgaaagatatttttatttaattaatatttgttttctgatttttcctataggttacaataaactgtaaactcatctttctaaaatcttcatatttcttcctcattaatggcatttttcaaagggaaaaattagtgcagtatgtcttatggtgtttcataatattttggggttggtatattttattcctgaattattatgaatgcttactagtcagggttactcttgcttagcatattcattcagtatacttactcattctcttaggatctaagcctgccatgtctcagaaactgcattcttacccttatgttatttatcccaggtgcttttatctacttgacatgtcaggtttatccaccacttgtccattagggtaaaatacatacgggggaaatgaaataacttggccgctcctaacccatcatgtctatgcaatctacttaggttattttctattagttgatggatttctactaattctctcactcgtggcctagttgtttcaagacaactaactggtattacaagcacatctctgtggccagtctactaatatagattcttgaattttagtacagtaataaataaccattaaagctcttattggtatacctaattggacacatactttgcatgtcacttactgatggacattaaagcaaagcactcataggaaggggagactgttggcagtaataaacatgaaacttattaaacattcacatttagtgtgcaagaaagactaataaattttgaaatggtttagaagataaattatctaaatatcttttatgaccctgcttatcaaatgtagaaaagagagaaataatgtcacatcaaaaattctgccctataggatccttggtttctccttttttttgacagggtcttacagctggagtgcagtctctgctcactgcagccccagcttcccaggctcaagtgatcctcccacctcagtctcccgagtagctggtactacaggtgcatgccaccacacccagctaatttttgaaaagtttttttacagacagggtttctgccgtgttgccctggctggtctcaaaactcctggacccaagagatccgcctgcctcagcctcccaaatgctaggattacaggtgtgagccaccaggcctggctctgtttttcattttaaaatgaaaatcagtaaaacagttctactagatgttgaagactgagaatacaggtgtgaattggctcattttcactggtacttctcattaatttagggggtttttaccttttgtattatgtccattgattggttgaggaaaccagagtattttccataaggacattacattagtggtcttaagtattccctaaggcttattcagtgaaattcagaagcttgaaagatactttaaaagtttgaattttattttatttttgaacagatataggctggataagggtaagggaaattagtttttgaaagcaaagccatatctcatttcaactttggtgattttgcttcagtttttatttttagttttgaaaccaaagcggagagatgaagaaataagatcaaaatcaatagacgtgaacgtgaacatttcatttgacctctgcatttcaatatgatcataatgatctttttatagtgcttttcatatccttagggattattatgtattccacctttctcatttgaaaggagagtattatggatgggatgacaatggtatttctgtggtgtctatatcatcacataccttgtagtttttcactcacctagaacattccttcctgtacactaaaacatcggtttctatttacaaagtatgacatttaaacaagttaattgacagaactgtgtttgactggtatctctaaaatgtactaaacaatcaagtgttaaatgtatttacttactgtctaaggaaaattattgtgggtaattaggttcatggtggcattttactaatacacatttatctaaacgaccacgagatcagctttcataagactattttcagatacccattcaaggactttgttgttcctaagtatgatttcttttcagtatggatctgcttgttgatgtcatactaataatataaaaattttgcttacaagcatcctttttaaaaagttatactttgaacagataagaatagatgttcagttacagttgtaaaaaatagaaatgaaattttattgtaaggtttcacatcaaggcaaagtcaactatttttgcttgtaatttggcattttcttctgttttttttctttttttgacaccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaaggagatatctaaataaataaaatgcctagctgtatttaatagagaaaacatcttactaaattggtttaccccaaatccatattttgtttttgtactaggttaggaacacgatagcatgatgagtcagtatactgtattgactaattttattgaatgaagagaaagagagaaaaaaaaaatacatatatatgtctttttttttctttttgtggggaacatggtctcactatgttgcccaggcagatcttgaactcctgagctcaagctatccttcttctacctccttcagtgctggaattacaagcatgagcaaccactcctggcgagataatttgatattaaattatttaaagatcttaaactgtcatttattatggccctattaattttccatatatcctatactgaaattgcataccaaaactatgatagtaacagcagcaacagcaacaacaaaaaacaccagtacctactttgtacattatctgaggagaataattgtgggtaattaggcttctgatggcattttactaatacatatttttgtgccttgcatattttaaagatccattcttttttctttgctatgtattttctttaagtatattatagcaatgtagttagattttttttagtgctgtttattactccactattagttttagaggtaatacatctcttgtggatgttagaaggaaaaatctcattatgaaaaaaatagaagtaaatgattttgtagtctttaacacatttaaatgttgtataaataaatcagatatattgtgaaactaacacgtcacggttctctcaaaatttgttaacatgtcatatgtgaagaccaagaaagacatagttttagaactcacctatctacattactcatggctttaagaaagtgtctgaaatgagagttgctctatttaatttggcttgagatgattccagtggtctttctgtttgttttttcagaccgcagatctgttattgttattgaactcacctgtaatttgtggaaatcttactctgtctctaaagatagattcatggtaaacccatgaaggtaatgaatcttaaaacatcacagcccttcacttgcgtgggtctcttctaaggcatttgaacaagttcatggggtcaaatacatacagtaaaaattggcagaaatacaatatttaaacacaatctctaaaggctctgatttcattctctgacttttctgatatacttcccctcatttatggtggcttaggaatagccaagcgcatttagagatgcagttagatggaagttcagttggtgttaaattcaatctaggtttagtggagttatttttacgtggtttgtagacacttgtatacagttttgttactgctaactattctggtgaagaaatggcctctagaaatacttctgttactcattatacttccttcctgatcgtgacataaatgtgcaaagccagatgtcatattgcaatttaaatatgtcctatgacacctgagatatgtgggtagtggaagagagataatgtttgtagtgtatggagccagaagctagtctatggaaaaatcctttcattcattacatatatatatataacattaagggacatttggttttcatagatagctaatccaaagagaagttttctcttacatattcttggtggagtatgtagagtacacagagcacatgacaagggtagtacttaaaattaccaatgtaccatactttccccctcttgatgagtaaaatatgaaatagaatttatcagaatgccagtgtttgtaaggcacaggctggagcagtgtagcaagcacgagctcttgtggcagtgtgggtgcatgttttatgcatcacaactatcagtagtaaaaaacaaatttggatcagctgttcacaggaaaagcaacattatagaaagtaaactgaaatttttacatgaagagacactcatagactatgtcgctaaaaatattgaagtattagaaaggaatatcaggcaattaattaaaatgctttagttttctggattttgttggttgtggttcttgttggcttttacaaatttatttcttgtgatttctttttctaaataaccattcactttggtatctaattttctatatgtaatttttctattttgttttttatagaaggacccttaaattttacaagttttagaccccacaaaacttgaattcacgcctaccttttttatttatcaggtgatagtttcaagaagttggcatagcattcccctggacattcacaggttgatatgtacattttaggatatttcattgtatctttagatatcttctttgtatttcagagatttaggatttgggagaagagagactgaaagattaaaaattaaacaaattcattttttaaaggacattatttaagtttataaactaaaacatttatttatttagtaaaagctttgagctagaataacccattttcgcagtttatgttaaataaatgcttggcttaaagccctcctattataatatggacaaaactaaatggaggaataaacagattttaaataaatttcactaatatactttgcttttatactctcctcccccttcttctcctcctaatttttggaagtttccctcaccctcaactcccattacagactttatatgaagaaaactattatttaagttacttttccttagtaatggtgtttctgttagatttataataaaaaacatcctttagtaaatgaaagctttttttttttaagttttactcttggtacttagaaaaatcacacaggaatagaatgtatgctgattttttaatgatattttataattctgtaatttttttcatacatttgattatcttatgacatcctaaagtgttcttatcattaattaatagaattctatgtaaacttgaaagaatgtttgtaagtaacttttgaaatcaaattgtgaaatatgtgaatgagactgtacctttgaaaatgtacaaaagcaggtatgttagatagataaatagtggtcataacaaatatattatctaataagttggttcaaggcacttttatatatcttgccatttatttcaacccttgatgagtagacctttattaagctgtgatgattactgaatatgaaatgtaaccaagattattttttattcaaatataatttaaatattcatcaaagagaagttatgcttgagactgacagagactattaacatcaaaaaatataattaactgcattgggtatcatgaagcagagttagccaaatagccgagaggtctaattgctctagagtttgagaagcaatggttttattttatgctgtagctgtggaattaatagtaatgcggtttcctatgtgggccaattaaaagctgcctgttaaggttcactgctctataggaaacccattgaatatcgcttagtaaacaggattgacatgtcaatgtgtacaagaagataaaatagaataaaaactgtgaaaatgagaagtagtattaaaagaactgtccttgaaaacaactcataaaactctttaccattagtgttatggttggtgttgtagtgtgcctcccacgttcgcctttcaggatcaggcactgtttctcccagctgtcaagagagttgcctgctgatgggctcacagctgagtcactccacaggaactgccacgggctgaagggatcttaaactcttctccccagaggcagcccccagtgaatcccaatgaatgccagagtacaaaggattggcttcttcatctttgcttcatttcagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaaccaaagaaaagtgctaatacattataggaatctagtaattaagtataaaaactaaaggttttaaaggaaaaaaaaaacaaaaaaaaagcccaattcaggtctaaaaatggctttttgcactcaaaacgtttatctttgtcttgtcatcctttttctttaataaaagtaatattttgacctttgtggctctattaagctttttaactgaatacaaaaagaaagtgcttctgattgaatccaaaaggttttgccttgccttggctatagaggtttagaagtgggcagacattctaatggcattttgacattaatgaggttgctgaaatggaaaagtttaagggtcaaagataagagcagcgacaagttattctagtgtttcttttacttaataatgtcatatcaaatatgcttaagaagttgaccatgattccttatgtagaatatgtaatgttttatgagtatactactttaagtattataatactttttgcaaataaaaaaattctaagacttactataaaacatgccacctcagtctattaatatgtttagttgcaacttctgcaaaacgtgtaaaaaattttaaaattgcttaatagattttattgtgtacaatatgataatgtgtatagtgtgtctttaaactgcagtgataaggctgttttcctagtcattcattatttaatgtgcttactctgtttatatctgtggcataagagtgcacgttagctttcagaagagcacaacatttgctgcttcacagcacacggccctccactcccaagcctgcacatggtgttagtgatagttaaagcacttgagtctaacattttatagattttgatgaaccgagcctttcagacaagttactgatatgaagctaattcaggctagaagtataatatgaggatagacactttctgctttcattgtcacttttaaaagcttctacaaactgcttgtgtaaactataaatcagatacattttagtttggtttatatcatatggttatggaaccatgcttggcttctgaaaatgatatcttgtctttcattgattgatttgctgccaaatgattagtgggttctgagatatagaagcaaatgtgccaaacactctaacagtatttattaacaactggtaagaatatattagtatatttgttagagtacagtctgatgtttatggagttaatatattttagaataaggtagagcgttatgcagtgcatatgattcagagactcttaaaacagtgactaacccctcaaaggctctgtagtctggtgaagaagaggagataatgtacagaaataactgtgataccaaatctcccttatagtgtaacaaactttcaaaagctggtggagaagggaaagtggtaagttatggcctgagaggggaaaaaatactgtatgctcgggatactgaggaggtctgttcagggaggtattcagcttctgtcccctttctttcacactctgtaacatggagcatgttcgccagtttctttttcctttcgggcattgtgagtgaattccctcctttcacttaagctaaggaggaaaggatctttcaaagattgtgtttatatatatctcaaaaattatgaaaatagtcgtacagaatatcatatttaaaaaactatttttaactctgtaatgtcagcatggaaaatagcactaggatttgagtccttaatattaactccgaaacagtaaggagttcaatctttttatagtagagaagagtaaggtacagtttgatattcacttgttaatttttatctgtatagatattattcagatgtggcatatttatggtattactatgtttccaaaattacaggtatttctacactttaggatataacagcacgtaatgtcttctaccacttttttttaaaaccagcatcacagatgaataaaaagttatctggctgggctcagtggctcatgcccatagtcccagaactttgggaggcggaggcgggaggaatgcttgaggccaggagtttgagaccagctggaccaaaatagtgagaccccatctctataataaataaaatataaaattacatttcccctccctgcctttcttcttttcctccttcttcctatttacctgtgatcaattgatctatctatgtatctgtctgtctatctttttaaagataatttcttgcttttgtgactgagatgcagcaaaaggacacttcccttgatctgtgctttttagaaagagctcattgggtaataggctgtagactgaatatttacgagttggtgttcagttatcaagagaatgccatcagcaatgccttgttgctttcttatcagctacttcctgctgtcagcttggcacttatttcaatagaaaaggatttgcatcaaatgtaatgccttattatatacagctaacgtggggtttttaattgtacaaacacatgagactcctgcagtggtagtcaatttgataaaaggattagattatgaatgttttgtcatgattaaagattagttcagatttatcagaagtaagccagtgaaatttgtcatatatttatcagtcaggtgagactccattaatctgagagtgtatgaaccacaagtagccatctctttataaaagtctgctgaatttggttatttatattcaggtgacaggtgctaaggattgtttttggccttccctacttgctctactgctcagagtatcccaagagtctatgtctctagcttttggtcactattttttttttaatctcatcttatagaatagtttggtaaacatctacacaaaatttctgtagtttttattaaagaaatgacaactagtgtatacctgaagacattttgaattgttcctttgattaaaaaaccttcagtaaaatacggaagattgagaattccaacttagaaggtatttaaattgagtacttcttgccataaacaagactaggcattgagatagattgaaaagaagcctgacatacaacagaaaggtgaaactacagtcccagacacaactaaaattactgtgtgaggcctgatacaacagtacccactgctcttggagtgtttgggaaataatataaacaaggacataagaagtttaccgtgtaattctagacatggaaaataattagtgagtttagcagcaactaaagtgcaaaatataggagatgccataaagcagaatgtgattaacttccaaattaataatatagagctgctgctctaggaaaagactacttccgattcaggtagtcagggaatataatcctgtttggccagcatcatttgtattggctttctgtataccacctgtgtggctgattcttcccgcatatgtgtgtgcctccctcaagtatataacagggagatcctgtttttaggattgcatggagggcaccactgggagttggaaaatagcagttcctcagactagaagcatagtatcctaagctctgataattttctacctcagggacttaacggtccttcaaatggatcttcttattaaggaagagatagttcaagaactgtacatagtcatttatgtgagaactcagttcagaggtatttgctagtgtgctagctgttttaaattacatagatatcaagattctcaaagtctacatagaaaaggttgcctctgttaggatgatttttgtagagacgagtactgagccatgcttatggagtagataatatcgtagagagatgtttaggagagagatctttcagatgcagtgattcctctagcctgtggtgttagtaagtcaatcagattctctgggccttagtatattgcacctatattaatgaagaattatattagatcggtgatttttaaactggatttcttggagaaaaccctcaggttgaggggtgattgaggtatatgggaggagagatcaagtggatttttcaggggtttggagccgaatttcgctactataattccagacctgtctcaacttctatttctaatccattctattaagcaggatttttttgttcattttttaagtaaaatttttcatgtcaaagagattgtgttgccagaatctgatactgatttggtactactgtatttgatgatgatacataatttatgctcatatttgttattaagcacatacttgctaacaacatttttaaattaagggagaaggatcctctgttagaacagaatacttgtatgaaaattcctgaggggagttgggatataatttgaccatgagggtatactctctataagtagatgataaagtgaattccttctatgtgggaaagaaggacataaggaaacacagatcaaatttgaaattcaatagttaatagaaaaagattcatggctttctgaataattatgtagcactttgtttttagaataacagttttcactttgttgaacctttggagaaacatgaactatgtatttcccttgccctccaacattaacttattaattcagttcatatattcagatattgcttgctcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactgcaaggaatttcaaaggtttctaaaacatagaaagttgtttttagaaaatcagcattgccatttcaaaatgcttattttagtaattaatgtggtatttttaaggaaatttttggagtttctaagttgtaaatgaactaaatattaaagtatgcatactttgtgtttataaattctggcataatattttactcaaatgcaaaggttatgggaagatgttattctgttttcattgactgaaaaaaagcacgacaacctcctagaattgattttccataggattttactgtcaagcttttgttgacttgccaccagttacttgatttttacttggggagtgaggactttctgtttctcttatacactatactccttttcagtcaaatggatttatgtttacacattgaaagtacagaaaaacattttgcatttttgcttatgattatcattttaataataaatgcaattttaaaataatttttatgcaatttcaaggatttaatcacaggtgcaattttaaaaaatcaggattatatttaaaactttaaaaaagtagaaaattgaatgtaataaaaattatattgtttatttttcccaaattatgtatctctgtgtaccagtattcatgcatattatgctagagattctgaaactaactttattacagtaatgatttcaaaataaataacacagtgttctataatgcaaattgtataatatcctaacatacctataggattaaattctatatgatggttagaaatctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttttggagcatgactggagaaactaatgttatcttgccaaaacagaagcccctgcttaatcagcagaacaagactattgattaaaacacctctcacaatagattacacatggaatctcgtctccatactttgcacttggtaaagtgtaataatgagcataagataatcaaaagaagagtaaaagcaatttgttgggcattgtacaattcaagattagagttggaatggaaacaaatttgcatgaatagttgagcctgtttttaaagctgtacacagtaaagagtacgcacagtgcagggactactgtggaagagtaaaagatgttctgcttctttaagatttgcaaatctgttcatcttacataggggacattgttattattggtatttttggtggcggtggtggtaatttatatttcttgatgtttgttatccaggtattgtgcagagagttgcctgcactatcccatttaaccttaacaaacttctaaagaagatactacgttttacagatgataatgctaaggttgaaaggtttaatacattgcttatggactcacaattaagtaagcagctgacctggaacttacacaccaatttttttctgattctacagcttctgcttttaaacactaatcttcccaattatcaaatgattttgcttttgaacagagataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaataaacaaaattcagtgttttgtcccatttaaactagtttatgacctataaagcaagacttttggattttctttgttgtggttgatggattttattaatgttttacgaattttaatgtcagaaataatacttttattccggtatttgaacttaatattaaaaggttttattattgggtttattttagttatatttggaattctcaggttgagtgttgtactctatatactttagaatagtaagaaaggtctttaaaattgtagtcagaaagttgcaaccagaaattatatataggtgatacttcgtgcgtttttaacccagtgatgtgaaataatgattaaatctttgtctttgtatgccaaatttgaaaattttggaaatgtgactagaaaaatactaaaaatgattatatgtttagaatttgggactgagtgcttatgtagttttatgtttattttctacttagtatttaatcatgaattataccctggaaatggtttttgttccttgtttttgtttttgagacagggtttcattatgttccctggcctgtgcttcagtggtgccatcctcccacctcagtctcccccaagtagctggaactacaggcacataccaccacacctggctaatttttttaaactttttgtagagatggggttttgccatgttacccaagctggtcttgaactcctgggctcaagagatcctcctccctttgcttctgcctcccaaaatgctgggattataagcgtgagcaatagcgcctgaccccgaaattgtttagacattattcgcaaggcctacttatgcctctgagttctctctaaaaacagaaagaaagcaatttctgtatttattgccttcctagagttgagccactttattaacatttatttgaataagtaagtcaaagattgaatataggaaaattggcagtgattacaatgggtcatatttttctgttatttttaatgacatacttctgtagaacatagtatatttttacatattctcaaaagttttatttccaattttagtgtttcgttagcacatttttagcaaaacattatacttcttatctgttaaaaaattggttcatatgtgatgtatacatgtactcagataatatacttatttcaattctccatgttaagaattgatgaataactagacagcttgctcaaaattagagcaactaaaactcttgatttctacacttagaattagcaagaagacatattaacattgtaaactgtattatgtacctcttacataagttgtactcatcacttgttttctgtttcacttgttttactaagttttatagagcaaaatcatgttttgccattcatatttattctttagtaaagtatctaaacctatctcgttttaaccctgtggctctcacacaagttgcactgatcagagtcacctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgcaatctcagctcactgcaacctctgcctcgcaggttcaagcgattctcctgcctctgcctcccgagtagctgggattgcaggcatgcgccaccatgcatgcctgcgtggctaatttttgtatttttagtagagacggggtttctccatgttggtcaggctggtctccaaatcccgacctcaggtgatccacccacctcggcctcccaaagtgctgggattacaggtgtgagccaccgtgcctggccaataatttgtatttctaacaagttttcagctgatagtggtgctgttggtatgaggaccacattttggaaactactgctttcactatcttaagtcatctgttcatctttataaatataaaatgaaataagaccagttatttgaaagttgaagtgttcaaaatatattctagtatctgcttctttatgatgaaccgtaattgtagttccttcaaattgtagtaaaatgtctactcattaaaaccctattttttctcttttgccttgttctcattcataccgattttttatgcttaatgtgtaagaaaattgtaggttattaacgtaataaacccacatggtattaccaaaatatactgatagtttgattgttaaaacaatgatacctttattggtaaagaaatcttcttctgtagaggaagggagagaaagtcatgccaggaactgtgcccagtactgaaaatacaaacgactaaacactttttctttcttggcttaactctaccttttcgctttcattagtatgagaacttgaagctgagcccttggcgggaatttactttgcttctgtggataagtaattgctttctttctggatctttttaaatgatagcaatttacacttttataatcttatcaacagcatattgttaaggaattttcagatttttcttagtattaatagctcacgttgggtgtttcccaatgtctttcttgtctcctcactctctatttggaaacttaatgctgcttgcaccctttataaaggaatataaatgtctgtatttctatttctgtaatttgggcctctaaaagcttagattcatttccatgaatcaagatactggcatgcaaagttctaattttcttgtactttttacagttggatttctctcctttctgacccttaactgttttagctctaaatttgccatttttctcaagattaatttcttgcacttctgatatctctgtgtatataaacatatgaaattttcaaatttaaaatgaatattttttatattttgggaggccctgaattctagaattttttataattttattgcaggagcttcattaaatcagttttgcttaagattatagttgtagaattaatacgttttgctgtcttaaagtggatgctttgtgtaatgtgattatttaaatcaataaaaattatgtggttggtataagtaatcataattgctttgacattaatttgaacctgtaattggtcagaggactactgcaaagttgttcagaaagagtaaatatggacagttattttttattatggtgttggtcctctttcaaacaaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaattcaggttttgactcttacgtttctgtttagttataggaccatttttaaaaattgtaatcttaattcttaatatcctagtaagatatatccaaatatcttaatatcctagtaagatatttgttgttgatcttgttgtcgttcagttcatgttgaatatatcaaaaattaaaatgtataacaatgataggaaactgttggccattatttttttacttctagttaaaatttagtgtgacccatgataccactgtattacaacataaagaaaacaaaactcttataaaatatttaataatgtagagtaacttaacatcacttgaatttttgttttatgtttctggttgcttaaagaaaatgagaaaaacttctatgttatatttaagtgaaaataatcaaataaattatgttacacaagtttgatacattttgtttttcaggtgcaacaatcgaacacagtgtatagtagttactgggtcagatgtgtttcctgatccatgtcctggaacatacaaataccttgaagtccaatatgaatgtgtcccttacagtaagtatgcagtttatatttttttacactttgcccagcattacttgttgatgctgaaagactacacatgtgaaagaagcatatgtttatggcctacaaaaccattatgtatgcagagcactaacagacttgggcctccaattaacttcatgaagtgtggaaggaagccatagtgtgatgctggccaagtgtctgtctgtgttcttaagtgtttggcttttaaggctagtgtttttccagaaaacaaacttgaattagctattcaatacggctgatagaaatctgtacttttgcccaataccagttgctgacaaattggtttggctcacagttttctaaagaaggaattgacttcagttttaatcgtgagctacttgaatggctacctgctgttgtagtaagtttagtgctgggtaaaagctaccattgcagtaactgaggcaagtgctttactttttgttctattgtctttaagggagcatttctttatgggattcagtgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattcctatatactctacagtagtgacactctataaattgcacggtttcaactaatattaaaatacaatgcaaagagccttcttagattattctaatcctatgtaggacagtgtcttatctctttttcccattttcctcaccttttgtttctttctacctctgtccattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgattcattaatcatcaaaggtttataatattttaaatctttacttttgagtgttacttacttttcaacagaattataaaatatatacaatatataatttatacttattttccttcaatatgtgatatcaattaaatctcaagtaaataaagactttgatattctattccctaactacattgtaattttagtttatcaaataacaaaattcagccattttcaatgaatggaaagcaaaatacactttctacatcttctattgaacttgttttaagttcttttttaaataaacattttaaaatgtattatttccatcctttacatttaatttatttcagtaaaattatcctttccttaggggaaaaaagcatacagctgtatataaattgtagtttgagtagtcacaacgctaatgatttctcttatcctgattttctcactacgcccttccgttattgattctaagcaggtataatattgctcttcgctgaggagtaattttaggactagtggtttatacaaaagtattgttttcaagacagtaatgttgaatttcttgtttttcagatgtagtcagaataacacattatagagcaagtatgtttcctgaaagtggttacatagaccaagttgattggggaaagttgtagcttaatgtggaaagttgtatgccattcctatggcaaaaatgttcgtgtgatgttttttcccataagtgtttcagaaggccaacatttaatcttgatgaattattgtaacttttaaaaattaatcaaactaagatcttaataaaatgtgcactactctgtctgagtacattttggaaatgcagtattagcaaccctgatgcattttaacaacagaaaagggagaaacagacatcagtcttgtcattttatgaaatttaggcaacatacttcaagcctatatacaatgtaaagtagtattttatggtttgtaagtattagaatacggtttaccaacaaggatcttacatagcccccttcctaacttcataatctgtttcttgaaactgtaggagttgtttttttttttttcctcatgtaactctactaatcaggtttgttttatgaaagcatttactttttataaggtctgtggagtcaaggtatttgctctgaatgctcggtatgattgttgttgcatgctagcttgctttctatgtaaattgatgatggtagaattgtcataataatctaaccataattctttcttcctttttctccttgcctactgtgcttgcttttcccttgtatgtattttgcttactttttttatagacttagtattacaagtttgagatatataatatagaaaatttaataagaattttataataaaatgtatatgtaaacctaactaagtaaatatactaattcttagtgggggagaaaggtactaccttaccctactcttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaaagtgtcatcttgcctggcttccagaaccctctccatagcatgccatggttacagggtctcctgattgtttcatcactgcttttcttgcatttacttttctgtgctcctaattgcattttccaaatacttatgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattgtggcattattagtcagcttaaacttttttcattgctaaaaatataatactaaccagaaacctgttagcagtgtttttttgtttggttgttttcccctacttgactgctgaattgattacaatctatgttcagaccttttaacttcttggcgccagtggttaaaggaaacgtgtgttaggaagtcccaggagaatggctaggcttgatgtacaatgccagatatatgcgttctaaagttttggtgtctgttctctcagtaggagagggagccatccaatatttttctagattatcatgtaaaattacatgtttttattttctgataaattagtgacagtttgaagtcaatatttctgtgactttaacgatcacatgaaccaaactttaaatgatcccaagtgatgacttgtgatgacagatatgcaagcattgtgtgatttgtattctctttatggaggatcattactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtgaataaagttgagtataattcagttcaacaaataaaaacattacccatctacttgccacaaagtacttcagcaaatacaaagatggttagtaatgtcatcctccacatgtgtcatatattctagcaaataatttgatccatttcagatgaaaagtctttgatagtttagatgcttttggaaagagcagttaacagccttgaaaatgagaagcttcggcagatgtagcaactgtatgttcctacaactatggtttgtcatccaaaatagccattctttataaatagtcccagaacatgaaaattcatattgaccccttattcagcccttagtgatgaaaagtattatctgacctaaatttctctcactgctgtttgacccatattcattctctctctctctctctctctttgtaatttatattatgcatttagagactcccttctctctgatccaagatgtgtgctacctatatgcatgtaggtggggtcttgcagaactattctggcccacaaatttaggtcaaaccaataagccactgtcagctttccagaaacaagatccaagaaactgatagaacagagcaatcagagaaatgaggtcttttgcctgtcataaagtagtgattgatttattttgctgaaattcgtagttcaggtcatctgtgctggatttgctatcacatatatggccaaggcataaattgtgctataaaattatccattcgttttttttcattatctatgtcatttttcattgtggactgtttaataatatattagcctcaatactttttcccatttataaatccaagccttttcattcctaaaagcacacgcatattatttttgtgccttaatctttttttttttttttttggtgagttttgagctctgtgtgatccctgcatagttcatttgctccactcccctaaacgaggtctgtttttcctgtttcaccttctccctctctggaatggccttaggaaaaacactttccagtcctgttttaactcttttccatttcttaatctggattgctttatatttacttaatctgtctgcacatgtgatatcccaaatattataaagaaaatgatgtgtttttacttggcttttggcagttcctcaacatttgggttagactaattaatgatgtgatacacttctgtaataccaggaaaaaatttttataaagagagccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgtacctctaaaagatttagttttgtcacttaagctttatgatcatgtttattttcatgatatcccaatatttcactgatttatttttgaagaataagttgattccctttaatctattttggtgatcaaaaggtaaaaagtggctgggcacagtcgctcatgcctgtaatcccagcactttgggatgtcagggagggcggatcacgaggtcaggagatcgagaccatcctggccaatatggtgaaaccccgtctctgctaaaaatacaaaaattagcagggtgtggtggtgggtgcctgtagacccagctactcgggaagctgaagcaggagaatggcttgaacgcaggaggcggaggttgcagtgagccgagaccacaccactgcactccagcctggtgacagagcaagactccatctcaaaaaaaaaaacaaaaacaaaaaggtgaaaaggtataaaaataaattatcaaaaaaaaaaacaatggaaacatggctgtagaatgttgcatgaaattttgcacatttaattgaggtccttttaatgtctaccttgactcggttattatgaatctcaactaatgcttagctaacaaatcactaattgtagtattaatacatatttcagtgattaaatatgtgctagttagtacagtgtcaagggatatatcaggtagtgtagcgctcaagcattttgctctgcccccttcttttttctgttctgattcccgactcccctttaagacttgattcagcagcagtcatttgacacttctgcaaaagattgtgatgcttttgacaaatgttaattgagaaagcactgaaagcctggctgcattgtaatcaaaagaaaattacagaggtttaacaagatgtcaagcaagtgctttaaagaaaagatagacaggtttgaataggtttctgcagcagctggctaggcatgatgtttgactgatgtacataggcatctctcatatggtcaataaattatgccctggaaataaaacacatgctttagaagtttctcttgaggtagagggggggaaaggaataaaacgtgtatagtgtacttactggtaacaagaagtatgtaactactaaagaactagaaacatgtcacactactttttcgtagtttactgtcagtagtgtcagaattaataaagaaagattgatggaccagagagcttaaaatagtaaacatatcagtgataatatgaacttgttttctaataaattctaatattctagcttattatctcatgtgtagataaagtgtaaaataagttgattttattaagatgatttgaaaacatagctatttttcatttgctctactacaacaatttaaattgaaggcatcatatatgtaaggttttaagagccaataatctgtaaatgttgatacaactttcgtgtgatttcctccaacagtttttaagtggtagtattaaatttttactgacagatttttgttgttgtttaaattaattcagtggtaattaatggaagaaacattgagctccactatttcttaaacctagtggatttaacagtttagtaacattggaaggcaaaaataacctttgaaaataatgaaaacatttttgcttttaaatgtgtaacgatagttcttttaaattctctgttaagggtgactaagatatgaagggttggtttgaattaggcatgatttgatctgatgctttatcttggtaagagattccacctctgactggaactagctgcttcttcatacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgtttacagtagctaactttatttttgtactttggtaatataacatctatggacaaagttttttaaactgtaaaagtcatttaagatcaggcactataaattacctctccctttcagagacctaggtcaagcctgagatttttgccccaagactctagtgagtcttccttacagctgcctttctcattataagcatcactttggatgaatcccaagaaaattaagggtttttgtttgtttgctataaatatatgatatttctatgctgacttcatatttaccatttataatctgcattataccctactttttgtcacttattgtcaaatacttgcattagagtttattcaaaatttaacacgcagagcaggatcatcatagctgattcccgaatgcatgcagaaaaatggtttcaatttcactgttgttttctacatctgttgtaggaactgcctcatatctctgcatgatttccactggaacatggaaccctaagggccccgatcttagcaactgtacctcacactgggtgaatcagctggctcagaaggttggttggaaccttttaatatgacacattggtgatttagggcattaacttctaacataaataatttagctttgtgtgttaaaaccagctttattgctctttgttcagtataaaagtaaaaaaaaattacgcatagttttgtctgtaaactgtttattgaaagttacatatgtttgggggtatcctgttctctatgttaagctttttagtgagtaatgcttgttaatttcattcatatttagttctgtttcttttgatgttcataagacaaaatgcattcgccgattaaataaaatatcattaagtttacaactgaatccacagaatgcaagcagatgtttatatcacacatgattatggtagaatgagtaaactactttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagttgccgtctccaggaatatattgttatcagtgccattaatttttcctattatgacaaaagttggattgctacttttcatcacactataagtgtttatattaggttcataggaacccaaaatctgtgcctaatgtggttctacctggttaaaaaattgacttttttttttactgcagtatatattttgtctctttttgtcaacatattttagattagtatacttcataaaatagaataaaaaactgtaaataagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaaggcatgacttcactaattttggttggcaaggtctaggaaaaaatgacgtctcactagttagtattggacattgttgaacttgagaactttacaagaaaaggtagtaggaaagtctgtttttaggtaataatggtctgaaagtccccttttagcctgtttaataggggcagagaaataactgctgaaatctatagaatttttttaaacttcaatgttcagttcacctttaaggtattagttaatgtatgaaatgtaataattggtatgttgcccaggacatacatcgcagttggaaaagaatagctttttttttttcctttggcagaaagagactacttcaggaatatgactaggctaatgatcattttgatcccactagacgagtacaaatagtaataaataaggagtgtttcaaattaataaaagcatgccattagcaagttatgtgtatatggagtaaatttcagcatgaccttaatttctgaccagtgtcattttcagtatgtctcaaatgagcttctctgttcagataagactaataaaactctttaaattacaaatcagaagctgacttacactatgcaaatgaagcaagttcccactttgtgacagaggattcatttgtaacttagattagagagaggctccagtctgtatttcttggtgactaatgaatctggcctctgcagaccaatttctgttccactctagttaatggctgccgcagtatcagtgtgagcatttcgactattctgtctcccattagagggagaaaaaaagcctttaacgccacttggaagtatcttccacctgccaggaaggtcgtggtgtctcacacggcagacagaacgaggatattaagatggattaagctaattaatcttactctgacagtagcttcaaacaactttcccccctgttcatatagtacctcacgctagcaatttttattgttgttctttttgtacagtgtgtgttctttctcttcagtaattaccaatagatcagaactatgtgtttatgggcataatgacacattatgactgggtgaatggaatagagtaaataaacttagtgatttcacctttccaaagcatagtcagtgcgtagctacagagtgtaggagtataagatcctgccttcagttgattaactgagttatattttatttaatgttattttgtgtagcaataaattaagcctacatatgtgcatatttacaacttgggtgtttatgaagacttgattctactttcctgttttctctaacttatcagtagaggctttaatttttattcctttctttatccctttaaaagcagatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacagactactcttccaccagaagcagtgctaacttcattagggcagcagatactgaatgaagacttactatctggaatgccatatcttaatgcctaattatgccttattgtgcctgcgtaagtcatgagactttatataaaaaatgcagatcaaaggggtatatggaagaaatggacataaatcaaattagcacctatatttgaattcataatcttaaatttattttatataagtgaatttttaaaaagaaatgaaatattttaaaaataatttgtttttatttactttgaggtttgggaatgaaaaatcagtaattaccgaagtggcatattatgacctcaatttgttttctaaatattctgaaaattattaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcgcatgcctgtagtcccagctactggggaggctgaggcgggaggatcacctgagcccagggagggagaggttgcagtgagctgagatcatgccactgcactccaccctggatgatagagtgagaccccatctcaaaaaaataaataaaatttaattaaatgaaactaaaggattatttttaatgttgatcttttttcatttttaattaaaaaacactatggagagactggcatctctaaaataatgcttggtatttactagtctaaatgctgattacccaagaattatcaatatgaaagtcattttacggccgggcatggtggctcatgcctgcaatcacagcactttgggaggccgaggcaggcggatgaggtcaggagttcaggactatcctggccaacatggtgaaaactcgtctctactaaaaaatacaaaaaaaaatgggaggccgaggtggatggatcacctgaggtcaggagttcccagcctgcccaacatagccaaacccagtctctactaaatgtacaaaaaattagccaggcgtggtggggggtgcctgtaatcccagctactcaagaggctgaggcaggagaatccctcgaacctgggaggcagagcttgcagtgagccgtgatcacgccattgcactccagcctgggcgacaagagcaagactttgtctcaaaaaaaaaaggtcattttacatattgtaataatagttgtgtcttttttatttccaaggtataaacaattttgggggtggggggaagggccctgatttactgtgagggaaacgttcacctttttcctaggacttgtcttgttctcttttcagacatgaggactaaaatagcctattatttctctatgttcccactcccttgaggacatggctataatgtcttaggttattaaaacaatttgattttcctccttagtgatttcttcttaaattcttggtttaacttcatagcatgatttacccttaataatacatgactccataaaatgatataattttatctattataattatatctaattgtgacatttaaaaacttggaggtataatttaaaatatgcaataagagcacctgttttaagtgtatagtttgatggagtatggcagttgtacactcttatgatcatcagcatggtgatatttctgtgtcctcagatgggcccttcatgctcctttgcagtcattctcctctgaccctagccctaaaaacatcagaaaccactgatgtgcttttcgtccatgtagattagttttgctttttctagatcttcagttgaatggaatcatatagtatgtagtactccttttgatcttgctgcttttatgcagaggaatattttttgaaatttatccatatacatgggagtgtccataatttaatcctttttattgctgagtattatccattgtgaagacataccacaatttgtatatctactcacttagacatattgaatttttttccactttttggctgccatttttggctgccatttttccaagtggttgtaccatattaaacttgaactgtagcatatgagagttccagttgctccacatcctcaccaatatttaggattggcagtcattttatttttagtggttcttggaggcatctcattgtggatttatcttgcatttctgtgattgctaagtaacattttgctgataacctcctttcatgtgtttattgtccattcaaatatacttttatgaagtgtttgttcatatcttttgcctatttttaattgggttgtttgtctcattaaatgaattctaaagattctttttatattattgttgtaagtctttttgtcagaaatatgcattctgagtatttttcctccagtatgtgactttattttctttatatcttgggaagagcagaagtttttaattttgattttaaaaattcaccttactgagctttagcagcatctggctaatcctgttccacttaactcctctcactcttgtaatattttaaagcaaattgtaaaatcctatcatgattactgtaagaaactttatatggatatatcccatactctttaaaaaaccacaataccattatcacactttaaaaaaataacaaaacgtttcaaaagataacaaagtgtgttcacattttcataaatttattaatactttgttgaaaccaggatacaagtccaagtaataaatctgatagatatgtcagttgagttttgtttttttttttgagatggagttccactcttgttgcccaggctggagtgcaatggcgcgatcttggctcattgcagcctccgcctcctgggttcaagtgattctcctgcttcagcctcccgagtaactgggattacatgtgctcaccaccatgcctggctaattttgtatttttagttaagacgggatttcaccatgttggtcaggctggtctcacactcctgacctaaggtgatccacccaccttggcctcccaaagcgctgggattacaggcatgaaccaccattcctggccaagtattttttcattaaaagttatttctctttgcatactaaaaaaaatattttttaaacattttttgtttttcttgaggaagtcaggtgggtaatttgtcttgtagactttgttacattcttggtttggcttatttcatccacagtgcatcatttaactctgcctggtatgctgatggttagatttagaggcatgatcatgctaggtttaactttctgtttctttaatttaacaagaactttctgttgcatcttatcaacaagcacataatctttggttttatttccttgtgattttcagatcggttccatggtttagatgttatcagcctgatccatccattgtaaaattcccttttatttattgtcttttttttttcttttttctttttttgagccagaatcttcctctgttgcccaggctggagtgcagtggcatgatctcggctcactgcaaccttcgcttcctgggttcaagtgattctcctacctcggcctcccgagtagctgggattataggtgcctgccatgatgccctgctaatttttgtatttttagtagagacagagtttcactatgatggccaggctggtcttgaattcctgatcaggtgatccacctaccttagcctcccaaagtgctgggattaaaggtgtgagccaccgcccctggccttatttattgttttaatgagctgagtggccagcatgatttttatcatcactttagacttagactgtggtaacaaaaaccccaaagtcacagctgcttacaacaacaaaggtttactactccttcctgctgcataattgttgaggctggacttcagctctgcttcctgtcatcttcagttctgctccgtgttgtttttattctgggacctaggctgatgccagctccttcccataaaggtgcaagtctcctggcagaggtcatagttcttcctctttcctctcattacagccactacttgctgaggaatttgcaaaatagtaagataaatatattaaaattctgtttacagtattggctgagtgaggctctgaatggctctccagtgaaccaagtgtattcatgttcagaaaatctattgaataaggcatatattatttcaagcatacagaaagtagaggatagcataacatctgtgtaccacttactcagctgagccacatattggtattttaccatatttgcttcagatttttttggaaaaagaaaatcatagataatgtcgaagttcccaggattgcctccttcctgattcatatcatgaatgaggtagctgtcatctttattacttagcattaataagcttaaaaaattttgctttgtaagtatgtacagtgaatacttttcaggtttttaacattaatttcacactgtaaatgtaattgtataattttctttctttttttttttttttgagacggagttttgctcttgtcgtccaggctagagtgcaatggcatgatctcggctcactgcaaccttcacctcctgggttcaagagattcacctgcctcagcctcctgagtagctgagactacaggcatgcatcactacgcccagctaatttttttgtatttttagtagagagggggtttcaccattttggccaggcaagtctcgaactcctgacctcaggtgatccgcctgcctcagcctcccaaagtgctgggattacaggcatgagccactgcacatggccataattgtataatttacccttagcattttattttttatatttacatatgctgatatgtgtatctgtagttcatttgatctgtttctaagaatgtaccagaattaactgctgatagacattttagtggcttctgcttttttcctgacagaaggaaaactgtaatgaaagtttctgtatgccttcttgctccaatgtgtgcctttctagacatacatgcgcacatacctgtgtgtgcctacacacacatactccctagaaatagaatttttgagtggtagagcatacccaccttcagctttactaaatactgccaaattgctctctaccttcttttaccaatttaatttttcaccagtaataccattactagttttgcagacactttattattgacataactgttgtcaatctaatgagtttgaattggttacgttattgttttaatttacaatttccgtgattgcttcatgttgatttttttaacagatttattacctatgttagttttctctcctatgaatttattgtttacaactttctcctgtttgattttttctttatacttctatgtatactggacactaatcctgtaaagattatatagtttacagatacttattctgtctgggctttctctttttatctttttaaaaggaatctgttgttttacataatgagtcagatatatcagtttattctttttagggttggtactcttggtatcttgtttaagaaatattttccttttggctttctacttaggaaaattttctctacattgagtttataaggatcttatacttcccttgtaaatgataaacctctgccttttacagttatgtcttgaatctacctgaaatttatttttaattatgatatcatatgagagaggcagctgatttgatttttccccatatgaataaccagttccttgtttacgtttagtgcgtaatccatttctccccctaatgatttgtaatgatatcttacatgttagccatgtctattatttgctgctttggttttttcagtaatgttaatatctgttgagtctttcagccttgctccttaaggaactgctttggctgctttttggcatgtctcttctatataaatttttaaatcaatggatccagttccagacacaaaaatcttgttggaatttttattagaattggactgaatttgtagattgattttgaaagaggtgccagggtgaactgttgcattctcccaaataacagcattatgtaattcttcatttttttcttaggtcttcttataaagttatatatttttcttatttttagtgtcttgcactttttaaaaatcagatttgttcctagacaacttatacttcttttttttattataaataatatcacttttaaaattacatattttaattgtttgttgtgtggtgtatagaaacacgattgatgttgctcatagcagccttgctaaattcttagtatttctgatagtttatcgttaacgtccctcgttattactatgtagttaattgtgtttactgtgaataatacttgttttttcctttataccttttatttgcttttcttgaattactgcattaagctaggtcttctagtacaatgctaaataaaacctgtgacagagatcattttgactttaaatggaatgcttctagagtttttcactattgtttgctatatatgttttggatacataaaggtttagcctttatctgataagaaaacttctatctggtcaaagaatttttctttaattcacattttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaagattaaaaaaattagtatccaagaattactgtacaatggtatgagatgatttttgtaaaaataaaaaggggattgtaggtgaatagctgatagatgatacagacattagagacattaaagagagtgacattcagaaaaaaagtgtggactgtattttttgaacttttttaagaatacagattatttttaaaatttcaatatcagaaattaatgaatttttcatataattccttagatttcatcaataaaatgttaatattgtaattattaatataagatagttaactcctgtaaaggcaatgtacttttccattccttttaaaatctaaatgaatgttaatgtaaaataattacaatctgtattgtgattcccagcagacagtaaacatttatattgttagtggttactattaagtatatttttgaaatgaagttagcattggcatgttgatcaggtagatgttctcagtgttttgtattgacgtgttttccttaagtgtttgtcaatttcgatacttggtttgaatttttgaaatttggtttagattgcagtggttgtcacacttctgctgtaaaggtccagatagtatatattttaggctttgcaagccatggtggtctctctcgcaaatatttaactggcattgtagcactgaagaagccataggcaatatacaaatgaataagcatgattgtgttccaataaaactttatttacaaaaacaaatggcatgccaggcttggcctgcaggttctattttgcccaatttgaatatgtaaagactgatggttactagtgagaattaatgggaagttttaacataatgacattttcatcataaatatattcttggctgggctcactatttttagaaattagaaaaaaaaagtattactgcaaacttgacctgtgtaatttttcatattaaagtggatcatagatagaaagagttgtatagatgccataaagtcattcaaatttgtacttcatattagttttaccactgccaagtaatggtcattgaaaagttacttaatataaagagccaaaaaatatcagtttgaaatatttttgtttagcttcatgatttaaatataaaaccttgaaagttatgtactattaattcatacactgttcatacttacaggctaacagattggtattagttcatgacaaaagagataaaaatatgaagaaggtgttagaatgacaatacaaaatttttttgagaagtgaatatttaagacttaaatcatttggagtaatttggtttttagtccatgatttttgttgaaacctaacagtaaaattttttaagtaggcaaaaagaaaacagtagtttccatacagttatcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtactaacaatatgatttacattgctgctagtgtatctcttagaactaaccaaaaatgggcccaaaatagaacatggatttttaaaacatttggtccgtatagaattttctcagaacaaatttatggctctaattttatcagaaaggaaaaaagattctaatgtaccatcaattgtaaaatcataaaatggaaattgtaattgtgtaaaatgggtcttggtaatttaaagtacactttagagtctttcggactataaagccccttttaagctagatatctgccttgtataacatagtccacaattttgctgatgaaaaactttatagtctgaaacatgcaaagtttaatctaaattaccttttatacatattaaacaattgctgttgccatcttagaatataaaatcctaattttatcttgtcattttatttcccagcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcagtaagtatttgcacttctaattagtagcagagaaaaacctcagagattcaaaacagcttgtataatagtcccattctttgggtgcttaccgtaactaaaaagcaaacaaagtaatgttgatttctaattgtttctacactgtccataaattttaagaagtcttggcactgttattgttacttctcaaaatcatatgctatgactttatagacttgtaagttttcctccttggggcaggtgcttggtagagacaacagaagatttaaataatgagcagcaataggtcatacaaaagagacagaaggctctcgagtttaacatgcccttcccatcttgaatgttcgaatctaattttacaactttccctttaagtttcctaaccactttgcacattgtgcaaagctgcatcttttgaaaagtcaaaatggcttctggaatatgtctcagtattctttcttgtgattaagacaatgacagccagaagacagaaatattttaagaagtgtagcatttccgtctcagatccgtagtatgtgtcaactctcaatatgtaagcatacaaaaccccaaggagaaaataaaaacttaaaacttggcttatgtgttagcttggaaaaatcattaaaatgtcagttgtttttaatcatgaataagtattctttattctgtcatgtaaatagtttccatgtgtttatgtagttaattcagtcatactttgaaatcattaggctcctttattgttttctaggtaaaatcttcctctctcatagatcattttttaagtataaaagacaataatattgaacgctattatgtgatcaaaatttatttttggtattgagccttttttgaacacatatgaatagtattcttcaaagagttcagtagtaaaagatgagctgtacatgtgaaagctgtctttcttctagttgatgtaatgcaggaatactaatgttcctcatatctttttattttcagtataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcggtaagcaccagttgagttcattgaccttagatctctgaaaattattttagtaggtgtgaggtgacatatgatactgatattaatgtttgaccttgtaacttgatagaattgatacggcaatattgaaagacaatttgtagtaaattaaaagactgtccaattattaagtaatattatgaactaattcattttatatattaagatacagtcgaatttttctgtgtttttattaagacataattttaatagaagaatgctgaggatacagtaatataaagatcctattttaaaaattcttattttgtttacatagtcattctgaccagtgatcctttctttgtattcatagcaattgattcatcatcatgaggtcttaatatcagaaacagaacttagttagttaatgcttcaccctatattcatctgcccttggataattttaagaatgttccagatatgacaggaactgggtaattagagctaggattttgtcattaaagcaaaattttaaaattccattatagaaaaaaatagaaataatatatttgcaaacaacacttttaaagacttgtgaagcaaatcatctacaagtggaatatttagatttcataacagataattcacaaattatgaagttttcttatttgatatttaatttcactaaaaaatgttatagtaatgttcttccttgatgaaacctagcacacttggcattatactctgtgaacatgataatcttcagatttgtcagggtttttagcttgtttccagttacgaaaaaaatattttcaggaagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaattcagtggggattccatgttatatgaaaaatgaaccactaagtaaaatctgtcttaataagtttatgcatcatttactctaatactgtgtgagttctgtgctttgatatccttttctagcatttatccattcctagtggaggtattatatttctgctacactgttttgcaacaaacataacatctgaacagtttttgggggttctgttaggttccatagggttaagcacttcagctcagacagatctgaaaggcaaattttgaaaattatatgtaggactttaaaatgatgagacaatttgcaatattgagtttcaagtctgtcttagggaagtcagaagtcttaaggattcagtggtggagtggtgtttattgtcttccccatacaagcacgattttgtatgcttttatcaaatataaaaccagcagtttgaagtaaataaattattttcctttgttaagtcaaagccaactcagaattattagaggtcttgcacatgataaatgaatcttcaaaggcaaatgtaaagatagttttgtctgttaggtttttaaaatcctattttccttgtgatgttgaggttccatagaaactactaatgcatattcttctcttttcataatagttgctggcttcatgttgataactactttatatggagcttcattggacctgttaccttcattattctggtaagcaggttctgttttcccttgctttttagcttgctgctttagcagtgctattcaaacaaggataatttgttttattgtttgtttatctatctatacaaagatttataaatatgcctgtctcacaggataatagtatattttaaatattttttataaacttgctaattaatatttctgaaaatctttactctaaaaagtactttttctcatttctaatttaataagctgacatatcacatcataatctaaaaaacatgcttacatataggccatgttataaattaaatgaatatgtcagaaaagtgaaagaatattaccttaatttttattatcttagtttccacatagtaatttaatgaattactatgtaattctaatgaattaattttaagtgaattttaaatgaatatccacatcctcaatgctttttagtatataaaaagttgtttaagcttgcattaacgaatgactattaaatcaacttaaaatttattagaaataaaattacttctataagactgaagataccaaatgaatatactagtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattagttcggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtcttaaaaaaaaaaaaaaaacttgctcagttgtagcactatggtgagaaatggtgttattaactctgaaaaggaaacataaatacttcctattttaagaagtttttcttacttttttttcaaaaacgtaacacaaatgagctcgtttggatcttttcatggttaagcagtgtttcatgaaattgagaaaaacttctagtacttgaaggaaacttaaaaccacttcaagtgtatatttgtttgtcattaaaattaattattttacacaattacttatacaaagtgaaatgaaaatttgagatgaatgcctgtatgaattaaaccagtaaaacattctcaagtattcctgggaaaactgatttctcatcagaattattaaatctgatgattgcccaagtttttgttcttggtgttcatatgttaacacagcctaagcctgtctagagttcaatggctgacatgaagaggcatgatccttgaagacataaccttccattttcctctaagaccttcgtcaaacacataagttgcaaaaatgtaaagactgctttagggatatttggccaatgaggctatcatgtgtttactccttttatactgtagttttatttatttgatatctgtgaagataagtactgactttagatcattaaaaaacatttcaattagcaaaagaagttaattttcaacatactcagcttttagtaagaaaaaagggtaaaggacattttattatgttgttcatttatagtagagcacactattactttataagtcttgtcattattgtcctctaccaaatccttcaggttgagatgtgaatggctttttcaacagcattctcaaacacaaaccccagtaggtagcaatcccagtacagatcttgttggaattctcctgcgattgctttgctttctaattttcccaacagagagaaattaagagtggtataggagtacaaaacagcgtcttgcaaaagaatatctaacttaaattgagatatgatatgatgatacagtgtgtgtggggaaaaaatatatatatatatcttccctctggtgatgataagacatgtaaactcaattcaggcacaaatcttaataatatagattgtattgtatactatccttttaaggaatattcccataacaacaattacctattgctattcctaggaaagtatagctttgcattttcagtttttctgaattgaaactgtttcacttagttgtattaaataggtgtacattctaaataataatctatgaagaaaaataatatgctaaggaagataaaacttcctacttctgcatttctataggatgtcttgcctacaggcactagagttattatatctatgagaaaagtgctggtaagtaatgagcagtgggaaaccattagtatgcctgaaatggtttaatgaaagcttggatcatgacacgtcaggagctgttcttatcatttggacagctccatctgcatcgttaataattaattcagttcagtaagagttcagctcacacactcatttagaagtcttcttcagagaacacctctctggctgctagtcccagggagaaataggtttctgcttggctaacagcaaagatctggagatacaagtatagctttagagttgcatttgccaggtagcaaaagctccagggaggacaaaaagggtcagaacgtgcacagttcagctaggttacttcagagtgatgtttctgttcttctgtcttatcatatccatgtcagcactgcaagctgtggaatgaattttaagctgctaagctcagacggatgtgattcaattgagcaggttgatgaccataaaacaaactgtgcactcctataatctgtggtacctttttctttcttaaaatttctttgtatttttatgttcatcaatatgggtgatgtttagctgtgtcatatcattaagcagtttgaattttatcagcaaattatattggtgggttattataaataataatttatgaaattattgtttggggataggtaaaagaatgatctttgtcagtgggagagaaaaaaaaatgtcccagtttgatgacttactctttttggctgaataaggattttttttttcttgatttgttctcactcaacagacttatcttaaaagatagccatctatttacctgtacacacacacctgcacacagacacacacacgcccagagctaagctaaaatctgattcttgaatgagttgtttcatccccagaattaattattagcatggacatttagcctggtgggttgtcatatgtatgtaccacaatcctaatagcctatacttactagtagtggcttctgtgtggataattgagtaactgcatgtacttaccaagtttagacaaatgtttgtgtgcgcagctgtaactccacctttttcctttctcactgatgcatgcagcctttcaacctatgccaaaatattatgtttaaacttcgtagtatttacactgaaaagaaaaaacaaagagcaagagggtcaaagagtggctgcattggaattcaagggagaagagcagcaattggatggtagagacattgttctctccctgcctctttgcctgccttccattgagaaataggggaaataccatgttggatggttgtgatttattttgtaaatgcgtatcaaaggcagaaaaataaattgggcaaaagtaaaagtaaggaggagaaagaaatcacttattataattggtgggggcgggggagaaggggaaagcacagaagtatatggatggaaagagccatttatgtcatgagaaaaatgcaaagaagaaaggaactcagacttgcagccagtagtttatttgaaacctaccttttttgtcttaaaatgactacagatttttatcaaagatgtgtttatttgcccctctgcctcttgttctcatttccacggttgtattttaagaaaacaagaaagaagtaagaaaggggaaaaaatttttggaatattttcccctgcaaaattataattatcagaatgtattgcctcctgaaaaagattgcagcaacaatatttattctatcaaactaaaatttagcattacatttttttaacattggagaaaataagataactgtaaaaccacatttttaaaaatgtatctgtgcttcagtatatgttctatttaattccagaagatattttattgtcatatatgttggtggtaacataaattgttgagcatcaaagtgatataaaaatttttgtatttctctaataagactagtaaataatatgtattggtgaaatttttttctttagttgggaaaaagaaaaatcttattcagtattattttgccatcttacgatttatgtcatatgctttatttcataattaattagtcttgaaatgatgatattttgtcctcttccacataccattgcctcattatttgtatgctttcaagtcatgtttcagaggctaagttagtgttgggtttaactataaatttctttacatctagatattagtgcattagctaaaagttttattttcagtttcttcaagttggagaattcagacacttgtaatttgagcgcaaagatccctcaaagttatgattatttttccaatacttttagttgtctttaaaggaactcactttcaaatcttttaaaacattccattttaagtatgttagaaacagctttaaaaaattttgttcttacatttgcacttggatttatgagcttatgtgatatttagcaatgtaaaagtataaatgacataaacaggtttagaaaaaatacaactaactgttgttaagcatgtgacttgactagtgggagtagaagcgtggccaattgctgattgtgggatgctagtgttttacaaaggaaatggagaattagttaattctggcaaatccgtcaggcagaagtcatttgatgagcatacctattatgtaaataacataaataggatttctttgaggcagtattttatatgttaatttatttatcttcaattcattcatctctgagtgatttttaagttggattactttttatagaaatggaaacttttaaatatagacttagtatatctttgttaggagacttctaatcttttcacccagaataaattggttaattttatatgggaagtctgtgggctgtagagcccagaccacagtatattgaatcccagccctgaaatatagtatctaagtaatctttggaaggacacatctcaattatttgtaaaacgggtatacaagtgctgcctgctaccactgtatataggattgtagctgtatttttcctctgtaattttctttattttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaactagaatgttatggaaaataaagccagataatgtttctacaattgtatttactttttctctagatgtattttaagacattattaaattttttttaaacaaagcactgtttttgtccttaagtaattaacatcaaaggacagaatgttacctgccaacacttgtaaaattttgcccattgacctcatttatcccttaagagggaattctccatctaagagaaatcatagggcacagtggacaaaatgactggatagatacacagcctacattaaagctttccttagctctgctcctaaactcatcattaggaaggacttggaaatttttatttattgccctatatcacttttcctaattataaagtcagaagtagtgaaagatgaataaaatagtgttaccatttgatcatgtgatattgtgactcagtaaaaatgatcatgttactgtaacactgttatgctgattatctgcaacaaggaattaaattcatccttacctataataggtgaaatgggtctttttctgaatatactatttctggtattctcttaagtaacgtacagctcacaaaatgacttttttttccttttaaaaagtaatctaaaaataaaatggcaaaaaaaaattcaggaacaatgtagcttagttctatttttggagcataaaaatggaactgcctcctcttcttccaacattctgccaggtgtctgtagaaacaaatgcaaattaccaacctttgtctctcagtcaaaacacagctccttttcctctgagcaagctcatgttgacctcttggaatccactcactttccttcttgtcagattccatcttcctcattttgcttttgtttgcacctagattctttgcatagctgaatgtttagaaagactcaaaacagcattttgtcagaatgtatctacttccttacaatacagagacatagaaaaaaaagactgatgatggcttttaacagttaaatggcaaaacatacctatataaactttatcttactttatataacaaacgtttatcatgttacttcatttgatccccacaattgccttatgaatagattggacagatgttattatcctcatttaatcagtcaaaatcaagagctagactcacagccaagacttatggtttcaaacccagcaattttgtagattacatgatgtacattatgtaaatgctccttctaaggaattcactttagtgtttccatcagatggtttttaggccctgaagtacatctagctaaagaaactaatttaggttttctaatttatttaatcattaccacataatactgacttaatgaggttgcaatttgatgtcaaatgatctattaaagaattgatcatacatagccagagtattttttatgtagactcaacttgatcattgcatacataaaaaaaattatatcagtatcttccatataaacatggatcgatacatttgcaagaactattcatttttcagctctttgttcattgtggtctaattctttatttgttacaacagctaaatattatcttcttggtgatcacattgtgcaaaatggtgaagcattcaaacactttgaaaccagattctagcaggttggaaaacattaagtaagtattttgtattttaattttaatacttgacaaactaagtaaaagatactctccacagggaacacagggatttctaccttctatcaactgtagaaattattcagaatgaagttttactgccctcaagttgaatctcagtgttactatatcactgatactggtcaaaaattagataataattgctgtcttgatctagagccaataaattgtttcagtggctttgtggaaattccatatcactgtagcaatttcatttgaatttaaaatgcagttcaaaatgattttcgtatttgcatggctgatatgattatattaagtttgttttgttaaatgactttttgctttaaggattctgagcagtttccactcctaatcctgttttcctaagagaatttactctattactattgttaacttgaagattatctgttgttttcatgctaaacaaatatttactttttcttaatgttgaataaaagctgcaatattctgtcaatggagaaaatgctatctaattaacaacaaatgatagctgttgttcattaaatcatcttatggaaacattttcagagttacctttaaaatatgtgagccttgtaatttagaatttgagaaggtattattcaagttggttataatgtgattgtaaaaaatactatttttaatgtcaaaaatggcagatctatagtaagggtaaatttttttttaattagatgttttagataggttagtgccagcttcattgcatgttgcatggtaagagagagagctaatctttagcatctctctcttttcttccttttcctctttctgtcttctcatctacaccagtaattaccgtgtttgtgatggctactataatacggacttacctgggtaaggtagaaccctacattaacaaatttatggcatgatttgtattttttacaaattcgtcagtatcatgaattgcccttaatttttataattattttgaaatatctaatttgctatagtatttttaaactataatatgcctttattttttaattgcttgcctctgcattttgactttcttaattttgactaatttataaaatatataaatgctttcttattactttctattttaattctgtctaataattttgtttctcttttctgcttataatgctttctagctatgaagataataagccatttatcaagtaagatcattagttagacatggaatgcactgactttaaatccttctcattccgtcctattttctacagttcttttcttcttaagctgttcatgacgaaatctctccaaaattattttattttgaagttgttctcatgtttttgtctcatttcagctaggcttcttcatgctttagttataaaaccttaggttcacctaagactagtttattagaatctgaagtttaggtgttaagtgattatctgccatttaacctttctgtatgtgtcacattatttagtgtcatgtgagtacaccataggaataaaaatacaggagtaaattaattaagcactccttaatttcttttatcaaaatgcacataaaagacaaagtcataggggatatgttacacgttgtattttaatatagttttgatactttgtttattctggaataagaaaaggtcatacctgctgttgctgttttcactggaggctgcagtactaaatgctattgttctttcttaatcagagaaaggttaaaaccaaaatgctgttgaatatgaatgtgaacatagagaaagtcaactgctactactgatatgttaacatttaagcgtgatgtgtgttttttgctcattgaacctgttaaaaaagttcactttatttttccaggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtaagtaattgaaaacacctaggggctcaggttactcattctttgatttgaatataatagatataataaagaatattttaagtcacatctggcatattgttaaagagcattatatttttaattataagttaattttcatacctgtctgaaaatttaggtttcacctataaaataataccagtcatcttttgtatctcagtttgggaatgttataaactagatacttaggttaagatttcttccttgctcgtagggtctataaaatgctaggtacaaaggatatacaaggtaaaagaaaaggttaaataaaactcattctttgctcactaaaggcattacagtgattcacagtgaaatggagtataaggataaatgatgttaatttttaaagcaccagacatacaaaaaattaatgttaccttttgagtaattttgaaggatctaaaaatcaataattagtaccttacatcttacttactgttttttcctgattttatgttaagtggagtcagatgaaacttacagatgaaaagctttaatctgtagcaagaagatgtaaacctaagggaattgcttaggtgctatttaagtataaaatttccatacctttcactgggtatcatcctttctctgcctacatatctaatgtagtcgttttattctgttattactagttggtcactaaattgaacagagaaatagaattgtggaagtgaaagctattatgttttcagtcctgacaagacgatagtgttgttacttccatcagttttgaataagctataattttgagataatgacagtggaatgtgcaatactgacagataatgtatattcacagcaatataggcattaggcaaaaccaacactggaaggtattatttggataaaataccattttgattgccattgtcttggttatacagcatttcatagcagttaacacccattaaatgtgttgaaatcttttgtgaggtatgatgtgttatttaataacaatgaactttaacttctaaacattgtacaggggtaacattagtaattactttggcttttatatatttcctacataagtgagcattttattattgtatgttcataatttttgtgctgttgtgccaaacatctttgacacaaatcatagacatagcagaaaaggagtgaggtagtcattatttcctcatatagttatgtgtattaaatggaacaggagagtctcttatgctttttagatttaacaattacattttaaatgcatcatgttatacttcaaaagaagtataacttagtcttggatacatccagttgggtgcgccaggatgagttgttaagaatatgatataaaatggttaagttaaaatcatggttttaactgcttgaatgagcatacttaggccaagaaaatgctttgaagactcaaccacattgttatttgttctaataggtataactaaataaagctaaaaagatgaaaatgtaagtgcgcttagatttaaaaggccatctactgatttttaattttctaattttgcaaggaataagtgtcaaagtcatggtctttacaggcagttactgcacacagacttctgagttgagggaaagcctttgagtgtttttgtaacctattagaaaaaatattttcttatgcagtttcttcttgtctgtcttgtaatttcacagtctggctctaacccacaagaaaacatgtatatgccagtatagctgcaacagtccagcagcaccctctccctcttaattctgtaccactgctttagatggggccctattatttagcagttgttcggacttcactttttaaagtttagttgaaactttttttagacctaacaactttttttttgcattcatatattcaagcttcaggggaaaagggaaattacatgggtaactcattaatgtgaatgaaaattgcataaatagttcccttgtgtgctaatgaagtgaatagacatcttagactctctacactaaatgttaaagctagacacatcagaaaatgaagaaaacattccttcctaattagaggcaaatgtatcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacacatgtattcttgaataaaagcttaatacattccaatttagtatgaaaaattatatggtattgtatatatccttggaaaggtaatttattacactattttcagtttgatatgtactgatttgtaatacaagttagaatttattacaatgaaatataatgacattttaaactgttgacattgttctagtgagattctcatttaaaatggaaaaaggtgtatgtgtggtagcaatactaacctgaattttaagatatttttatccaaattacattagctatgcaaaacataatcagtaagtatttaaaagtttgtaatttgtcagttagaatgaaagacgtgcatttcttctgttgctttggtattttacttcattctgttggcgatcaaaaagtaaatgcattattcaatgattcatttttgaaacctggcaaataacattacataatgaaaattcttgttatatagaatttgtgaatgatctaataattcattttatagtcttttttttctcagcatgtgtgcttttgcatttactaagagaagctttttgcaatgtgtcatactttctacctgtctgtgaaagttgttttcctcctgctcagttggtattaacacagatgttttcatgagggataatcccacacctgtaaattctgaaagtttgagattccctcttctgggcctcagtggttacgtttttaatattaagcagtaacatcttgaaacataatgttgatctctatgcatttaattgccatttttgtttaacagtgcttttgtataaattagtaaatgtcatcctcagcaggtgtttacttgggggatttagaaagcacctgtgaattactgaaatttaacttccctctcccttctctcctgcaaattagtagttcaaatacagtcagaacatttcaacagattttccattgccaacttgtccactacccttgatgaatataaaaaaaatagttgactacaactgtaacactaaaataagaaactgatgtacttttctctgtttttttgttgttttttttttttactttaggaatgactggcaattacctactaacaaaccctcttcttcgaccccacggcactaacaacccctataacacattgctcgctgaaacagttgtatgtaatgccccttcagctcctgtatttaactcaccaggtgtgctttacttacaaataaaactacctttctttgctgctaaacagagctatgatctttgccctgtttctaaaatattcaagttgtcatatatttattgttacattcttaatttctcagttaaaaaaaattacggtattgtctatgccaggcttctaaaactgcactatattatagtaaaagctcagtcatgatagtatttacaataatgatccatgtttttaacacaggtggcataaatcttaatatattattacaggactgacatcacatggtctgagagcccatcttcaagatttatatcatttagaggtatcctatctatataatatactgttcagttaattctaaagcttgctgacaaaatttgcttctggaatgaattagctaatgaagataatttggatgcctagctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatgaagctagagaattgtgtctaccaagttaaaggaagccttacaaataactatcacaatttcattttgttgcacatggaacatgatacaaatttgtcagtttttcagatgtagaagttgggacagtctttaagacaatacaaatcactaacaaatataatctctcattttctcatttttttgctaatgataatttgcccaacaatgatcacatatttattggtcatgaagtttgtgtcaggtgatacagatattttttttttctgaaggaaactgcattttctaggatatctgcagctttaagagtggagtgagcactaaaacgggaaatttcgtatttttttccaagaattaaattttttcctaaactcctccaagccttgcatacaatgcagcagcctcacagtggtcagcttcatttcaataacatcatttcattctttttttttacagacctatctgtagactgtgatttttttttttctctaggattttgagaatgaataacctaactttccatggtgcagaccatttaattttctcttgactttttttttcatttgcttgagaagcactgtgatgtcttagtttacatgtttatgtgtctgtagaaaatacaactctgattcaaatagagcatgttaccatgttttatttccccctcctaaacctcttttcctatcttcagcagacttatccagtctttcattcctttagagataaaaatatattagccaaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaatatcaagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatatatattttttttttttttttttttttttttttttttgggacagagtgtccctctgtcacccaggctggagtgcagtagtgtgatctcggctcactgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaatttttttaaaggcaacactgattattcagttagtcctatttctttctcttgaggcagttctcaaaactctaaagacatgaacactgcatcgtacctaaatggctactgttctctaacgtctttatcctatggattcaatttggaagccatcattgatctttggcatcaaaagaaaagtcatttttaaagcatttcttttcaaaaatatataaatattgccttaaattccatctaggattcccttagtacaaggtagtttcttaggtttgtaattactaaactactgactgttttaatgcagatgcgttattgtatttattaacccagtttctttgggtctgcctagacttcacctgaatgtacagttttcacattcttgattgtttctctttgtgatagtcacaactgtgaacttataaagtcacatttttaaagttcttcctagagacattcactctgtctttattaaaaataataataataataataaacgttatcttgttggcca

SEQ ID NO: 2313 - DNA, 193536 bp, Homo sapiens
  source 1..193536: mol_type = genomic DNA
gcggcgaacagacgttctttctcctccatgcagttacacaaaaggagggctacggaaactaaaagtttcggggcctctggctcggtgcgtggagaaaagagaaaacctggagacggggtgggtgaaagacgcatcccgggcgcctctccgaagtccaggccgggagcaagctcctgggcctagaggggagggggccccgagccgctggtcatccccctgcgctcagcctcggagcgccgcgcttcgcggcgctctcccaaatactcttcacccactccagaaataaaataaatgtttttaaagtgcatgtgtgtggacaggatggagagcgcgcgccggcggagcgcgcggaggacccagcgcgcagtgagtggagtttgggggtgggctaggggttagcggttgaatgggtgtgttaatggggggagctggaggcagagctcggggacctgggggtagggggagcgcgaaccgactgggaggggagagaaggggaggggcgcgagctggcgcaggccgcctccggggcgcgttccacggccgtgcgcgcgcgtccctcgccgccaccgccgcccggacagccctgcggccgccccgccggcggagccggggccggcctggtcctcgggcggctgcttggccaccgccaccgccgtccgaagggctcgagcccgtaagtatcccctttcgctcctcctccccgccgcttgggcgcacagccgcagcagctgctcaaatggagtggaaaacggccattgggcgacaatgagttatagattatctgctccacgttttgtacttagctgcctgtaatcttcttttgagtttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccggggccaccccagcgtcccgcccgctttgccctccggtcccgcactgtaagtggagcggggaggctgagcggctggagcgagttcgggggaagtggacggtgggggagggcttggacgagtttttgagggttgctgttccttctcgtcagtggttaggtggtgtggggaggcgaggatgacagtaaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgttttattagtaaaatgaaaaggccacttaattagtttttaattagtctctaaaacaatagaaattttgtgattaaaagactcatttgtacacgtaggtaactgttttttatgtgctaaataaatagggaaaaagtcagcggaggatgctgaaaattaaaacctcaaatgaacttgacacaacttctgttgcaaaaagaagcttggaaaagttttttttaagtgaagattcaaatttttgtgaattctatttaaatagataattctgtttaaatattgttttgtttcaaaatttttgtatcttgtcaaacagtaaactctagtattcagttggtttattttaaaaaatatagtttatttgttcttgcttttttatgtttacagagagaacatatctttgaatttcttttaacaattcaatatccatgaatgaaaaaaagaacaagtgcttgggtcatttgggttagttatcaagtgcagatgggtcaagggggaacttttatcttcaatttcttgggaagaattagttttatttatttgacttaagaatttacaaaacttaattctaagatggaaatgaatttcaggggagacttttttggagatgtaagctcatattttttatagttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggttaaaaaaaaaaaaaaaggccacattgatgtaattgctattattgcacttaagttgctgttaactagtctgctttgaatgcagagtgttataaagaaaacaacattatcctttacagctattagtgataatctaaaaattgtcttgaaaacattgctcttcactttatgtgagggtgatcttgaattcagtaaatctctaaaggtgcaaaatgtagtgaaaagaagatttttcaacatttagatgacaaaattggactacttagggaaaaattaatgtgttgtagaagaacttcagctgccattttcaatcactgggttactatgtgttggcaacagaaaacgaatttagaaatggagatagctctgggagcaggtagttggggaaatcagaatattgaatcatgtggggtagaacaaaccaattacttcaagttttgacttgagaatttccaataagtataattttttccaggcttttgactgtctgctttattaatggactaacatcaaagcaggcaacaaaacttccaaatgttataaaaactaatgtaaatatacagatctcacatgcagtaatacaagtctaaatttaagacaaacagttggggtttttactgctgcaattttcacaatcagcagaaacattaacaccaggcttctgggtgtttccttttttgaaatgagctagaagagagctttaaaactaaggtttacttagggttaatctttatttgatcattattgaagctttctgtgtttcattaaatttaaaatagcgttttagtatcttaatataagaatatgtgaattgagattgagatgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaaattcagacacagggattacaccttaatctttgaatttcagtgttgaaattagttatcttaaaagaagcctatttaaggctaaaaagtctttggaggactttttttgcggtagatttagtactttaataaaaacagaaatatattgttaaaaattgggtaggttaggcagatgttaacttcctgaaatatgtgaccaagtcttaattctgttttaaaatgcattaagtaacatttatatatatttttaaatctgataaaaaaagagatggagataaaaatgaactattagttcttggctatgagagatgggagaagttgaaaagatggttaactttagacttagcatcaattcaagcacatgttaatttgttagaacaaaaccagatacaatcctgtctttttttctgaatgaataagaaaaatcttcagccatcatactagcgaagaaggatgcaccatgaggttcctaataaaaatgggcttaattttgctattttcaattgttaggtagtacttgttaacccctttcttggtcacacatatgtacatacataaacacacattttatagtctgtttctctgtatatatcaatacttgttgtttattgttggctaaaaattaggaagttcaaaatgtaaaatatgtatgattaagatatctcttttaaaactgattttgaaaatggtatgacataaatatctgttttgctgtcaaatatatctatatctcctgcctgtggactgagaaatgcttgtactatccacactttgcctccttttataggtatttttacatcagtccacacctcaagctagttattactctggatttagatgacagcataatctaacctcaattactgtcaaaaatggcacttgactgctgggggtgggttaggtgaccttgttttgactaatgctttctcttgaagatgatagtaaatagtgtctatttatagagcgaacaaaagagaattctgttttcttcataaagtaagttctaattctaatcatttattcttaacattgtaagtactatgacagcagttctccatataatgggcaaaccattacaagattttagataaaatttttagttgatacaatatttctgttttatgcagactacgtttacttaatcagttttcagcttcaatttacataacaaataatcatgtttaaaatgagtttccctgtgtctttactttgaagcaaagtatttctatgtggaattattactcctttattaaactggttaccatccatacggaaattttctctgcattaaaagcctaccattttatagtgtttgctactgtggttattgattagaaattacagaacacatttcttatgtaccattttctccactcatctttgtgttcttaatgtcaggatgcttatggcgtattttagttcttacaattcctgactttcctatggttaaaatctaagacattttgggaaacattaattttgataatattctatgcttatgtatttttgtcctagtaattgtacatttttttttagtttgatgaaggcttaatgtattaaatgacagaagatatactgaagattcgtgtactgaaaataatacatctctccaatattaaagagatgagcataattctaaaacacgtcactttgcctcatatgcgtcgacaaataaaaattacactaaaattataatgtcctagacatgttcacttttactaaggacatataacttttttgcgcttttcagagttctctctgtcacaaagaagacaatgtttgaatattaggtgcttcctcttgatagctcaatagatgaataaataggaatgttctcccactttgctttttctactacaagtgctatgatacccatagcctgcacggaaatgacttttcatattgttacgggttttaaactagatctacagcctgaatatctaaaaatgtacatgaaacaaaatttgattactttttcttaagcagaaaaccccacaaaaaacactgctgatttgctgttgctgttcctcttacctcatttgtttcattgggaaaagatataactgatacctcagtatgatatttctgtatgttttagcatatcttataattttcctttgttcaataagaaccttagttttaaaaagtcacttcttataagcctgtcagttcatttctaggtaagtcaaactggctttgcctcagatttccagtcagtatttacatgttatcaaggtgatatgtttatgttggaaccgagacattttaagggagagaggggcatcagcgttctgcagcaacacgttttttataacacgttgcccccgagacttagaaactgttcttaactttctgttttttgctcccttggcagagatacatcacatcatatctctgtatacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgaccactaaacatatcaaagtgtattacattcctctacatttaattaatagaccagattagatgagttgcatatgtgcttttctaaacagaaaaacgatcgctttggcttaatgacttttacttgcaataatggacatgagttcaatgacattaaaacacgggaactactaataaggacctactattacatgatttagaaaactgctgactaacttgggaaaaaaatgaatgcaggcagaatagacagtacttgattgaaacctgaattctgtttatgactctgtgccagctgaatttctaaggaattgtaagccagatacttagggaagtacttgagagtttttcattcgggtgtttaggtaagcaggatgataagcttttagaggcatttggatattttttagtgagtagaatttttcatatttcctgcatacacttatttgtgccaggaaatttaatgataggatattatattacattttattaaaaaatcaattccagtcttttcatttttccattttggtatagtaacattattttagaatttgcttgttggttggtaaaaaatagaaaggttattatccattatgtatctttggaaagagatgtaatagttcatttctcttattttatcaagtaataatatgacaaaaatatttattttgcattttaaaaagcttcgtttcttaatgaaattccttgtttcagatttattattttagtagctaatctttactaatgtgaaaagtcacattgttactgtgacaaagaataatcctctaagtaaggaaacttgtttaataaagagatttgtggtactggtatgggcttttttataagtagtattctctcagcgtggccccgtattatcttaacaagtgtgtgccacatttatacagagcatttttataatggggtaagaatattagcaacagcaattatatttcaataggattaagatggtatgttttacaaaagtatacaaatgcttcttttccatacaattattggtagatactctttactgccaaatttatgtcattgtcttaaataatataaaaagatatttcttatcgtagctggtttttaatataataggcactgcaaaatgggatctgatgttatagttcattaccttttttccccctaatactaaaacctccttcacagtgaggtaagggttactggagatttcattccaggaaaatggttatgtgaggcacagtaactgtcatagagtgcataacttctgtgaggttactggaaaggcacagctagggtaagttctacctgttttgtcttaaatttgaaggtagactactgagcgatttttaaaatactgaaatctgaatccattgaaaagaaattgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaaactattttttttgagatacatgtttaagaagggaaaaaacccatttgttaaaattacttaatcactgagtttttatgtcatggtttagaaaatttattaatttttagtgctctttaaatcagattgttggtttaaaagatactgttattttgaccaaatataagtcaaagcggaaaggtagttgttaatactcgtgtcagaggccttaactaaaaagttagctatgttcaaggaaaagacttagtccaacattttactatttgacagagcatcatgctgtgttatctcttagtagtagttagtggcccacagtagctttggctaatgcaaaaatacctgtacttttgaaagtatttgaatttcacctcgagaaaatctttgtttcatctcgttgctctgtaggattcagataacagctacaacacagtaaggtattcaagaatacattccaaaagcacttttctatcattgtattctctgtaagaattagggttgattctcatcagagtctttattagtattattactgcttaaaatattttatagaattatggtgacagtttgtacaaatagggtgacatagaattataatgaacttgatagtcaaacataacctttacctactttaatactgtagttactccctcatacctcatgtgttttattttttactaattttcttatattgtgttactaataagaagtacctaagtcctctgacatttcagcttggaaacctgtcattggtttcttaaaattagaatagatttaaaacaatgattatttaggttaatattacatgattaaaacatccgataacgaagcataagtatcttagaattcacattttctggagttgcatttcttaaaaacatttgggattgatttttaataagtttaagagtatttctaaaaaaaaattagggagtaagaatgagctcttagaacaatactaaattgaatagcttgtagtgcaagcatcacttaagtatttttagaatattgaaaatcttgtagattacatacactaatggcctcattctccttattgcttgttaattctgtgaaaatcaagaggagcatatcaaggttgcagttaattcaccataatattagcttttaattgaaaataaacgaaaatatagctttgatttgttagcttattttattcaagtcagtttttcctatttataaagaataaatcaccataaactcttatgtatgtataaaattgatgttatcagatgtttatacaattgatgatattactagacatttttgcactattcttaagaatactttttattttgtatattgctttaatacttttaatatttcctcttatagaatgttttcttcagatgttttaatagtttgatattactcatttctgaatggatggttgagggcctttttcttttttaaaaaacatttttcactacttgccatgcaaactatttgatctcctaaagagaaccaggatataaatttagtaattagtatcaatgtataggtttttttatttaatgtggaattattatatggtgatgttctttggagtgttttcatgtgacttaatgtgtatttaagccctccatagttaaaaagatgtttacagtactttcatgtttggcattattcaactctttccaaagattcttttaatattttgtctgattatcatttattttaacctacaaatgctctttttatgcttgcctacttttattcaacctacaaaataaaactttattacatgtactttaccaagtccttaataagcttcagtattcagtattgccaagcacttattaaagcttcaacattttcttcctttattttgttaatggtatctcatgaatgttgaattcttagttttttggggctttttttttttcaagtatatttagggggtacaagcacagcctttttacatgcatgtactttatagtagtgtacccatcatccacataataaatgaacgttataccctctaagtaattttcacccctcacacttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataatacacatttttttaaaaaattgaagatcgttctcaattcttagtataaaaatcagaaatttgtctgggtctttaaaaatatagtacaaatatctaataatgtatttggttgtttagctgaaaggcagatgtttcagtctttggaattcaagactatattaatctaatactccttaaaccaacattttatttatagggtgtaataaaaatcataaagttaaatttgaatgagtaaaatcttgattttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagtccttggtgagaggcaatggcagtagacagatatgagaagttttgtaatggtgggttagaatttggcatttgattgaatgcgaggtaaaggaggagcaaagaatcaaagcccagaaccaaggttccagccaagtcttttatgtattccattagcctgctttagtggaagggagaaggaatgagcccattttctgatgatactttgagatgcatgtgttaaaagtccaaagtaccagctgctgagaaggttgatgctttgttggtatgtatatttttaaatgtggtatttgtaaaaaaaatatattttttcttccttttaaatgtttttaaatgttttcgagtgtatacctgcatatgtttttacactgcatatgtttaagtgatactaattttttttaaatactcacataaagtgaaaatttttattatgcgatattcaggctacatgatctaggtttttatttgtattttagatgagatttctagtaggtaatcaagactgtataaaagctatcgtaatctggttagaaatctttattttgctaaagaatacttttgtcattattagacctgttgagatactcttcattgttcagggccattttagtaacattcttaacagctctttaaacaagtaatttgatattctttggtttccttagataccagcctgccccttttcagaaagcttagggatatctgtgccctcgaagatttaaaaaatttcattgcaatttatcttcactgcagctttctcttttgttaccatgaacttctaatattatatatttattttattggtacgtggggaaatttccctgcttcacctgttctttaaaagagtaacaatcatttcctcaatagcttttcagctcttcatacccagcaatagttcttaggttttatagctgatactttgtatcatgttaattatgggtgacaaccctgaacaacaacccaaagcatctatcagcacctatccatcagtgattaactcagagtaggctctcaatgtattttttgaataaatgcttatcatcgattataatgaagatcacaaattgtgctggaacctaaccagttatagattccttgcatggatataagaatgataagagttacaattaaagtgttataacactgagttgtgtgtcctaatccgaaagtattcttgcttccatatagtagagaaaattttttgtgatgcagttacagtgcttaataaagcttcatacatggaaactctcagtaaatgcttattgttgtcattattggtgtaaattaaatctgaatattagttcacatatttaagtggcccttttggtatccgttttcactcttcagattttttttctctcattttttggggggaagactcttctttttttcaatgctgctcaagattttctattttttaaattagagaattttctattattgttgctaccttccttagatgataaatcagtagcaagctgactggtttttatcaaaattgatgttctgatattgagaacaggaagtgttgatgttgacctgtctgtctgaaaaaaaaaaacaaaaaaccccacaatattctgcttacactttcactgggcaattatgtaaaaaagatcagtagtttttccttgttttacttttataatctgatgcctggtgaaataaccacacagaaaacatgcaagtaggaatcttttgtagttctccatggcctataatccctgcccccaaatcatgccaagcattaggatccgcccatgtattaacagctttaagaggaagtcagtagaggatccttgtcagaattgtcctggtgtgtgatggcttgctgcttttttatgaaaggatcagtcatgccgaagacatagctatgcataaggtaatcagcatgaaataaagggaagttaattaaatatggttgtcaatactgtagttgtgaattttatttaactagttaaggaaactaaaaatatgacatccttaaaaagacatttttaatgtttataagataaaatacgtaaagaaagttttgacaatcttaacaagtccattgtcaaactattaccaggctgtgtaaccatctagttacttagcaacctaagtgaagcaatagcatttaatattttgtataaattttcagcaaaggcggcccaaatttttagcattagagacattttctgatatgcagggagctcttcctccacagttcctttctttagtgggtcattacataccacaggtggattatgtttatcttttaatggtgaaatgatagtttttctttggtggaggagctggttatctgtcttccaaaatgtcttctggtgacttgtattaagatcttattaaaatatcattgtgttcttgcattcacagcagaagactactgtaaattgcattatatgaaactgaataatatctatggtttaatttaaagtagaaataaaatctaaattcatacattcgagctgtagggtttcaagattttaatttggtgaaatgccggaacaatttcttatatttaatttgaggagtattacatgagaagtgcatcttatcaaattaggaaagaaacatatactatttacacagtctaattattaaagcatgttaaatttcacagttaatattcagatatctttctgtaaatgagttgctgagatttattgtcaatgttgtttgatttgtaaagtccattaagttgcaaatgctgatttgaggaatggtggcaagttaggatttcaaagtagccatgtttttttcagtaggctctgtaaatcattaatactaaaaagaaataacctgcaatgctgtgtgcattataggtaatatcagaaactttttttttttttttgcaaagcatagctgaagtttaattcccagtgtggaatgtattagtttttcgtatagaggtgagatagcccacaattggctgttgaactggagtgccgttgtctgtcttataattttggaggagaaaaaaaaatatgattttaatttttacattctttgttttgaaagatgataaaagtgttttctacacatgtttcccgctatcagaaaaaaatcactgttaagaggatattgctgatggaaacaatgttttctcaagttcagaatattgctagggaaatatgtagatgtggaaggctaccttgttaagaagttgtgcaagaaaaaaatctttaatttttatattttgatttataatttaatttttatattttaatattaaaattctaatatttttagtgtactttgaaaatgtccaatttgtacatttatataatccctgggttttatttttatttttaaaattttatttatttttacttctttttaatatgaggtcttgctcggtcatctaggctatagtgcagtggtacagtcatagctcactgcagcctcagacttctaggctctagctatcctcccgcctctgcctcttgagtatctagggctataggcctgcgccaccacactttgtaacacagtttttatttaatagcaaaattagcaagtatatttaatatagtttcatataatttcacattttgagataagtttgaaattattataaattgtttttgtagatactattaaattcctaaacttcatggaggaattattctactggatttgggcctgagttgcagattttgtttctgcagtaattatgggcctttctatttcttcatttttataatgaggagactctggttttaaaaactctttcttgaggggtttaatgatgaaaatgataaggtattgtatgtcaaacaatgataaattaaaacttccagaagaagtagtcatttttgttttctgccttatagattgacactctttaatatttaagtgtttaattaaaaaatagtctggcatagaaaaaaatcttgaaaatctctatttaggaggtctccgagttagttcccagttttttttttttaatttaactttcttacaccaacaagcaaagatgaaagtttccagttttaaaaaattctgtttcacacgagtttctgaattccatccactttgctttattctttccactattcatgttagtttccgtaattcagttcatttattcatgcctgcctcccttcctctctccttcccgttttttctctccttccttccttccttcttccctccctccttccctccttccttccctcccccctccctctttccttccctccccctcttcctgtctccctccttccccctacctctgtccctctctccctcctatgtttcttattgtcaaaaacatttattatgtgctagctctttgtcaggcactatgcatgggttatactcactggtaaggtagcactgaagtgatagacatgaaagccatctttcatcataactgtgttcagttagctcaccatcttttgaaaatgttacattgtgatagggatgagcactctgtactatggacaaaaatgacactgtacccctgatgtgtggtggaggtttagggaaccagtcagttagacagtcaagtgatggacccaactgagtcttggaaaaggaacagtagttagccaagggacaagtggcagaggagattccaggcagaaggaacagtataactataccaagaaaggtatagaagtgagagtaagcttctatgacccaagaacataagagcaaattaaataatatttaaaaaagaaaaccacgaagttaaaaaaggatggtcttcctcaagtgtagatatatttgctaaaaaataaatatttcaaaaatttaaatattttccagaaagtttgttaatatatttgatgtgtttttttaattaccaggatattatactagtcatcagaatcacaaagtgataagcgaaagtcatggtccataaggagcacttactctcttaattacattacataaattcgtgacattacttgtgcatttgtgtcatttctgtatcttctgaatcattgtattacttgcagtttaagcctcagtgccttgaacaaagtatgtacccaaaaaattttttaggcttggtttgaaaagatttatcttgaagaaagataaacatagaaaatttcaataaaagacattttatttattcatttatttatagacaaggtctttctctttgttgtccaggctggagtacagtggcctgatcatagctcactgtagcgtggaactcctgggctcaagcgatccttccatctcagcctcccaagaagctggaactacaggcacatgccaccatgcccagctattttttttaattttttgtagagatggagtctcttaatttgcctagactgaacttgaactcctgggctcaagccatcctcctgccttggctccccaaattgctgggatttacaggcatgagccactgcacctggctgcaaaagacattttaaaactagtttaaaagcttaattgaagaggactcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctctctctctctctctgtctttcagattttcaattaccattcccctttcattccagccccagttgcaactttcttgttgttaaaatacatacaatagggctgggcgcagtggctcaagcctgtaacaccagcagtttgggaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatgagtcaccgcacctggccagaccctgtctccaaaaaaaaaaaaaaaaaaaagacatactagatttgttgtgctaagttagagtgaaataataatacatgtacttttggagacattttagaaacatttctgagatcaacctttgtcaagtcagaaccccaactgtgttcttccatgtaaaattatttttagagtttgttccagttttatacacatttatggtttagggtgaaattaggaagattactagaggctggcaagatggatggaaggtgataaatcagctttgagatttttgcagatgttcagaaagaaagatgttaggacagagggattgaaagcaatgggaagaggattaaggtatttcagggtaagaatcaatagaacagtgaatgtgtacctctttaaaatgaagtaccttttgtattgacagagctatattttacccaaacttaagatgaataatgctccagaggatttttggtttcaaaactattggagactaggctaatttcatttgtttgtgtgtgtatccatgcatacatgcacatatatatttagtaagcttggtttaaagaaaatctgttacttcatagtagatgtgattttcttttaccatttcacactaatgcatttctttgttattataagttagcaattgaaggttatatgtataattcatgctaaattagtatattggtctagaaggtttttcaggagactaataatggagtagaggcttctttaatacatatgactatataaaacattattaatattaacagatgttgcactttaatcccctagaatgactggtaccagcaggagatttattaagcctgaattgtgtgaaattgtgtgtgcataagctgcaacttagactgtaaaaatgctactgaaaactgttaaaaagatttagctataatttggcagagaagtattaactgtgctaaaagaagtatgtgtgtatggttggcccttcgccttaacctttttatcatttatcttcttgtattaatgtcactgaattattaattcatgagccaggatgggaagggtgaaggcaccatttaaatgtgtggcaaatttatccttatcgccagagacatgaaaaaagtcattttgtgttatctgtaaaatggaaaggacattttaaaatttcatttacagtaatccacttcacttccagtcaaacacctagattattactaccataatataatgttattaaaaatttgtaaccttctccactcttttgtcttatatatataatgttgatagaaaaatttagccttgatttatttcagtgtgatacttgttaattgtaggttaaaaatgttacttttacgaatgatatgttatagtttgacttaaattttaaggaacagtagacttatgaaaaataaaaaatatttactgtaataataacaatcaggatattttcattgaggggagtccgcatatagggaattggaaagctctaaatatatgtttcaaagaaatgtttgcatttattgtgacttcataattatttggaataagattggtgatgttggccttgtggaacttttagcattatacaagaaacttagcaaattagaatttagcatttacttgttgaatgtaatgtggatctgggatatatccagtatttcatatggataagtagctatggtgacaggaatttcaagagtttgaagccacttttaccagcagctcttcgaaaccatcatgctaatggaagaatacctcaggggtcttgtccaaacctcatcacttttcattctcccgttatttactattttgattggttttatatactctcatgccaaacaaagtagtaagataagttactgtggtaatgtcctttgttttcttttctagaatttctccccgaacactctaaggtatacatatggctctgttatacacacactgaaaacacgaattgttttttttgagatagaatctctcttcgtcacctgggctggattgcagtggtgcgatcttggcgcactacaccctcagcctccccacttcaagcatttctcttgcctcagcctccagggtagctgggattacaggtggtgccaccacgcctggctaatttttgcatttttagtagagatgggatttcaccaagttgtccaggctggtctcgaactcctgacctcagccaatccaccggcctcggactcccaaagtgctaggattacaggtgtgagccactgcacctggcctgaaactctaatttgttttgatcagtaaataatgctactttgtttttcttattctagtatggttaatttacctttacattaacatttaaattaatttcttaaaataatagactaaagttgatttgattattttggcagacatgaatagttattagttcattatgtgactgaactgcatccagttatcttggtcttaggattgttcatctataaacaggggttgggcaaactatggctagccatcagttttgtaagtaaagttgtattggcacacagccaatgtcatttcggtatgcattgcctgtggcacctttcacactacagtggcagacatacatagttatggcacagaccatatcactcttaaagcctaaaatattttctgtctggtcctccatagaaagagttacctaacttctgatctgactgtctcaatctgcataaaatgttggttctaatccttacaaatgtagtggaatataattgataattttaagctcaagagattggaaaattcagtagtttttatcatcattggaaatgtttttttttaagcagatttttgcttttctttatatgtggagtagcaataataagtgatatttttcctgaaagttttctgaattgaaacattttaaaaaccattaaaatgttgcaaaaatacattagtctgttaccacatgaaggactcttggcaagtaattcaagcttctagtcatttttctctgctttttataacctatgtttcttttttattaaatgtcactgctttattactactttaatgttatttgaaattttaataggttataaaattatattttaaagttgaaaaagctcttttctaaaaaccacatacctctcctactccatgtttgagtagttaagaagcactaaaacataaattttaatttaatggaagaccttttggtttttaattttttcatacctaacagccactcaaaatgacacagtctgttactgtttcttaataggtgtgtccatgaatatttttcttaccgtctcatctaaatctcctcatatttttttttttcattttttttgggacgaagtcttgctcttgttgcctgggctagagtgcagtggcgctatcttggctcactgcaacctcctcctcctgggtttaagcaattctcctgcctcagcctcccgagtagctgggattacaggcgcctgccaccatgcctggctaatttttgtgtttttagtagagacggggtttcaccgcattggccaagctggtctcgaactcctgacctcaggcaatccacctgccttggcctcccaaagtgctgagattacaggtgtgatacatctcctaatattcttagaggaatcagctacaccaaacacagagtttcaggctgacatgggaagccaaagaatctattctgttcattcacttagactctagctttatctttagtactattaattaagttaattatttagaaataattggtatattccttttctgtacaactcaagaaaatccttttgttttgagttttacttgtagacacagatataaatggtatggaacatttggcataatcgggactaaccccagctaaggcatagaaacttgttctttcttaaagaagtccctgatgttgttttgaattttcgttatctgtagttttcccaggaaggcagagtgtgaaatatgtgagctaaatgcttcaggttattataatattcctgtcaatataataatctataagtagatttcaaaaacaaagattttctgaaacagttgcttctttttaagatatgaattagaataattgccgagacatattttgatagaagagacaagtccttagttaaacatattgcagaagcccccagatggcttccttaacattacttaaggtagaatcaggaccataaatttatcattgggaaaattggaaaatgattgaatcatagatttataatctcttcctacccttatatagttgctgaacttgagacctagatgcttgctactgcagtccttgtaggggcaggttgagccacgattctatagtgtgcacttgatctggatcttgacctcttcattaagatgactgattgatctaggtacacgtctcaaggaaacacagatccagaaactgctgttagttacttctcttagcttctcatcacatttactaccattaagttttgggaggtttagtaattattatttaatgcttattttggatcttggtcattttcttgcatatttaattctcataagattattaatttcttgaaggtggcagctatatcttaatctgttttataatgcctttagaacctaacacaggaccagttaatacagaaggtaaaaaaaattaatgaataacactcgttttagcactggatatccattaaaaatgtgtaggaagtactcactggatattcattgacttgactggacatacatgaaagtatagtgctaatgtgatctactttatgttaaaggcaagaaatgtaagtttagataacactatattgacatagtttgcaaatgaattgtatcatttaattacaaaggcaatgtgctatagcacttcacaaaacttcagcttcttactgtgtattctttatagttaatttttcacatatatctatattttattttatttttttgagatggagtctcgctctgtctcctgggctggagtgcagtggcctcatctctgctcactgcaacctccaccttccgggttcaagcgattctcctgcctcagcctcctgagtagctgggattacaagtgcccgccaccacgcctggcaaatttttgtattttagtagagacggggtttcgccacattggccaggctggtctcgaactcctgacctcaggtgatccacccgcctctgcctcccaaagtgctgggattacaggcgtgagccaccgcgcctggccaatttttcatatttatttttaagatcatttgatgtattttactcagattacctcattacctctaagaaacctctgatggtgatattgatgatctaatatatgacagatcctgggtcattattatttcatttagtggttgtatatatagaccaagagggaatttgaatattgattcggggaatggccagtaacggtgatttatgaacaaaggatccagtgcagtgagccaaacataagattgcatcttatgagtgagccacgttgagttttttctgttatacttacccgaatgatgattagtccataatcttgtagatgttaatattaaaacctttgttccatgactattaaagatacattgctagttatattggaggaaatatttatgtatttattctttggacttactatgaacaacttctctagtagtttggttgataaaatttatcagtgtaattagttatataatttaggcactttagtaatataaatgagtaaattaggatagctcaactggaaatagtaaaaattaagttaatatttagctgttattacctaagggatgtttagctcatgtaaacattttaaaaatcaactcgctattcttttggtgtttcctcacttttgtatctcaagatgattttgttctgtattcatttttttattctaaaggaaaagatagtaaaataaggttatctggtctacataattagtaacagtagtgattttagaacatgggcttatttctcagcccttctgcttgcttactttccttgagtaggttaagttttctgcttttaagataaaatggatatatttcttaaggttgttgggaaaattgcatggaagagtaagcacactgttatctacctagtttagctgtaatttttttgggagcctaactgtgtgcaaggcagttacaggtttttactaggacgagttatttttaaagtacagtgtaatctccctgtggatgagaaattttgtttctttttttcctcagtacacaacatatgtaataggtgctcagtaaatatttgttgaaggaataatttggtgaatagtggaaagaatggctttgtagatagccttgattgggatctaagctctgctgcttattagctgagtaatttcagttgagttattttacctctcggagcctcagatttctgacctttataatactgatcttgcttttttggtaaggattagtgatatgtatcttacagtatttcagacaacacagaagttagctttttcccaatttgaggtaaataaaaagttatttttaaatggcagtcctctccaattttaagacattgtatttcctccgaactttcttttcttctttttgatatggagtctcactgtgtcacccaggctggagtgcagcggcacgatctcggctcactgcaacctccacctctcgggttcaagcaattctccttccttagcctcctgtgtagctgggattacaggcatgcaccaccatgtccagctaattttttgtgtatttttagtagagacggggtttcaccatgttggtcaggctggtctcgaactcctgacctcgtgatccacctgccttggcctcccaaagttctgggattacaggagtgagccaccttgcccggcctgaactttctaatagtctagagtcctcaggcagtttttttgaattgaattacaagtaccatgactagaaatatttcctgagtgtctactatgtctgcgaaacgaagaaattttagtaaagggtaagaccagtgatgaatattaaggggacttctgtataaatagtttaattaatgtcctctagacttgatagcagtgcctgcagaaagaaaatgaagaaagagggtggtgactagtggctggccacgtggttttaaaatctctgtgagcattgccagccccagccctatccatgtgaagaaaagaaaataaactcaaacctcaaagaatgctgaatgtctgaagcttctaagaaagcctttctgattagggatagcaagggtttgcttagctgacttactgaaggaaaactcccaggggtaatgatgtgttctctgatgttaagaaggggaaatctagtctgtaaagattacacataaaatatttctgaaaagtgaataacctgattgaggttcagctaaagtgaaataaaactataatttattttttcattttctgagcctttgcacagaaaatgaaaaggcagaattgggttagtgtcatccttttttgtgtttgtttgttttggtaaaatacagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatatttgattatttattcgttctattcttagctgattgtggtttgttaggtatttcaactttcattaacatttgtttaatggaaggttgtttaaaacttgggtcacagcagtaaaatcttttgatttagtttccaaattgcacttaaagcttgaggttttggaaataattttatttgatgtaaaagcgattgggcacaggttgtagaatgataaaaataaatttgacttttttttttacttattcattacacaggcagattgacttaagctttatttttgtaaaagaagccatgattttatacattctagaacctgtttccatttgtcagaaacaaccacttacatggtctcataattgaatgatatgtatttttaaaattgtgtttcacattctcaaaccttcagaatacactgaatttttagtatataaaaattttcataagatattctttcctggccaaagaccacaatagaggtcttgattgtgtggtttcctcctcctttttcccttcacgaacagaggttttcctatcttggcagctgtttcctacaaagcagtcatcagtccctgatttcttccttcctcctccttcccacaaacaagggctctttgaatagtggatgactgaagacagactgatcttggatcactttaagaaagtggaaacgtgtgcaagagttgagcatgtgggcaagctgcctgtaggcactagctcattcaaatcaaacaatgaaaacttggacagtaaaaattctttgcttggaatctagagtggtccaaaggctgacttaattttacttgcagcacttcatccacgcgtttacattattctgattgcttgatcagatcatcgaacagactgtaagaatataagaaattgttcattgatggccttttaaatgtgacaagccatgagattatctgactttttaaaatgctttatgtagaataactttcaggtttaaggcaggcacattgctacagcagttgtaaactgcaggttcacttttggttttggttacctttgaatagtctatgggagctcagagtgaaaaatgtacagagccagccagctagttttgcagggatgcgtgccatgtgtctccatcagattaattttggatacatcattctttttgaggaagtttgcattttcctttgtttctttggacagataagcatctgaggtgttcttaaatggcataatactgatgttggtgatgcctccctctcccctgtgtcttcagtgctttcagagagagagctaaaacttgggccaattctgggtcatagagggatccttagggaagcatttacatctctgaaactgtgggcctgaatgatttcagattaatttcttacattatttttgttgtgttcttaataaagcaagatagtacctttataggtaataagtgtttcaaaccatttaacatctgcctgcttttccaatcaggttacattataatgaactgatagtagaatgtagtgtactgctaatagcatcccgtgtgataagctacatgaagcatgtagtaaatgcacagtaggtcagataatgtgcaagaactcaaaagttatcaggaaaattttgttttctaaattttctttatggtttagtgacagcatcgaaatgatgtaatgagtttgttttactgagttatgtatgcaacctcagaaagggagggaagagttccctccctgctgcactttgtaaaactctttagttgcagcaggttaaggataactggagaaaacttggtgtaagagtattatgtagaataaaataataggaaacgaacatgaagaaactgtaagatgttcctttaacagaaaagtttgtgatttcctttccctcagaggctaaatgaggaggctggatatatttgggaaatgccttcattttatgtgcattataaggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataattctaaaactcctaagttaaaatatgtagtcttttatgaaaacttacattttaataatagttcatctttttatgttgtttatatctttagctgtatatgtgtgtgtatatgtatattctttgtaatgttaaatttgcagaaatataactatttctttgtacttaaaaatagatgtggaatttttcttaagcactattgcattaaacatttttaaaatctaggaatagtaatgagtgtatttttcaagacagacctgatttttaaagaaataaatatacttttgaagcctaatgaaataattggaaccatcatttattaactatatagatttctggaatccattgttttcttagtcttaaatattatttccacatgaaaacaacacacatgcaggtgttttttagagcaggctagaagttaatatggagctaagatgtataaattttatagctagttgatagtggcagttattggcacgaaaatgtattaatcttgtaaagtttgtgaagggtataaaatctctgagaaatgcatataaattataatggattttaaaaaattccaattcttgaaaaaatgtttaagaattaaaaaattgattttatatgtacttttaagtgatctcacttataccgattattaaaatgataggtggagaaggggcatactgtcaactaatagaagtgtattattccgttgtctgtgtaataagcttcaaaatgttaacgttttaattttgctgaaagaattttacttgaattgcttgttccaaagttatattttatcatgttctccttgtccctccagtcccctacgttcagtatattgatatgatgtaatataatttaaataaataacaaatttagaaatacttaaaataagagtttctgtattcagaaagtaaatagtgttcacttggatttaagtcacacttggcagttacaatctttgggttaatattttattttcagatgacattgctctttgctttagaattgaagatgcatcatatctaacatcatatgtaatctgtgtgaatgaataatactatcataaacagtgaacaggaattgtgtttaataatataaatttctggcttggattgttgtgaaaatcttgtgtgtagtctgatgattttacatctcgtttttggggaagaaaacctaactgaattcctgctgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatccaggtcactgcaaatgctgttaattcattcctttttatggctgagtagtattccatcatatatatatatgtatttttttcatcatatatatatattttccatcatatatatatatattttccatcatatatatatgttttccatcatatatatatgttttccatcatatatatatatattttccatcatatatatatattttccatcatatatatatatattttccatcatatatatatgatggaatatatatatataatatatatataaatacacacaacacacacatcacagttcctttatccactcgttgattgatgggcatttgggttggttccacgattttgcagttgtgctgctgtaaccatgcatgaaggcatgattcttactcttgagaagctcatggtcttgtgcagggattgaaaccttaaatacttgttggtgccttgagaacattcgacttgaggtcagacaagaaagtgcttgtcagaggacctgtgattaccattccagtatttagcttggtttttccagtcttctgactttcagtagaaatcaaacattaggatttttaagtaatggcaactaattaagattttgtttaaaaaacaagcgtgtataccatagaatagccatgggttatgcctttccttttagatctttttttttcctcctgttacagttgtattttaccttggtacatgattttaaaggcttcacataattttggatttgctttacatcggtacataatgagacatacatttccaaattcataaggacttactctgtgttcaggcaaacattataaatgtcatattttgtgtacacatacaggggcaaatcactaagcatttttaaagtttgaacatggcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcattcctccttttttctttcattctttgatttacacacgcatataacaaaatctgtacatatatacacatatttgtgtatatatgtgcacgcgcatacacgtgcacacacacacaacatgcagtatgctagtttcataagggcagggatgttttgttgttgttcactgatgtcttcaagtgcctgaacaatgcctggcttatactaagcactcaatccatagctgtcacataaatagaataaatctttgaagaggttcatagtctgtataatgagggaaaagacaatgagcagttgtaataagagtgtgataagtgccataataatgatattcacagaggcattgggatgagcgatagttggatggttgcatgtgtgttaggaaattcttgtagttggaagtgatgatacggcagaatcacctggaagatctgcggtggggcccaagcattagttaacattgctgacaaattgcagggtgatgctgatggtgttgctcagcatcacactataagagccactgcgtattctatgtgcttaggggtggttgtggtgagggtaggggtgcatgggtgtagacatggtacaactttttcaaaagtatttttggaaaaaatgatgagatgattgatcatgattcagaagttagtatccagttgtttcttgggagttagtatctgtttctttgcagattgttctttattcccctgattaggcttcttgggaataattttagtcttcagaaaaggattttttttttcttttagcgcttttttttttttttttttttttaagatggagtctcactctgtctcccaggccggaatacaatgggatgatctccgctcactgaaacctccacctcccgggttcaagggattctcctgcctcagcctcccaagtagctgggattacaggcacctgccaccatgcctgtctaacttttttatttttagtagagacggggtttcaccatattggccaggctggtctctgactcttgaccttgtgatccacccaccttggcctcccaaaggactgggattatatgcatgagacaccacacccagccttttttgctcttttcaagagtatactcagaaaaaaattttgaaaaatttacaccaaattggaaaaaaacgtatttttcctcttagggataaatgctctgtttagtagagctcttaaaactcttgtttcaatttgtctctttcactctaataccctggttcttttcttgttgagaataactacatggccaatgctgtgataacactgaattgacttactgtggggatttcagatttcccaatctaacaaaattaactacttttgttcatttcagtatatttgattagttgaagtctaggaggtaaatttttagcaaggtacttggggatttggctgtaaacctaatgggagtcacaactcccattaaattaataggaattgtgtatttgtgcctgctgcatagcaaatgtaactttattttctaaattcacaaattatgtaaattaacacccagctaaagcaatgaattttttaaaaattactattattattttttgagatggtgtcttgctgtgttgctcaggctggagtgcagtggtgtggtctcagctcactgcaacctcggcctcctgggttcaaacaattctcctgcctcagcctcccaagtaactgggactacaggcacccaccaccacgcctggctaatttttgtatttttagtagacacggggtttcaccatattggtcaggctggtctcaaactcctgaccttgtgatctacttgccttggcctcccaaagtgctgggattacaggcatgaaccactgtgcccggccaaaaaaatgattttatttaagaaaatacttaactgtattgctcttaggacactttagatattctttattttgtttcatgagaatattgtaatttgattgcagcagctttcttctccataggtagcgataattcggttttaaaaatataaatcttaatgcctttacaaattgtatgatgttgttatcttctcttgcaaaaatcaaattattataatattactatcagcattcaagatgaaggtaaatatgttacaaatgtgactcaaagttgccgaaaataaaattaagcttaatcggatacactggcatcttttcaaaagtaaatttgaattatactttggtcatcttatataccaatatttagtgtcagaatatgccatgtttcataaatgaagataaagttcaagtgcttgattgtcgatttttttttcttcccacttttcctcatgctttcttcttgattccatcctcttttgcctctttttcatttgtggaaaaactttgtttatccacagtcttcgttgattcaccagtaggtctgttgttggcggaaaaagtattgcaaacgtgtatgtcattcacaacagtcacccagcagacctcaaaaacattatattgcgtggctgtttaatttcggtaaacctccattttctgacagaaaagaccatatcaaatatttagtaaataaatttgtttttaaataataatttgctaaaagtaaaaaggttattagctcatgcatactagagtaaattttagaaataccgattttacatgcatattaggcatttacacagttatttttatagtttgaaagaaccaatagtgtattacagggagtttaattaaaagcacaggaggcatttaaagcaccttaattttgtggaactgtgattctgttaatttctcattactcattaatttcagcattgaagctcttcattttttgaattaatacactttaattttttaatatacgatagcttgtgatattagagaataagataagtgattgaacacatctgaagaccacatcagaagactattgtagaacatgctgtgtctcaaaaaactgatttatctgccatattactaagggagtgtcttactaaaacttgataccccatggtactctattttcttttcccctcctctgcaagacaaagaatgacatatgacagccatgcaagctacacatattagacatcaatttggattagtgagtatctcatggcatctttcaaccctattcctgaactccttttgtcaacttgacagaagtgattccaggagaatacctagtcccagcctcgggatctcctggctaaaatgtaaagctgagaagggaatacgtatcagcacttcaggaagcagaaacaacatttataatctcttcttatcagcatgggactctcctgagtttgacttttatgtctgccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttcttcttctttcctttttgttatatagctattttcttttgtgagaccttccattattttatgcttaaaaatgtatatcttgatctcagttaaatatttattcattacatttccctgtagctcttaaatatttttatttaaattttgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttctccagttggaaggaagggaaatggaacccattgcactggtaggaaggctcattcagggaagtaaagaatgtgtattaggatccagagagaggaaagattcaggaagagatgtgtacagccgcagaagaaagatgatggaggtcatgctgggctttaaacatcttatttatctagaatagtgcccctcaaaagttaatgtgcatataaatcactcagggatcttgttaaaatgtagattcttgcttcagtaatctgggatggaccttctgagtctgcatttctaataagctcccaggtgatgctaaggttgctggtctgtaagataatgtctgtattagggagttttggttattaaaatgtttggtctagaaaatgagagtttacatgacagtgacttccgctgttaaaaatcgaggtttgttttaaacccaaacaaccatagttgaaatatagaaataacatcactttcagttgtataactcattttattaaaaaaggaactaagctaccttgaaactttactgaacatttttatattttgtggcacttctaatcctattttatatgccttctattgaccttttatgtggtgagttgctttgaaaaatccctgagtaacaatgcagcctgaccctttctccctaatatttccctctattccctattgatctgtcatactttcattctatcatacacagaaacagtgtttttaacagcattttaatacaaatgttttattatttaaagtaacactataaagtcatgtaatgcaaagtgtatgtttgtcttatttagaaaaagtttatttttattatactaatttttcaaagtcaacatatttaatcaactaataattgttgtttttgcctaagtattaattccttggcttatcagcaccataagagtataggatggaagtacttgattgttaactggtcattaaaaatggctaaatatgttttatctgccttaggttatctagtgatttttccactttttagtattgtatagaatcaaagattttcttcttcttagtggacacaatctccttttcccttttctttcagaggcaaagatatagggtactgatatgatttgttttaattttacgataataccaattataaagtaaatttatttcttaatgaattttattagactcttcaggctcttaaaccactcaaaagtaagttagtagcaaattttaaaaatagagactcctatataggtacctgagaggtcgaagtatttttattttgatttttttggtggaattaaagaattttggactttgaatcacagcttggatattagtagtgtagaatttttcattttacagatgaagaaactaaggcctgcagattgttcctttgtcaagctctacttaactgccagtccagttttcttgctgtagaactttatatttagcttcagatcattagtatattttcctatctcagcaggctgttactcaagaatatttaaagtatactttatattgcttaacattgcattacttaatggtaattatcaaacgagctaattatgtcagttttcttaatgtttattaccattttagatgaaaaactatgttaagatttgttttttagtgaaaattatgtagagtacaggaggaccaatcatgctaacacttcaactttcaaataatcttccaaagtttacagccataagcatatattttttaaaaagcacaatttatctttgaagttaccagctattgctgagaaccattaactgtcagaacaccgaaaacctgtaacaattataacaagaattgtaactcttactatgtttagttatcagtccacacagattatcagtcatcattaaaacagttaaaaggcatgctcctcctgagcccctccttcaggtatgtgttttggacattatcttttcccttttgtttgcttacaacaggaagctcgtttaatcctttgctttgttttagaggtaagcaaatagcaaccatccctgttagctttcaaaagctcttacttttgttgcattaatggcactcactgtagattgtgtgatcttgctttatttaccagaaagcttgcctttgagagctgtcactccattctttcaacaatgttgttaattgactgatagcactgattgagtggaaaaccttcagtgacaaaagactggatataggtgtgagtccatttgaaaggctggtgaatctttgcttcttaatcccatttctatttgcactgaaatactaaatacagcctagaagaacaaagcatatttaaaagcattcagaaatgttaagcaacaataaaaccccgtaaccatttaaatgacagcagctgactatttgaattaactttgtgtttggcttaatttggggccctaattattcctaacttacgtgagtagatttcaattatagtatcctgcagggatttgtagctaaggcaactaaaagaatcattttacataaagtacttttgttcaactgattagacaagttaaaacgtaatgatgtaaaattgaaacccttctggcaaggtccaaacaaatggttctagtaattttgtccaaaaaagattaatctaagtttgattttaaatactattttggtcttttaggacgattgactttcctgtaatactgataagtatataaaaatgccttaagattgcatgttttggtaaaggagtaagactttaaaggtgaggacaaatttgtcacagtggatggacaccttcctaagtaatgtttatttgctttataatcttcgatacacagtttgacagctttaaatgcatagatttagaagataaatacatacaaataacgtgaatgactagtacctatttaattctgtattttggaatacatttcagttgaacacagatcagaggctcatttatggatttgaaatgctatataccaagaagggacacaacatggttgacattgtgctatagtcagtggacagactgtttgactcgtcctgccgaaatactcctccccactacaaacagccacattaattttaaacacctttaccagaatgaaagctactttaaacttaattactggtgctggagcacaatattaaaaaaagcattagccagcatccatagatcattttgaggcttaaccatagcatttcactggagtcttacagctgtctaatatcagtctattgtagtgagtgaagttaagaggcagcaactctgttctatgtcttgtcttagcactgctttaagttctcttcgttgtcttctttctccccctcctcctcttttaccccttctttcagtttttgaatatctacaacatgtgagtcattgtcttttcacacttgatattttcattatttcctttaagctagtcaattctatgacctgtttttcactaagtgaaacaaaatctaaaaggcatggtgtgaagttcacagacctcacctttttgacttcaaagtgaggttttcctcccatagcacaaatgaagctatataactgcttcttgaaaacaatgtcaataaattcattctttgacctattcagttcctttttgttctttagtatactttttgaaagctagtaacctttaggaggctttttctaatctaaacaggaatcctctgaatttatatagcaacacagtacaatacagtaagccacaagtagttattgaacactggaaatgtgactaatgtgactgagaaaatacatttttattggtcagagcaattttataggtacttctttcctgtaaggctttgttgttgttgctgttgttacctctttacacctcctttatatgtttcagctaattcattgaagttaagcacaatgttttatttatttctgtatttttcatagtgcttaggcattcaaaactattttaaatgattgagaagcacattcaaagagacttagtaccaaagctacattttaaatatatacttaatttatagggcagggatttcactaatgatcacccaaaaaccaatatggttagtttatgaatatcgaaaacaaaggagtgtccatgcatgcatagtgtatatcttgcaggaattcagcccttaggattaacagctaagtatactttaagcatattttaataattatagcaagccctagttatttactgcagcctcaattcttattaggagattttgatagttgtttaaattatttggatggtaataacctacactgaagtcagctaacgttggcttctcttccctaaatatggaacttccttcttaaaatccattgatgaacccagctaatattgccatttgctttttatggtttgagaatatgttttagagtataagtaattatgaaggtatcagttaaaaatgatgagtaatgaatatctctagtcatttcgaaaattcttgtgatcttgtcttgtgaattctttagtaactagaaaatcctctgtgattttagcttaaatataaggaggacattttatcttcataatgggtaatgatgtattttattataatgatattttatatagatttatacatcacacctgaaaatatattacttttttggttcttaatgacttttggctctttttcttaattactttactgttaatattaaaatgtttatagcttgtaatttataaaaattcgtagcttttttggggaaattgtcataaaatgccacttaaatttgtgtgtgtgtgtgtgtgtgtgtgtgtgtatgtgtatgtattctggctgtcagaatttcttattttccacgtacgtttgcaaatgaatttctgatttaccattctgtctctgggtctaatttagaaaaagaagtagtaaattctatgtttagtagaaattgaggtaaatgcagagtacaactataggattttttttatatattaattttgaagaggaaagcatctgacttagaatggcgaattaaaaaattattatattctgtacaatgatgaactattctagcttcaagtacttggtaactaaaatgtttgctcagtaaacgtaagaatttttcattgacatattcagcatggatttgaggtttcagaagtgctagtttctaatcctaacatctaatggttcattaccacctcgttttaaaacaatagtgatatctctcaaatgaaagcattattttgtcagactttattcctgcatggtttacatttgttttagaaagtcagtccactttaaaaatgaaagtttggtaccagtgaaagtagctgaaaagaatgtattgctgtttgataagtcaaatagaagaggagtgttagaacagatgaaaaaccttccaggtaaccgcctggtaagagaaagatggaaagatatagcttcttttcggaagagatacttatgaatctaatctgagatgtatgtgggaaaaaaatttttaaaaagctgtattctgtaagcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacggcaaaaaagtggaggttggtgtttttaagaaaactggaacattttattaggttttatctttgaatctctttaaaaactttatgatttgcaacctatgtgaataagcagtgaaattttcaaagactgtaaaaaatgaaagcaaataaagtattaataaagaaatattaaagatgatttttttgtttcttcgagctttgtggtcttactggaaagatttactataacatgatataaggttaaggtttttatttttctgtcatttttttctaagaaattgtttcataatatactatgatgtttgagaacaaaattgagaattttatgctttataaatttgtatcacaagatgttactaaatactgctcaaattaaagcagtatttgagcagtatgctcaaattgaagcatttataactgttacctttcttgaaatttaataagttggatcacagaattatcctttaattctgttaatcatgttttctttttttgtcataaatatatttttaaaagagtttatggcctgccttttgcctattctatgggcagtgaattttcttaataaattttccaatgtaggttgcattttctgtttctgttttctaatcatctttgcattatggcaagataaatgccaagtgctcaaaatgaagattttatgaaaatgttttatagttttccttggactctgaaagttgtcatggcatttctacagccattcacattacagggatactgccgaaccactggatttatcctgtcagctttgatttaggattaggcagtgtagtcatttgtattgacttggtctctgttttctttcactgacataccctgtagtgaaattacatttgtacgagtatttcatgggaaagacagaaagtataatatactcaaaggcagcaacttttggtgtaacgtccagtggttcaaattctgactctcatcagctatgtgaacctgtacaagttatttaacttgggttttcttgcttattataaaattgggaaaatgcctctattttagaactgttgatgcttagaaatgaaatgtttaaacatttattaatcagtgattgttgaacatttgccatgtgctcagactatgcagtgtgctaggtatgggtattatcttaaaggaacttaacaataatggtggtaccttatgacacctaaaggggaatccagagagagctgcataggtggcatactcagctgaaactcaaacagcagagatatctgaatgagcaagaggtgaccagctgagaaaagttcttctgagctccaggagagtgtgcaaaaatattgccactaagaaatggggtgaattgcaaataggtcaatgtgtgccgaaggtgaggggtgacaaaagatagctctggatgaagttggagccagatgactcatgtggaagagttagaatttgatcatgtaggtgagagataatcattgaaaaatttcaaaggtgattatatatttttattctggaagtatttctttaggctggatggggttgactattgaaagcgttgagaatattgaacaagttcctgtgggaccagggaattaacataaacaagtgaagtagacaggatataaagaaatgatacaaaactggaaagtgcatgcttgtctaaagtaggcagaagccaggcacagtggctcgtgcctgtaatcccagcactttgggagactgaggtgggaggatcacttgaggccaggagttaaagatcagcctgggtaacatagataagaccttgtgtctacagaaaatttaaaaaattagccaggcatagtgacatgcacccatggtcccagctacttaggaggctaaggtgggaggatcacttgagcctagtagttcaaggttgcagtgagccatgatagtgccattgcacttcagcctgggccacagagcgaggccctgtctcaaaaaaaccaaaaaaacaaaactaaacaaaatcaagtcggcaggtgctattcagcttcaggtgattattttatcagtattttgatactttttcttcctcttctttttctttttcttttttttactttttaatattttttccttgcaagcaggaagttatgatacattttcaatgcgaatatgttgtcaattgagctgatatttttccccaagaaaagtcggacattggatttgaatgttacatccccatattttgaaatgttggcagctaattcaaacagacactgagggggcaaatgaaatatacctgtgagctgaattcatcctgtggtctgcccatttgtgccctttttcttaaaaaataagattgttggagtaatccaagcaagaaagaatgagagactagaaaaaatattgaatgagagtagataaaaggaatgaattgatgaaatttccgaagtcatattcacagtagaagtgaggcaatttggcagatcgctgatgagggaaagggtgatttatatagtttgttcgtggtaagggacagaagctgatgtttgggaataaagtaaactggactttcttgcaggcatccaggggaggtcatattgcccagctggtccttgtggagtttggaaggtggtgtggaaactggtcatatatagcacagatgcataatctgaagcagcaggtgcttctgggactctggttacttgcttagttgtttggctcatggattccctttgtatctacctgcttctgcctaatagcaactagctgttctttccctcaactctttttattttttcccccttgcagttttgttttaggatatctggggtacttcacccagtcttgtgccaccctgtcagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagcttctgaatagaaaggattttgttcttgatctatagagatgcaattgaaagattatattgtgatttgaatataacacttcttattttaaatttctcggttcttgatacaagacaatattaaataaattattggatacatgaagacatttttaaaaatccattttttggcatttttggagagaatatcattgccttaatgatattattaatataatcatcttggaatttttatcttatttatacagcaattaatcttctttatccttactactatcaaccaaatctttcctttttgttaaattgatatttttagaatggcccttgaaaatgtatgggaatgtattttatctcaaacgtgaaattaagatttatggttagttgcgattagggaaataggaaaagttaaaaatgactacatttggaccagtggagataagactaggaatcatagaggataagagttaaatattatataatctctaacactctgaggtataagcagttagttctggccactaaaactcagtattattcttttggggataatagcagtgttggtttagattaaggcttcatacataaaatttgaaattctgtaaaaggtacatcaaaataaggaaagccagatccaataacacataggacacagaattaataactgagcctatagtactactattccttgatttgatttattcatgaagtcatttgttatttcattcagcaaatgctatgtttttgcagtttttactaaatgcaacttttttggtagttggtggtgcaaagaactgaaactaaggacaatgaatatcattttaccgttcctgtaaaattcctcttagggcaagaacaaaggtggtataaaaatgtttagaaccaagacttaagagaatgtatttctttcctatttttgctgtcttcctaaacatgacacatccttacctctttagatgttcagcttccaccgactgcacagggtcagtatttgacttggtgttatttcttaaagtatcagaattggggttgagtacttccgtcagggactgtgaaaatttagcacactctaaaaaatgatagcaagtataaaggtcctgaaaaaaaatcatttgcaaaatgtaaacataaaagacaccaaaatgtagacatatttaccattttttcccggatgtaatataaagtgcgccatttgtaacttagagtgcttatttcctattggctgtggtttattttcagtctactatggagtttttatgttatggcatgttaacatgccattttatagtcgtatggcagctattattatttatttttactacatattggacagtgttgactgagtaaatgtaattttgatatatacctctatgaaattaattgtttagaatttatttaagtaattatgtttgaacattcaaattatttgataactagagagattaagaagatgctactattaaagattgaaaataatggacagtttaagatggtaaaggaaaattttgtcactgagtttttaccttttaataatttgagcatcagattattttaaaacatttgccaattcagttctaacatgattttgtatacatgtatttatttgtatgaaaagaaatagtgttgtttaaatcgtgtcaattcagtgctattttctctcttattgtgtagtattctttgagtgttgaatatttgaatattgtagtttgttttgttcttctatattagaaattctcatgtaagtaaaatgaccatagaataaaaccttttttttttttttttttgagacagggtcttgctctgtggcccaggctggtgtgcagtggcatgatttctgcctactgcaacctccaccttctgggctcaagcagtcctcccacctcagcctcctgaatagctgggactacatgtgtgcaccaccacgctcggctaatttttgtatttttttgtagacacagggtcttgccatgtttcccaggctaggctcaaaatcctgagctcaagcaatccacccaccttggcctcccaaagtgctgggattacaggcatgtgtcaccgtgcttggccctgaaataaaatttttaatgttatttaattaataatcatttcatgtcatttagactttaattttttgtgaggctttttaaaataaaagtatttttaaggactttattaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttctaacttcaaaattttccttgcctttagttttctttttattctttattgttttcattttatcttatgaaactactttcagcatgtgataggtgattgttcttaagtatgcagttgtccaattgcataactttggcctattttgataatttttgttacatgtccttattaatttaggatatgtacatatttcactgactttttttttttttttttttgaggtggagttttgctcttgtcgcccaggctggagtgcaatggcacaatctcggctcactgcaacctccacctaccgggtgggttcaagcgattctcctgcctcagcctcccaagtagctgggaatacaggtgccagccaccacgcttggctaatttctgtatttttagtaaagacggggtttcaccacattggccaggctggtttcgaactcctgacctcagatgatccacccaccttggcttcccaaagtgctgggattacaggcatgagccactgcacccagcctcactgatattttaattggatgataaagtagcaaagtatttttatcatagctagttttgcaaaggttttaatgatttcataatattaagttaatttaagaaattcatctagcactttataagagatgtcagaatatcatggcaggttccatatgttccatatgtttgactaaaggtgttaccgtgcagtgttatactaagagaaatttatattttattgattatgtcggtatcaattataaactatcttttaacatttaatgctgttctttatcaataaacacatgggccatgcacagtggctcatgcctgttttcccagcccttcaggaggctgaggcaggtggatcacttgaggtcaagagtttgagaccagcctggccaacatggtgaaaccctgtttttactaaaaatacaaaaactagccagttgtggtggcgcttgcctgttatcccagactcgggaggctgaggcaggagaattgaacctgggaggtggtggctgcagtgaactgagattgcaccaccacactccagccagggcaacagagcaagactccatctcaaaagaagaaaaaaaaaaagaaacacatgaatttgcttggtttagtccttaaacatttttcattatgtgttattttgttgtagaaaaatttataattgttttttgttaattacatccgtcttttttgtcatcgtagaatgcggccgaagatactttataataaaagaaatattacgtttacgctggaattttgttttgcttgctgaagttaaaacaagcaaaatttgtaacttaaggtaatagaaaattaatatggtaaaatgtcagattataatgtggacacttaatatgttagttattaaggaatttaaaaaagagactaagatggatgagacagaaaaaacttcctaaatttcaaaaatagataattttaaagaatagattagacatattgtttttacgttatgggtaaatttcccagaaaaagaaattaaaaaaagcacaactgattcataatgagccaaccccttttagggcatagctcttgctacccttttaatttgtggcctataaattttagcccctatcaactctgacagttactaggtaagtactcttttcatttagccaatagctctgtattgatatctaatattaagataacaaatagatcttgattcaaagctagtcttacatagccttgttatatcttaataagagcaggtaccatgactttgtcactatatatgaatgaatgaatgaatgacagaaaaaatgaatttcccagcagatgactatgttaatagaacatgagtaagccatttttttgttgctggatttgtattttataaactttagggaaagaagaataatatttagtttttttgtagtacttttactcttttaccaagcaagtttacttaccactttcgcctctaccagtgtctcccatgcactgaaacacatctgatacagaggagataataactgttggaggagtgaataagtgaatgattcctaccccattcacactattgtaaacaagaaaagctttttcaaaaccaaaatgtgttttgaaaaaacaaattccccataaaaccaaatacataagcataatactggtttctaagtactaagtcaagaaaaacgaacaaacactgaaggctgagaatctgatttttggcatcatgtttatactttttcaagggaatattctgtatagactttttaaagacaagggtttttaaaaattttatgggggagtctaacagtacagtgaagttagatgatttgtttgtgattaatagccggtgctagctggtgtcagacatgaattagaaacctggttgtttggttcccatgctgctgatctttgcaggattggttgccttctcactttgggccctgtcatatatgaattgagggtgggcaacagacagctcaggttcttcttcattactgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaatacgtatatatttagtgaggacctatttctgatttagaaaaaaattgattgtaatttctacaacattgaaacagtgtctagaagaatcctttccccacccccaaatagctgttactgacatgtccagaatattgcacctaagaatgaattgacctatgacatattaaggataaattttttaaaaaattaagtgaatattgcattgtttctatttaatttgatagcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaaaaccttacggcttccagtataccactttgtaggtagcagattgtctgtgtattttgatgtctctgccctttttctctatttactatttaaacaaacaggctttactcttacagagacaaagttagcaaaagtaccccattgtttttcaggtttcttctacattcccaaagctgtaaccttattttgtttttctaaaatttaatgtagttctaactgttgacaaagctagttgtgacactggccaacattttctttattgagagttgatgaatgacagccatgtctgaaatctccagtcagactcctcctgatataaagataaatgtgaaatattagaactggaagtattttagcagctttcactacatcgaagctattttttgtcacttttatttggggatatggaatgttcacataaattctattttaaagatgtttaagttttttaaaaatatcctcttcacttaccaccatagatgaggagcctacctattctagaaagaaaaattgtctctaattcttaatttattatgttttctcatgtgagattagtagtttcattactagttttgagccgatggtacatttctcctgagagatacccagggagtgaagtggactttgttagtaacctttgctacttgccctgcagacaaggagaacttagggagacaattcatcaccctaaagggaagcagaggagagggctgacatcacaattgtctatgaaatcttgatcattttaagcagcattgaaaattttgttggaaatggttttattaaaaatgttctgcataattgtgacatttaaagagaaaacagtttgtatcttctaagttaagaaaggtaaaagtgacagcagttttgaagaagaaggaattgagcattttctgtgtgatgaaaactttttgtgccaacagtcataaaatagggatcttattttctccattaaatagattagaaaaagggagctaaaaatgttttggtaacttactgccaagatcacataactgttaagttagagctgagattaaaatcgaaccttcctttctcaagtccatggtttacactgttaagccttgatgctcgtagcagaataggaaagaaataacatttcatgctcttttcttctttctaaaacatgttacattttttcttgcctctggcactcattcctaggcttgtcatatcactgactttttcgcatcctttaggccttggttctaattaatgtcaaccccagagaggcttttcatagccattatatggaaagcacctcccaattacatcatcctatttattttctccttaacagtcttagtacctgtaaatactttatttttatgtctctcccactataaactctatgtataaaggacagggacctgtcattttcctttttgttcaaagttttgtttcatagaatagtacttggcatatattagtatagtaggcagctattggttcaatggatgaatacaactttttatatattctggcatccttttaagtaatagagacaagtactatttcctcaaagaatgtttaaaataaataattaaaaatttaccttcagttttaaatttgaattgttactgtggcaggcaaaagttattttaaagaaataagttatatataaatttctctgaaaattattgaaaattcttattgaaatggtgttttactgagatgacatttgtaattttgtatcttgcaaaatgcaagataatctttcattattcatataggattcatttctgcaagcatagcttaatgattcagttattaacttcattgtatatcttaccccaaagaaactaatctctgatatttgggatgtatggggtttttttggggtgtgtgcataaaatagatactctctggatcttgtccataacatgcataggaatcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagtcatcttacttgcttttgggtaataaattacttttatgattagtgtttgattactaaaatcttaatgttttgaaatgtctactttcctaaaactacagccaaaaaagcctgtatataaagtgctttgctatactgttgaacaaggtagcattgttattgaaccccatgggaaaaaaggagtgctgttttgggtgtctataaaaacgaaccaaacttcttccctggagtattctgactgctgttgctatgtgctcatgggcctatgccatgtggctcttttcagatttgtatcagcaagtcagaagttaggaggcagctctactgatccatgagagaaaaaacaatattgaagctgatgaatgagttttatatttctgtacttgaaaatatttagttaaattactgtgcaaaataatgtctgattatctgtaggttaattcttatctacaaacatcagatttttaaaaagaagattgtgaactacttttgtttacatggaattgctaatactaattacctaaatgaaataaatttataaaggaaaaccaaatacttcattgcaaagtcaagaataagtaatattcaaaaaaattttaattcataagatattctgtagttgagtgaataatcaggagttaacttatccatttgtgaagaacttagattttatttcgttttctgttctattttagattattatctctttatatcgtatggtaactctaccttacagtgttagttgttcttaaaaatttggagcttatagactctttggagaatctgacaaaagctgggcaaccctcccagataaatatgtaggccaatatgggcacaaataattatgccattgtaatccacttaataaaaaagctccactttgggcaaggctgtgtgtgtgtggtgtgtgtgtgtgtgtgtgtgtgtgtgtgtgtgtgataaaaattattttccttttacattgaagaggttttattgttaaaatccgtgccactgctatgtgctaggcattgcagtaggcagtgctaatactgttgaaacaaaactactcaaagttcttgcctccatggaacttacacttggttaagatgttgcggagacatgcattgactaaattacaaatagggtatgttctacaaaggtggttgctttgtgtggtggctactttcatttttgtcctcctgtttttccatttattccccatagcttagcaaagtgaactttgtgaaatataaattggatcacttttcctatcaaaaactctcagtggcctcagtaggcacacaactctaagcagtttggccctggatcctctctccagcttgccatggagctacccttcggtaagctctcctgggttcagccatactgatcttattttagttcctttaaacgtttcagtgtctttatacatctatagtttctttgcctaggatcgttgtctcctcctcttcttatgataacttcttttttagaacgacatgtaatttttcctatctcagagaagctacctgcccaattaaaacacccttctcccctacaacattcatacctacaaaactctgttaactttgcttcttctttagcacttattacaaacatgaacctgtttatctattttacatcttttttggggggaaaggtccctgttatttgcactagaatgttggctctatctgggcaggaatactgtttttgttttactcagccactcacaggtaggatactgtccgtatttagtaaccaaagatgcattggaatgtgtaatgtggatattcatactgcatataaagtatatgcaggggatttgaaaggatgttgtgagagcagtagaataaatgatcaatatgtggattatcttgctacagtagagatggtgtaaagaaaatagtttagagatgaaacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctccccccacccccaacaggccctgttgtgtgatgttccccatcctgtgtccaagtgttctcactgttcagttcccatctatgagtgagaacatgcggtgtttggttttctgtccttgtgacagtttgctgagaatgatggtttccagcttcgtccatgtccctacaaaggacatgaactcatccttttttatggctgcatagtattccatggtgtatatgtgccacattttcttaatccagtctatcattgatggacatttgggttggctccaagtctttgctgtagtgaatagtgctgcaataaacatatgtatgcatgtgtctttatagcagcatgatttataatcctttgggtgtatacccagtaatgggatagcggggtcaaatggtatttctagttctagatccttgaggaatcgccacactgtcttccacaatggttgaactagtttacagtcccaccagcagtgtaaaagtgatcctatttctccacatcctctccagcacctgttgtttcctgactttataatgatcgccattctaagtggtatgagatgatatctcattgtggttttgatttgcatttctctgatgaccgatgatgatgagcattttttcatgtgtctgttggctgcataaatgtcttcttttgagaagtgtctgttcatatcctttgcccactttttgatggggttgtttgattttttcttgtaaatttaagttctttgtagattctggatattagtcctttgtcagatgggtagattgcaaaaattttctcccattctgtaggttgcctgttcactctgatggtagtttcttttgcagtgcagaagctctttagtttaattagatcccatttgtcaattttggctttttttgctattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaaagggatccagtttcagctttctacatatggctagccagttttcccagcaccatttattaaatagggaatcttttctccatttcttgtttttgtcaggtttgtcaaagatcagatggttgtagatgtgtggtattatttctgagggctctgttctgttccattggtctatatctgttttggtaccagtaccatgctgttttggtaactgtagccttgtagtgtggtttgaagtcaggtagcgtgatgcctccagctttgttcttttggcttaggattgaagacactgtttttattgtctagtcaaatggtaaacataagtgactacattattgctggaagatgaaaaataaaactatactttacagttcacatatttcaacaggtgatacctcatttctcattgattttaggtattgtcactagacaaattagtctctctgataaccagagagagattaatcaagtgttggtgcttactggacttttgtgtttcagtttggctgttgtaatactcacatgtcagactaagtagaaggaggcatatgcccttggaaattattttaattattttagatcattttttctaaaaagtcattgccaagagaggacacttagctatacatatctacatggatatttttctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctatgaatattatcataatctttgaatagagaatgaggtcaattaaggtgtaatcacttgattcttagtcccaccctgcatatggaaatatctaattcttaccaacaaacacatccaaagtgccaaagttgctgaaaataatttgatttattttagttaagcattaataaagtattgaaatttactattgactcatattccttctgatggttgaaagatgaaaaatgtacaaaggtctctaattatatatgtaggtaaaaaagatggagtgtgataaatatttgtcagtaagtatttaactccagatttctatgtaatgtttagggagttttatcctaaaaatgtgtaaagagtttcttagatcttttcccactcataaactttcaaaatcacaaaatcatgatttgttttggttgggtagctactccaacattctttcttcacattcttccgtggcattgaaaacttgccatttcagtcttcatggctccctttggaaacaacttaattatgtgaaattgtcatgtagctttaagcccttctgaagatcataggtcaagctgaaaattaaaggggacccttgctttatagtgtcagttgtaccttttggaaccttggcagaatattgattaaacattttaccaataagtttcagattgatttacatattgtgtaaaatttatcaaaagtaacagtcaacatctgatggaattatgaagttgatgggattatgaaggtaactagaggtacctgcctcttttcctcttaatgaaattagtcataaattaaattgttactgaaacttaaaaccaagataaagctgaaagtgtatccttgagtttttctgaaatgtttctccacttgctttcttcctgatctgagttttctttctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacacttgccttttatttgtagcttgatatgtagtctgtccttttgttattgtttttggagggggcttagggtttatgtgtgacttaggtgctgctgtgaaatggagagcatcacctatatctggcatttgcatttttgtaatattgttttcaaaatgttccagagaggtacattttcttccaccccgtctctctaatgcacagttaacagtatgtccttcacttgaactttctcccttgtaaatcaattatgcatttgctatagtagttcagctttttaaagtgcataaggagaatactgtataaaaagtgcttgtaaaacaagtctttttctaagagtctagaccttgagaattatgtttttgtttttcaataaatggttaaggtattgtaaaaagttggacattttaccagagttaccatatttgagctaatttttagaatattttttaaagagttaagttatagtgctttccacgcaagactttatatgaaataaatacattaagaatgtagagtttttgatgccttgtcaaaagtggaattaaggttggttttattatatgctttgaatgtgtttctgaaatattttttgaagcggatacttgtaagttaaataccttttatcatttatttttatcataattttatatatactctgtcagggaataatatttaagaatcccaacatttgtttttatggtatatctttacattgtaatctgtagtattttaatttcctataaacctcttaataatactagacaatatgtgaccttttacactcattcatatgtgctataaaattactttttcctttgattctattaaatcctttcagaccactagagaaatccctgatttgtacttaacagaggttttcatgtattaacaagtagagttacctggctatcaataagtacttgtttaactagagtgactaagttaaagacttgtagaagttaggactttctgaagctaataatccaacaccctaatttgtgactcgagggatcagatgcacagtagttcaagacttgatgtttttgttcagggtaaggtagtaatttagtgacagaatccagataactcaaatcctcagactagagaaaaattattaagatttcttgacatttattgttattccctacctttagcttttacacagctaaatctacttgtggaagttcagcttcaaaaagttttagccatagtttcaaagctgttgactgtggttgaggtttattaacaaccttggttttctaatgtagtggaattcaaagtagatcaaattccttccctgagccaggattctctgagtgctcttcttaaccactcctgcccaaccgctcattctacaatattgagccttaactcctgttcctgtctcctggccatcctttttaatagttttgtattaaattgtccatgatcaacaacattttgttttaatagatattctcacttcaaggtggcataaaatagtatatatttctcaggattgactttcccaattaagagtatttgccttcatctctgtgcattaaaatttattgctgcaattgacatgactaaggtggcataacagtgctgtgagcataatctagagctagtctgaataagtctgaatcatagctcttctgttcatgaccttgggccacttaccctttctgtgctttgttttacatatctttaaaatgaggattaaaatattactattaggattaaagtaattataatattattcataaagtactgagaatcttgcctgatatatatagtaagatgctacatcagtgttaaatcatagaaggagccagtaaattgtttcagtattttaatgtgtgtacttgaggttctggagatattccaagaacaacacacattcctagtttgacctgaatgaaccaggaatatttaaatacatagcatttatttttagagccacattttactgaaactaaacctaggaacaatacgtggctttttttggggaggggggaggttgttgtttgctttaagaaccttgctttgttaaaaaaaaagcctaacttgcctttttgggaaggcaagttagacgtagaccttaaaagaaatctagctactgccatttataggtggttatatggataccttacctttagaagttattgagtgtgacttatctgcttaatagcgattaaatccgtttaaaatgtttaccaggtgttaatcataagtcaaggttgacatagccagttaaatcttatttgaaagaaagaaaaatctctgtaaatcatgtttacagattttttaaaaactggctggcaatgtttattataaaaatccataattttccatttgtttgctatattagaatactatgcagttgtaatgaataaacatttatagtttctgctcctaaaaattggactacagtttcgtgagtttagtctcatctggtaagctttccaagagattcagggaagccatagctttccaagtatgcaaatctcttacattcaaagcacttccctcaggcacaagaagactatttcagtggcatgctttgctcttttcccttaacatatctaacatgaggaacatagataggggacagcctatctatgtttgaatagatgttgaagaaattatatgagaagaattgatagaaagttttatttttaattgtttgctttgtaatatatttatttggtgactgtaaaaagtagatttcagaagatttatttatactatcaatgcatgttttaaaattattcgtttgagttgtaaataattaatgaaaaaggcattttatgtggcactgaatcaacctgttagtttcagttgttcaccctggatttctttcatttaatcgtcttcttcttactgcaaaggaggacatttattcattactttgcccaaataatactaacacactagcagatggtcactttccaactggtttgtcttcagaaaagaaattaaaatattatagtgccagagagagatgttgtaatgtgtccctttcaaattaacaggtcattcttttcaactattttgtaactgtaaaatagctcaatgtcacataaaaggctaaaagctagagtaaatggtgtcatgggaaacatgaaataaacacagtgtaatggtttatagtcttgtcttgaacacactaagaatatttcttttctaaaaagacacaaattatatgctacggtagtattttggttttactggattctagtttaattagttcatatcaaaagttagcacttgttttaaaacgtgtatacattctgaaagaagatacttcccccaaaacatttaaaaataccttgaatatattcttaaacaaatatgttagcctagcaaacaatgaaatgaaaaccaaatatgaaaataatgtatcttcttcctttaccccttcaatgaatgatctgtaactctgataaaaagattagtttagagattattgaattattttaatactaggaccagactgaaagtaacattgtgcatttagaaatgcaacatataaatgagtagaattggagccccacatgattgggaaataagctggagaaactgaagtatgcttaaaacacagagtaattagcgagcaagctcaggaaaaaaaaaatctcagaatacttagaagtagtgtttgaggaactagaatcatcacagtttaaattatttgttttgacctttctctgccactgaattgctgtgtatctttgggcagtcacttagatcatttccttgactagaacagtagcaagttggcttagacaactcttaagccctttttttaaagtgttatagctatttggttggtgatgaattacttaacccagaatttaaaaaaaaaaaaaacaacttaaaatgcatttgcctaagtgagccaggtagatttataatgagaaagaaagaagtttttataatattatttattcttcttctgaaaaaaatcaagtgataatagaaacccaaatacaaaataactgaattcgatttgcattcctcctaattactagcactgtgaacaaaaacaggtcgtttaaatatgttgtatgggcttggtgcagtggctcacacctgtaatcctagcactttgggaggccgaggcgggctgatcacttgaggccaggagtcctgaggccaggagtttgagaccagcctggccaatgtggtgaaaccctgtctctattaaaattacaaaaattagccgggcttgttggcacgcacctgtaatccctgctactcaggtggctgaggcatgagaatcacttgaatcctggaggtggaggttgcagtgagccaagatcttgtcactgtgctccaatctaggcgatagagtgagacattgtatctaaataaataaataaataagttgtattttggatcctcaataaataagttgtattttggatcctcatccgaacaatggaaattataatttttctggttatctcactgtgtctaaagcgatgtcctactgtgttgcctttttcaaagagtgatcatttgactattcctataagagcccttattggaatgctttctagcatattatttgcctcagatactccatctgtgtggggagttctttctcaaatagttggacactttctgtctttttaagggtaaaatatatgagacagccttttctaatttgtacagagatgaaaaattaagtcagccttaagttctttcttaactgagagtttttcttagaaagtaattttaagatattgatgcaggttattttcctccttagcttaacaaggttcaggttcttgtctcagtaccaggaagaagtaggcatgcggacacttgaagagtgagtggtgtagattttattaagcgaaaggaaagctctcagcaaagagaggggtcctgaaaccaggttgccgggttctccctttacagttgaattcgagggcttctatatctgcttgatggggctgggttttctatttgtataaggcatgaatttcttctccctcccaccgccccccgccccattccgtccagtgcacacgcgggcccttagtctgagccattccacattgatttatttcccttactgtgcatgtgttaagggacagaatttttcaccacgggcatgtttaggcaagccccctgtgcacaatgacattggtgggttggatgttgtcctgggacccttccctatctgcctaggcatttggctgtctcctgcctctatcaatatctttttgtccttccctctcaaatccctactttaaccagcgaagtggaatatttgtcttaaacattgtggtgttattactcatcccaccccatttcttcctatatttgtttgaaatgccagtatactcatattgcataatataggataaacaggtttatatgtggaagtgtgaaattatatattgttatgaatggtaggggaattggtagatctgggactcaaaatgattgctagaactttatatatatatatttttggtaaggcattaattcactgagtacttcaaatattttattttatttttgagacggagtcttgctctgtcacccaggctggagtgcagtggcgcgatcttggctcactgcaagctccacctcccgggctcacgccattctcctgcctcagcctcccgagtagctgagactacaggagcccgccgccacgcccggctaattttttgtagtttttagtagaaacggggtttcaccatgttagccaggatggtctcgatctcctgacctcgtgatccaccagcctcggcatcccaaagtgctgggattacaggcgtgagccaccaagcctggtcgtacttcaaatattagtcccatgttcatgtttgaaattgtttaatcaaaagttgttacaaatagtactgaaaaaggaaagaaacctgcccttgtgattgttcttgctcatggttatcctctctgttctgtctgttcatcctgccagggtaagctgagatctcccttcctccataatgtattttacagctccagttctcattagtctttactctgagttcctacaccgcttacagtatgcaccacataattgagtatttacttatatatccttccgtgtatggattggtgatgtttcatctgtttctttgcttcccctgtagacctcagactatacaaggtgaagacaatattttgtttaatctttccctaaatgttcctaagaatgtgttagagcacctaagtggtgctcagtgaatactagattgatttgtttttttccttttctccatttcctttcactgagtgtgaaaattgctagaaatcacacaccatcccccctttttttcctgagtctatctttttaatgggcctctcttctttcctggtatgccaagatagatgtactacaaaagtctgtatatagaatttgtacaatttgtttcttgattttaagtatatgaagaaaaacgtggacatagagaaatgatgattcataatatgttctaattagaaatgtgaaagttggttaaacattaaaaaatcagcttggtgttacagatgtgttttttttccctttcttaattgtttgaagtttgcagaatttactgttttctaccgtaactaagagatatgctttctggcagacctattgaagaatttggtttatgccaaatatactactaataatttaaatgtcccacatagttaggatcttttggtattcatcagagtaaaaattaattttatcttaaaaactagagtaaaaaacctttttttaaacagtaaaaaatctgctttctgcaaactgtgtccagataaccagagctgtttagctggataatgaaacagtaaatgtgaaagcaatttgaagaacatacacattaacattatggttagaagagtgagggatggaatgccttttgtatccatgacatatttcaaacagaaaaatatgcaatctgttttcatagttcataagatgctccacaatcccctctcaaccagttctggtagataattaagacctaacacatttattgtatgtaatgaataatttctctaatgcatctagaattcaacagaattgggaaatagccctcaaataattttatgtggggctttattttcttgtggaaccctagttgagaaaggctatgcaatctcttttaacctctatttgaacagaatcttattttgtcacgtatatgtttgaagaccttaacccttctagattatttttacttgacccaattacttagtggttaagaatgtattgcctatacaatacagtccaaatctggttggccctatttgttttctaaagttttaaatgtagctatgttttattgacagcatttttgctacttaattatgtcttttcttgacagctcaaactatctctgtttactcttatttagaatgcagctggcaacagcagttggtttgtgaaacccaggcatataattaacttccccagttaaggtatggtttgtttcattggaagagaaagaattttgggggtatgtttctttagtctgagaagtaatgcagtttattttcagtatggtatattttatgtgacagaacataagcagagaattttttaaaaaattataacattctaacattacttgagcactaaagtgctacaaaaaatactttgttattatttgaaccacgaaaatcagatattagcattcagcgtaaatgtcaaattaacacaggccagtaggaacatttgtgatcatgttcttctcacatctacttgcatggataatgaagctttgactattgctttgatgtagatttttggaggaaatcctcctcctatttccaagacactttgtagttactaattctaagagagtataagcgaatccatttatttaaaataaaataaaaatggggggaaagatatttaagcaataaatttcataccatgagattttttatatcctggttactttaaaacccagtaagctgccctgggttctctcctgatactgcacagaacttttgttttacatcctcgtcttcctattattagttcaactatattgtttttctctttccagcactctatctggatttttgtaattattactgtcttcctattactagttcaactatattgtttttctctttctagcactctatctggatttttgtaattattactgtcttcctttatcagttttaaaagttaagatatgtggtatttttgagatcagaattgtagccattatattgatgtgctgcagatattaagagaaaaagtccttagttgccagctttttgtatactcaagtgttatggattcttaagaataaatgtttctttgttttcatatgaaattgtcttttttttttttttaggatacatgtcttactttgtcacccagtctagagtgcagtggtttggttcccttcagccttgatctcctgggctcaagtgatcctcccccctcagcccccagaatagccgggactttaggcatgtgcgacaactcccaactaacttttgtactttttgtagagacggggttttgccacattacccaggctggtcttgaactcctgagctcaagctttgtaatcccaaagtactggaattacaggcacgagccaccgcgcccatcccaaactgccttcctttttgcccagcccatgagaacaacctgtgctagtgaatgatttttaaagaatcttgctacttttttctgcctgggattatgtgttgactgaatatagtttcctaagagatactgttgatttttttaaactaaacgtctaccagactttctgctctgttgttccaaaattggacaatttcctgcctggtattttatttttaagttgaaaatgggaaaattgctaatgatgttgaaagcaaaaatggtattgaatgctttctgactaaacatatattgaacaaagcaaaacactatgtatctgctctttcatataacattcggaaactcttgtgacataatcagggctattttctgtataagatggggaggtaggcttataaatatgctacgtaagtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaattatggcagaggcaaagtagttactttgacaaccagattgaggattcattgcgatttattatttactacttgaaaatctcactctgatttaattaagggttgagatttccatgaagtctgtcttttctaaatttgagcaccctgttactgttgtttatgtgtgcactgaaataatctcaaactgatgttactccaaaactgtgacgaattaggcttaacatgtagttttttgaaaatttagacaggtcagataacagttaactgaaattaactggatcttatattgggcgatggtaatcaatgcttactagtaacttagtaacattgactccctgggtatcttcaaagcagcctggttgtaataagtgaattttatcttttttgttgaaagcagctttaaataatttatacctgatttgtatttcagtgtatcattttagatatacacgttatttctttgcagttacttaatggtacacttttttgggtggggagacaaagtcttgcttttgtcaccaggctggagtgcagtggtgcgatctcagctcactgcaatctctgcctcccaggttcaagcgattcccctgcctcagcctcccaagtacctgggactacaggcatgcaccaccacacccggctaattttttgtgttttagtagagacagggtttcaccatgttggccaggaaagtttcgatctcctgacctcgtgatctgcccgtctcggcttcccaaagtgctgggattacaggcatgagccaccatgcccagctggtacaccttttatattgcccaaattatagtctataaaatgtgattgtaatcagataattcttggccagaaaacgaaagttcaccttcttagagtgagttaaccattaggtaattttgtattttatgtttttttcttcccaagtattcctgaaatgctttttacctttgcagatgtaactcagttgactacttattcagcattaattaataataaaatatgataggcttttcaacctatgatttttatttaaacaaaacctttcaaataaaaataattttaaacctgtatttgatttctatttaaaatggagtgttttcatatactcttttaaattaaaatagtgtctgcttagctcgtttacattctttctgtcagaatgtctgcctcaggattctatatataattaatgtaagaaaaacaagagggtaatcccttggtagaaaactggtaatggattaaaagaccatagctctgaaattccagtaatgtgacacattttctctgaaagatgcacttaggcccgatatctagagatattaaaaagtgccccctattttaattagctaaagatagacattcctaatatattttgttgtatgtttaatatggaatattataagtaaattcatacactgatactaaatacgatttgagaagaattactgctttggtgagaagagagctttgagtgtcacttgaagcttcaaatttcttactgaaccaattgataaaatgtacaaaatgtgtattgagaatgtgcagaacagccacccaggtagtttgatcagtgtctttctacatagtgcctaacatgaactagtttaagaaacttgaggaatccacataactatccttggttccaattttttaattaaaaagtttagactagagcagtgcttttcaaattgtgatttccaacccattatcagtttgtaagcacagtatttagtgggttacaatcatcacttatgaaagagagcaaatatcagagcacagtttatataatgagtattatttcatgaaatttgcattaattatatgttcatatcttaagggtacattgttttgatataacatgtcatacttaaggaatgcagtaaaaatatataaaaggaaacaccgggctgcatgatcctaaaaatctctcccagttccaacattcccgagtgaaattttaaacatgtagctcttccttaagtagcattatatcattatgttatttcaatagaatttgtcacatgcagatgcattttgggagaaaaagaggagaaaggtgcaagacttgatattctgagagactaatacctatataaattgtaattattcctaattgctatgtgtgataatttaggcctgcacaaaattgctgagagcatatcaaacaaatgattagttctcattgtcaggcccagaaaatacctcgtgactaatattagagtacatcctttaaagatgagtatgatttcattcatttgggatagagaattcagggaaagagtctggatactttggctgtggctagacagtcaagcggccttctatgccatacttaggcatttggaatttatcttaaaagaccagggaaagctgtcaaacccattcagcctgctaggattagctctccttttagaacgatgaaagtagtaatgtgattgttgaactcaagtagagaaaaattcaaggtatggagacaataagttacaagaatttcagaaggtcagctataaacgtagaaactcctcttttgataaagagtgaaatacaactctttatcaaaagcttgacagtgctcatacaacatacgaattgagtttcactttagtattttggaaatactggaacagctttcagtacctttgcaaaatgcccaagtaaatgtatgtgaaatgttgaaagacttaaatgagtccggcatataggaaaaccttgttttattgagctttgtagatattgcattgtttttttattttatttatttatttttttgagatggagtcttgctctgtaacccaggctggagcgcagtggtgcaatctcgctcactgcaagctctgcctcctgggttcacgccattctcccgcctcagcctcccgagtagctaggactacaggcgcccgccaccgcgcccggctaattttgtttttgtatttttagtagagacggggtttcaccttggcaccttagtagacccaggatgttctcgatctcctgacctcgtgatctgccccccttggcctcccaaagtgctgggattacaagtgtgaaccactgcgcccggcctgctttttttataaattgaaggtttatggaaaccttgtttcccacaagtcttatcagcaccatttttccagcagtatgtgctcacttcatgtgtctgtgtcacattttgttaattcccacaatatttcaagtttttctattatatctgttatggtgatctgtaatcagtgatctttgatattattataactatttgatgtgtattattgtaattggagtgccatgaatcatgcccattccagacgatgaacttaaggaatattaggttttctgactgctccaccaactggcccttccctgtctctccccctctcatcaggcctccctattccctgagacacaaaaattttgaaattaaccaattaataatcctacaacggcctatatatgttcaagtgaaatgaaaagttgcacatttcttcatattaaatcaaaagatagaaatgattaagcttagtgaggaaggcatatcaaaagcttagacagaacgaaatctcggcctcttgtgccagttagccaagtcgtgaatgcaaggaaaaagttcttgaagtaaattaaaagtgctacttcagtgaacacatagatgataagaaagtgaaacagcttttgttgcttatatggagaaagttttagtggtctggagagaagatcaaaccagtctcaagattctcttaagccaaagcataatccagagcaaggccccaactgtcttcaattctatgaacgctgagaggtgaggaagatgtggaggaaagtttacagttaccagaggttagctcatggggctgaaggaaagaagccattgttcccataacatagaagtgggaggtaaagcagcaagtgttgatatagaagctgcagcaagttatgcagaagatctagctaagatcattgatggaggtggctacactaaacaacagattttaaatatagacaaaacagccttctgttggaagaagatgccctctagactcttcatagctgaagagaagtcagtgtctggcttcagagtttcaaaggacagactgtcttgttaggggctaatgcagctggtgactttaagttgaagctaatattcatttaccatttcaaaaatccttgggccattaggaattatgttaagtctgaggaatacagatgtacccacccttctctttgcctttttatcaagactcagtgtacaaggattgtatgtgtgggtcacctcggtctcctctgctttaatgctcctcatctctggcaataaattacttctctttgaaaaacttaacatttattaatgtgaattttgggatcttatgcacataatttatacgagcactaacttgtcatcctgtctctgaattgaatcttttgatagtttcctgatatagtttatgctgtgtcttctgttagaggaggctttaaaaggagggagctcttgatccctataggagaagcagagcagatagaagggcattccaagtggggagaatactgtgaagaacgctacaaagacaggaattcacataccagattttatatagtgaatatttaagactcaattccatagtgtaaacagattaactttgttatttaaataaattatatggaaaaaattaattttggaattttctactatagcagcttggtgccacaggtaccatttgtttcttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaatttattgctattttgagatcagatttacccatattttcttgttagtattattgttattctaacactgaaattattaacgcatttatgtttggaggtcttttgtaactagaacttagtcctttgcagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagctctttaagggatagaacaaggattccaagccaagtcagttaactccttgtccggaattacttttcactgtaaaatagttacccattttagaattaaacacttcagatttaagtagtttgatctcaataatatctgtacagattaaattaatatcttagggggaagtaatacttaagaggagcatttaaaaaatgtagttattgacctaattatttccccacccaccacactccctgtaggattttcataagcagagaattatattctaagattgtgttcttatttcattagcactgtgataagccataagaattgtgttttactatctttaatctgttctactccatatcaaaacattcattgacaagaggagattgtagtctattcactgattttgtccaaaccagttggaatagtggtcagcaactgtcttccataaatggctagatggtaaattttttagactttgtaggccaaatttaagggtgttgtatagatatttatataatgagagaaatgaatatccaacacatttattgacaattttcagatcttattacttgacactgacaatttcatacatttttatgtgtcatgaaatattgttcttttgattttgtttgaacattaaaaaatgtaaatggaccatgggaacactagtagtccaacccttatttagaagggactgttgtgggtatctggtagatcagatttgaattccatttgtaaaacatttgagtatttactttataataatattaaatataaattaacatcacagttttctgaggaaactgaagttcatttgtaaagaaacttcttcaagttttgccaagtcagtaaatggcagaactagaattcaaaaccttatctatttttcagtgcctgggttctttcatgtgttcattgttacatcttctgtgccaggcatggagataggcacagtgcatactggcatgaattagatgagttcctgcttctacatagtccttagtcatgatgctgcacagatttgggaaatgtaattttctaaaacctgcctgtcattataaatcagattcatctacacttactctcattttctgataaaaagtatttgcttgtttttgtgacttatcaatcctgtcttgtatttttctttttttcttgaatagtacaggaacttttttatctggtaacattcagcttcttaaggatgaaattaaaactatttgaggttgtaaggggaataaacatttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgattagttgttcccacaagctctgtatatcttttggaaatctatctttatatctgtgagataaaaataatcttcagttattaaaaaagagtcatctgtgttagtagtgacaatgtatattttagaaatttcatgtatgtagcatcattgagaatcaaatatgaaacattgtttaaaggaaaaagagtagaaattaaaaaaaaactttgattgtataagttattttttgagatgagaaattatttcaatatgttttttttttctctagaaacctgttggaaaatgccttgttactccagcagaaaagcatgtctattattaccaatagaattagtgtgttcagaaaaagaaaaggcttaatttacagccttttgaagttttagggaaaattccttttttaaagcatgcaggaggaaagacatgacatcacagccttaagtgggtaaaaggttacatggctgatactttttaagtgattgaattattagcatgggtaataatttgtggaaggtgaagaggtgccactagtttcagtgtgttaatcttccccacttaaagtgagaaataaatacctcataagaatatatatggggatatagtgtctttcctttctaagacacttgcttgagtcagcagtggttgcgtgtggtcacctttggattagtcttcggattcagagaaatgagtgggtggtttcagtgcagtttcaatgttgttaacccaaataagttctagagttggtattaattggcccccttatagaaacctttgaggaggaagctgttgttacacaggtaactttatacctttagagtttattgttgcctagtaaaaattaatatggaaatataataaaaattggtagggaactctttcattcatctacattgtggtcactcatgtgattcaatttaaatgtatcttttttttttttttttttttttgagatggagtttcactcttgttgcccaggctggagtgcagtggtgcagtctcggctcactacaacctccgccacctgggttcaagcgtttctcctgcctcagcctcctgagtaactgggattataggtgcccacagctagctaatttttttgtatttttagtagagacggggtttcaccatgttggccaggctggtctcaaactcctgacctcaggtgatccacctgcctcggcctcccaaagtgctgggattacaggcgtgagccaccgccccagacctgaaagtacctttttaaaaaggaaattttggttaagagttttttttgtgttagtgctttaaaaaaattgcttatatttaaatacaacaacgtattaactaaaaagacttaaaatccaaatttttactctgtttgatctgggaaacctgcctgggaaatacttaaaatgaagtctccaccctaatgagttttagcatcagtgacaaaaaaggagtggaaacctttacctagcaatgttggagtgactcactggatatgggaacaaatagctcatttctgcatttttgcttcttatttaattatttttaagaataaatacatactcaggctggatggaggtgggagtgaattaatgaaatttctaataacaaaaggatagtaaaaattataagagattacattaaataacatagagttggaaataaattatacctgcggagatgatgaaattgtcgtttacttattctgtaattgtttgctagtttctttgttgacagtgaatacattatacagagttacttaagaattttaatttgctaggacaatgcgaatgacttcagatattaaatttttgttagaaacttattgatgttaaactggttttaactagttataaaaaaaaataataattgtaaagagtatttcctgtttccctgtgagggtgggagggggacggagactctggaatgattttgaactctagcaggtcgtcagtcatttaagagcatattttcatagttgagtcccactgattaggggactctgatgaaaatgtcatctttgtcctgtttgtattctttatctcttgatatctggatttttgaaaaaacattttctgatgatgttcatgtcttaaatttataaactcaaaactttaatatatatataaaagttaaaactgtggtctttttgtttcttttcctcttaaaacaacttttatgttcttgagtatgtttaacatcttctggtacataagaattatagtaataaataaagcataaagtaaaataaagtaaaaataaaatgcctactgtgtccctgaataactaatattcagtttttgttgaaaagctcagagtccagtaaggaggtaatataagtacaaagacccttagaatgtgttacctgctctgatagaggagctcataattgttcattcattcatatatccatttatttaacatctttattttgtcactccataaagaacaccgtaaattggtcctttcctacgttttggcattatagtagtgaaccagataaatgacacttgtcctgaaggaggtctcatcccccatgtttgttactcaggaacagggattattgtatttttgttcctagtatcccaagtgtctagaagagtgctaggcacatagtagttactcagtagatgttaattggaggaaacaaaacaaatgacccaaacctaagctcaggttctcctttccctgttttcaagacctggtgtcttgaactgggttttgaagagtaattgttgcctaacagaaaaatgagtggaacatcctgtgcggaggagatagtttaaacagaggcactgaataattgggtaatattgaagctcagtgtgaaagtcactttttttttttaagtaaatcggaattaaagtattctgcctttgtgaacttagaagttgtaactatatactgagactaatagcatctctttgtggcatatattatttttaatagatgtgcttatcaggaatttttttaagttaagtattaaacataatattttataactgaaatatgttttcatggtacttgtgaattattaattagtggtagataatttagaagtttttaggtaggagaaattaatttctttctagtaaggaatttaaccccacagtgtttttgactcataatgtgtactttctttttaaaatgtcaaaaggcttttcagaagtagtagtatttgaaactatcagctaatggttttctaaaagtatatttttaccttagagcatctagagtgtccagaattttgtgactcttagcaagtccccaagttgaaaatttttaccttgtagcttgcataattggatttaaatatgtattttcattatgcatgtatttgttagaaaatattggtgtatttcttagtgtaacactattttgtatttaagttgattttacttaagatttcaaataaactgttaacattcttcttagaaaaaatttttttgaagtacttcattatttaaaatatttccaaaataatcaacagcttatttagctgggcatggtggcatgagcctgcagtcctaactactctggggtgaggaagaggctgatttcgagcccatatgcttgagcctagaagcttggggctgcagtgaactatgattgtaccactgcactccagctggacaacagagtgagactctctccctaaagcagacaaacaaaaaaacagcttctaaaccaaaatgacacataaaactaaggcatatcacttatttggactgagttgatgattgtgtagttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcacaacaaaatgtactgtttgttgtcagagcagcatattttcttgcagaaatgcttataagtgatgccaaatttaatgatagaatttcaattctggtcttacaaattcccatccggtagcagtgcatctgtttattaggaattacccctgaatgtgaatgatttcagtcttaagttgctgcacctgttgccgggaggtatttattccgatcagtagcctaaagcagagagagttatatcttgacattttatagcttggggggaaaaactgtcttttcaaaatcatttgttcagagaggagaaaatggagcaaaacagttcattttactctaagcaccgctatttggtggtattcacatttgcacagcacaaagctgcaatattgattttttgctcacagagcctcccaccagttctctcttcaattgtcagggttgcaagatggattagattacattttgctggttgggatgcttatttttttgttgttgttgaaatagaaatagactgaaaatacggcttggaatgaatatcacagtaatagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaataaataaatgttttcaggaatgggtttttatgtcttttataagatttatttagtgaaaatgttgggttttaaaagttgatactaattgcaataattttattaaaggcttttcaaagttcctttaaagtagcattgttggtggaagaggttgagctatatcccttgaagttttcaggaaaatagtgtaaaatggtcaaagaaggcacaacaatttatatttttcttaaaaatgtgtgtaaactttttattttccatcagttgttttgccaagattaaggacatgcccgtgccacagcctcaggagctcctgacaacatgtgcccaaggcggttgggctacagcttggttttatacattttagggagacataagtcagaaatcagtacatgagtgatgttcattggttcagtttggaaaggtaagacaacccaaagggtagagttaggattccaggtaataggtagattcaaagatttcccgattggcaactggttgaaggggtttgtctattaataaagacccgaatcaatagaagaaagtgtctgggttaagataggggttgtgaggaccagggttcttattatgcagatgaagcctctaggtagcaggtattaagagagaatagattggaaatatttcttaccatatttaaagaggcagttctggccaaacgtggtggctcacacctgtaatcccagcattttaggaggccaaagtgggcagatcacctgaggtcaggagtttgagaccagcctggccaacatggcgaaacctcatctctactaaaaatacaaaaattagccggtcatggtggtgcgcacctgtggtcccatctactggggaggctgaagtggaagaatcacttgaacctggtgggtggaggttgcagtgagccaaaattgcaccactgcactcctgcactccagcctgggtgacagagcaagactccatctcagaaaacaaagggtggggggcagttctgtcagtcttaaggtctctgttttaatgttaaggatagtcagactgtgtcagaattccaatgaaaggaaagtacaatgaggcatgtctgaccacccattcccatcatggccacaactagagaacttttccataattgattcatgtttattttctcttttccactaagtcattgattaaaatagttaacctaggaagatgttttcctgtgatttgtgtgaactctgcttagtttgtcacatggacttttgaaaattattttgacagtacctcacaatctatatggatgtgcacagcacatccatgttaacaatgttgttatatttatattttaagaaaacagagcaagttgtttattaattatcgatcacttgaaatgttggaatagcatgtgtacttgattaaaaggagcttgcctgtttagacttacagattgaggaaattttataagactttgaaatggctttaattcttcagaaaaggttttaattaaaacccagagaagtaaaatgactttgcccaaagtcacaagactgacccatatactcatacttcagtgttcagtgctctttccatgtgtacctacagtatagcatttgctgtctttatatttatggtacacatgtttacatttctacaaatatgattttcactactattcatgtagttttgtgaacctttacaataattatttcttgtcagttttactaatatattctttggtgattttcagattgtatgaagacttataaaataaatcttgttattttatcagcaaaatggcttgagtagtcagagttgatcagagaagggttctggagtctaagctccctgcatgggttagaatctaacgtgtggtaagattgagaccctaaatttactactatttgatgccttagtttcatactctgtaaaattggtactataacagcaactattccattgtttattttttatgttgttgaacataaaacaaagtgatccatataaagcatttaagccagtgccagcacatagtaattgctttgcaagtaatacttatttctctcttcatatttgttttttaaagaatatatatatattcattatatatatatatacattatatatacacattatatatatacacattatatatacacattatatatatacacattatatatatatacacattttatatacacacacacacacacacacacacacacacacacatatttggttggaaatacagactttagataagagaaatgtataaatatgtaacccatctgtcttatgacaattccagtgatacatatataataataaattgacaatttaaatatttttttggtgggggagatggcatataattttcattgataagtagtttgccttgtttttaatgttcaccatttgttttcactaccaaaggaaatagacattacaaaggaaagcacattgcaatttatgttgtgttaatcactagtttaattcaacaatttggttccacatttataagaattatgtatcatgtgctattgtaggcattgagattataactaagagccttactacagtctagcagggtagatatatatatatactaaaagtgaatatgcactgtatcacatgttaataagcacattagtaaagattaatatatctgcatatataaagtttaatcaaaacaggtaagagaaagaatttagaaaagaacattaatgatttaaatcaaaatacattgtaggattaaataaagtggtatttgctattaagaactcttagtgcaatttctgttgctataggaaaatactcagactgggtaatttataaagaaaagagttttatttagcttatggttctggggttctggggtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactctaatcctgcaaactaacaacaacaacagttaaagggcttgggttttaaaaaccacagtgcttcataatcagttctatgttttgacaaaatagtaagaattgcgagtgtggctccaagccagtcttttaataatgtgttccaatattcctagcattttctaataatagatttattctgttttattatagaattgtaattgcaaattgcctctgtatttaaaataggttgcatttcaaaattttatttgatgtcgtttgtttgaattttcacatagcttttgccacagaaatgtgtcagcttctgaagccataaaaatattttctattaaaataaatatggtactactagtttaagctgaattatttgtatagatatttcagtacaaggtcaggagatggagaaaaaagcagagtgtgtgtgtgtgtgtgtgtgtgtgtgtgtgtgtgtgtgtacatataaaagtttatgaacttgttggggaagaaatatattttggaagtttggcctgtgtaccatttgtcctgacatttacccagctctgtttctgtatcccttctgcattagtagtgcacctctccacatgctacagtactctccatatactataaaccttgttagtgaaaacctaccaagtttggggtttgccacaatctcctgaagatttctgagttccaggttaggtattcttttcttccctcttcagtccagttacacctttagttttctctgaagaactgagagttcagccaggtttgaaaattgctgctttttaaaatcataccagtatgtcacccagtactgctttggaagaatatacttacatctcagaaaagatcatgttcaggtctttgaatttgttgagttggatgggagcagtgctagctcctttgaatgtccatctgctgattcctttcagtgtcagttttaaataaagggtatttaaatggaaataagttattgtgccataagcatcttattgtcataaatatcttagttattgtggggaaaaaactgctaagatgaaggtattttttaagataatgcaatagcaattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacagagtgtttctcaactgaagatactttgccccacagcagtacatttgttaacagtccatgaacccacattgacacataattatcacccaaagtccatagtttacaataggattggcttttggcgttgtacattttatgagttttgacaaatgtattcaccattgtagtatcatacagaataccttcatgtgccacataatgactactttttggttagtgatgaactgcgtgtaccatggtggttccatagatgctaatggatctgaactgttgcctagtgacctcttagccatcatcaagtcgtagtgtgacgcattatcttttctattttaaatgtgtttagatgtacagacacttaacattgtattataattgcctgtggaattcagtacaataatatgctattcaggttgtcgcctaggagcaatagactgtaccttatagtctaagtgtgtagtaggctatactatctcagtttgtttaaatactctcattgctgttcctgtaatgataaaataggctgacaatgcatatcccagaaagtatccctttgttaatgatgcataactagtttcactgccctaaaaatcctctgtccttggcctgttcatccctcttatcctcctaactactggtagccacagatattttccagattggcttatttcacttagtaatatgcttttacatttcctccatatcttttgttggcttgatagttcatttctttttagaatggaataatattcattgtctggatagacacagttgatccatgcacctacagaaggacatataggtagtttttaggttttgtcaattatggatagagctactgtaaacatcagtgtgcagtttcttgtgtgagtataagttttcagtttatttgggcaaataaagtacaattgctggattgtatagtatgagtatgtttagctcaaagtggctataccactttccatttctaccagcaatgaatagaagttcttatttctccacactcttgccagcattcagtgttgccagtgtttgaaatccattctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagttgccttttctttaaaatttagatgtaaggaaaattttgcccacgttcaaattcagtatcattcaaattcaagacagtataaaatttgacataattgtttgattgttggaggtactgtagtttgtattaaggtgttaaagatggttataaattggtgtttagccactttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaaaggtaaactcataatttctactttattgaatttgagcagttttttttcttcactgagccccagtttattatagaaagtagataatacatcattggttaattttgtgttttaaaaatggtgtgtttgagaatgtgttataaactttaaagctatataaatgatacctcttaactggactgttgccttcccacatataagtataatacagaaaactgctgagaatggatatcattttttctgtattagatacgagacacctaactcttggcacctttttttttttgttttaattgtggtactccgggcatctttattagaattttcctatatgtaagatagtataaataattattgcttatatagaataacttgtccttttttaaaaaaaaaacttaaaaatcccaaaaccctaatagtttagcagattttcccctttatatttctcaaaaaatgtgatattcagtcatgtagtgatgggagacatgtttatttctttaatgtagaaagtttgtctttgaaaagttcacattaaaacattagaatttttccattaaatttgaaagccccccttcctttttttttttacatgtgatgatagagatgggcatagaaatttcagtaccattaaaatatgttttcattgtattttgctcctcttgtgtttttcactccctttcttccatgttatctcttcagcagttgagaatcaagtaaataaatacacttgtaattcaggctgtggacatggtaaaaatattgtattcactctccattttctatttcctgttcatttaaaagtgtgaaactaaaggctctagtagtaactgattatagtatactgtcttaagtattctgagaggctcatcctaaaaagtgagaaatgaaatgctttcttaaaatgatatttgttttaatattttatagaacagtcaccatttagtactctttaaagataattgttggggggggcaacttaaaaatatataaaagttataacactttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagacggtgaaaatatgtgcttcagttagtccctattgtagtaaggtgtattttgtataaaataggccccctgcctcccattttttttttttttttttgcggggggatggattgaaattgcccagggaaagtaaggttatggcctagatttatggaactagcctggctccttcaaagcttttaaccaaaaaaattttacttaagcacagttaaaggtagcacctgactagaacctcatagcctacttacattatgatgtttcttttatttttttttattttttatttttttttgagatagggtctcactcccttgcccacgctggagtgcagtggcatgatctctgctcactggagcctctgcctcctgggttcaagcaattccccagcctcagcctcccaagtagctgggattataggcgcgcaccactgtgcccggctaatttttgtattttcagtagagatggtgtttcaccatattgtccaggatggtctcgaactcttggcctcaagtgatctgcccgcctcagcctcccaaagtgtttgtattacaggcgggagccactgcacccagcctatgtttcttattaagtaaaattcattatatttttggttgttatactatccattcaaattccttgaagtttatttcagaactgggtggcatgtaaataaatagtgcagcaagccattgtttatacaggtttggcacttaaagagtagtcaacaaagaatgtaaaggagaaacaaatgtaaacataaagttgaatagttgccagtgaataaatgatatcacccacagagattatgtaatttgagtacgcaaaacctgctagacaacatctgcatttgaggagcagaggtaaaattgccataaaaaaaaacggaacagacgtgggagaattaatgttttagaagccagtagcaaagtacaaaagagatacttgaattttcttgatgatgatgaagatttttattctattttgacagctcaaataaaagaacatgttaggattttcgagataggagagtttcaagatagaaatcaagaaatagcaattagccttgccttgcatagaccagcaggaattaggtagtactctggtcacatggagccagatgatgaataaatataagacctgaatttataaagtagggataaacttctaggatttttattctatgagaaagagaaaaaaatctagctttagaactttaggtatagtttaattaacttaagctctataagcaacaaagctgatttcaaagctcagtgttttctgaaaggttgggataatggaagtaagctctaaatgtaggcaccagaataatctattccctttctataccccattcggtaacttttctgttcttgaatttcccttttctaaacttatcaatatcctaacctattatctctaagtataataattacactttattttactttttaaacttgagagcatatggagtggtgagaacttcttgtgtgccagaggctttgaaggaatgtgttgttgtatatgtatgtgcattactttgttctgtggttctttacattacagtggatgcagagtgagactggaaaattgagtgcatacttccacattcagttagaagtaagactacatggaaaggaccatgtatgccttagtctggaataagcagaatgatcttaccctctaccatgacacctcccattcttgccacgaggcaagccatataaatagggactctgtaggggatgggagagtttataggccatggcttctattttaagggagttattgagattgttagagctacggaggagcttgaggctcatcatattctaattccctttaattacacttggggaattgatgtcattataattggtacacttagttcacatagctacatgtatattctcacttttaaaaaaatctccttgagaaggagtggcaatttgatattctttttacttcgcaagcctttagaacaaggttggattattttccacaggggctgaaacctcaaatcgcctgtacctagaacctcattcatttaatatcttactggcatgaaaatgtattcataaataactttgaagttcagttttgctatctagacttttaacatgtctattattttcaaatatactaatagatactaattttatataaaatatttaaacaagggagatacttaatgcacacatacacacacacacacacacacacccctttactatgggaagtggtgaatattggaagcctctcagaatttaatcaagaaaattcattacaatgcactcacagttctgccagtgtactctggcagacttcatgattatagatttcggcttgtgtatactctcgttgacgtacagtcctctcaactttttacattgatcatccattcttcataaagaagctttgtatccaagtcagagctatatgaaagatatttttatttaattaatatttgttttctgatttttcctataggttacaataaactgtaaactcatctttctaaaatcttcatatttcttcctcattaatggcatttttcaaagggaaaaattagtgcagtatgtcttatggtgtttcataatattttggggttggtatattttattcctgaattattatgaatgcttactagtcagggttactcttgcttagcatattcattcagtatacttactcattctcttaggatctaagcctgccatgtctcagaaactgcattcttacccttatgttatttatcccaggtgcttttatctacttgacatgtcaggtttatccaccacttgtccattagggtaaaatacatacgggggaaatgaaataacttggccgctcctaacccatcatgtctatgcaatctacttaggttattttctattagttgatggatttctactaattctctcactcgtggcctagttgtttcaagacaactaactggtattacaagcacatctctgtggccagtctactaatatagattcttgaattttagtacagtaataaataaccattaaagctcttattggtatacctaattggacacatactttgcatgtcacttactgatggacattaaagcaaagcactcataggaaggggagactgttggcagtaataaacatgaaacttattaaacattcacatttagtgtgcaagaaagactaataaattttgaaatggtttagaagataaattatctaaatatcttttatgaccctgcttatcaaatgtagaaaagagagaaataatgtcacatcaaaaattctgccctataggatccttggtttctccttttttttgacagggtcttacagctggagtgcagtctctgctcactgcagccccagcttcccaggctcaagtgatcctcccacctcagtctcccgagtagctggtactacaggtgcatgccaccacacccagctaatttttgaaaagtttttttacagacagggtttctgccgtgttgccctggctggtctcaaaactcctggacccaagagatccgcctgcctcagcctcccaaatgctaggattacaggtgtgagccaccaggcctggctctgtttttcattttaaaatgaaaatcagtaaaacagttctactagatgttgaagactgagaatacaggtgtgaattggctcattttcactggtacttctcattaatttagggggtttttaccttttgtattatgtccattgattggttgaggaaaccagagtattttccataaggacattacattagtggtcttaagtattccctaaggcttattcagtgaaattcagaagcttgaaagatactttaaaagtttgaattttattttatttttgaacagatataggctggataagggtaagggaaattagtttttgaaagcaaagccatatctcatttcaactttggtgattttgcttcagtttttatttttagttttgaaaccaaagcggagagatgaagaaataagatcaaaatcaatagacgtgaacgtgaacatttcatttgacctctgcatttcaatatgatcataatgatctttttatagtgcttttcatatccttagggattattatgtattccacctttctcatttgaaaggagagtattatggatgggatgacaatggtatttctgtggtgtctatatcatcacataccttgtagtttttcactcacctagaacattccttcctgtacactaaaacatcggtttctatttacaaagtatgacatttaaacaagttaattgacagaactgtgtttgactggtatctctaaaatgtactaaacaatcaagtgttaaatgtatttacttactgtctaaggaaaattattgtgggtaattaggttcatggtggcattttactaatacacatttatctaaacgaccacgagatcagctttcataagactattttcagatacccattcaaggactttgttgttcctaagtatgatttcttttcagtatggatctgcttgttgatgtcatactaataatataaaaattttgcttacaagcatcctttttaaaaagttatactttgaacagataagaatagatgttcagttacagttgtaaaaaatagaaatgaaattttattgtaaggtttcacatcaaggcaaagtcaactatttttgcttgtaatttggcattttcttctgttttttttctttttttgacaccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaaggagatatctaaataaataaaatgcctagctgtatttaatagagaaaacatcttactaaattggtttaccccaaatccatattttgtttttgtactaggttaggaacacgatagcatgatgagtcagtatactgtattgactaattttattgaatgaagagaaagagagaaaaaaaaaatacatatatatgtctttttttttctttttgtggggaacatggtctcactatgttgcccaggcagatcttgaactcctgagctcaagctatccttcttctacctccttcagtgctggaattacaagcatgagcaaccactcctggcgagataatttgatattaaattatttaaagatcttaaactgtcatttattatggccctattaattttccatatatcctatactgaaattgcataccaaaactatgatagtaacagcagcaacagcaacaacaaaaaacaccagtacctactttgtacattatctgaggagaataattgtgggtaattaggcttctgatggcattttactaatacatatttttgtgccttgcatattttaaagatccattcttttttctttgctatgtattttctttaagtatattatagcaatgtagttagattttttttagtgctgtttattactccactattagttttagaggtaatacatctcttgtggatgttagaaggaaaaatctcattatgaaaaaaatagaagtaaatgattttgtagtctttaacacatttaaatgttgtataaataaatcagatatattgtgaaactaacacgtcacggttctctcaaaatttgttaacatgtcatatgtgaagaccaagaaagacatagttttagaactcacctatctacattactcatggctttaagaaagtgtctgaaatgagagttgctctatttaatttggcttgagatgattccagtggtctttctgtttgttttttcagaccgcagatctgttattgttattgaactcacctgtaatttgtggaaatcttactctgtctctaaagatagattcatggtaaacccatgaaggtaatgaatcttaaaacatcacagcccttcacttgcgtgggtctcttctaaggcatttgaacaagttcatggggtcaaatacatacagtaaaaattggcagaaatacaatatttaaacacaatctctaaaggctctgatttcattctctgacttttctgatatacttcccctcatttatggtggcttaggaatagccaagcgcatttagagatgcagttagatggaagttcagttggtgttaaattcaatctaggtttagtggagttatttttacgtggtttgtagacacttgtatacagttttgttactgctaactattctggtgaagaaatggcctctagaaatacttctgttactcattatacttccttcctgatcgtgacataaatgtgcaaagccagatgtcatattgcaatttaaatatgtcctatgacacctgagatatgtgggtagtggaagagagataatgtttgtagtgtatggagccagaagctagtctatggaaaaatcctttcattcattacatatatatatataacattaagggacatttggttttcatagatagctaatccaaagagaagttttctcttacatattcttggtggagtatgtagagtacacagagcacatgacaagggtagtacttaaaattaccaatgtaccatactttccccctcttgatgagtaaaatatgaaatagaatttatcagaatgccagtgtttgtaaggcacaggctggagcagtgtagcaagcacgagctcttgtggcagtgtgggtgcatgttttatgcatcacaactatcagtagtaaaaaacaaatttggatcagctgttcacaggaaaagcaacattatagaaagtaaactgaaatttttacatgaagagacactcatagactatgtcgctaaaaatattgaagtattagaaaggaatatcaggcaattaattaaaatgctttagttttctggattttgttggttgtggttcttgttggcttttacaaatttatttcttgtgatttctttttctaaataaccattcactttggtatctaattttctatatgtaatttttctattttgttttttatagaaggacccttaaattttacaagttttagaccccacaaaacttgaattcacgcctaccttttttatttatcaggtgatagtttcaagaagttggcatagcattcccctggacattcacaggttgatatgtacattttaggatatttcattgtatctttagatatcttctttgtatttcagagatttaggatttgggagaagagagactgaaagattaaaaattaaacaaattcattttttaaaggacattatttaagtttataaactaaaacatttatttatttagtaaaagctttgagctagaataacccattttcgcagtttatgttaaataaatgcttggcttaaagccctcctattataatatggacaaaactaaatggaggaataaacagattttaaataaatttcactaatatactttgcttttatactctcctcccccttcttctcctcctaatttttggaagtttccctcaccctcaactcccattacagactttatatgaagaaaactattatttaagttacttttccttagtaatggtgtttctgttagatttataataaaaaacatcctttagtaaatgaaagctttttttttttaagttttactcttggtacttagaaaaatcacacaggaatagaatgtatgctgattttttaatgatattttataattctgtaatttttttcatacatttgattatcttatgacatcctaaagtgttcttatcattaattaatagaattctatgtaaacttgaaagaatgtttgtaagtaacttttgaaatcaaattgtgaaatatgtgaatgagactgtacctttgaaaatgtacaaaagcaggtatgttagatagataaatagtggtcataacaaatatattatctaataagttggttcaaggcacttttatatatcttgccatttatttcaacccttgatgagtagacctttattaagctgtgatgattactgaatatgaaatgtaaccaagattattttttattcaaatataatttaaatattcatcaaagagaagttatgcttgagactgacagagactattaacatcaaaaaatataattaactgcattgggtatcatgaagcagagttagccaaatagccgagaggtctaattgctctagagtttgagaagcaatggttttattttatgctgtagctgtggaattaatagtaatgcggtttcctatgtgggccaattaaaagctgcctgttaaggttcactgctctataggaaacccattgaatatcgcttagtaaacaggattgacatgtcaatgtgtacaagaagataaaatagaataaaaactgtgaaaatgagaagtagtattaaaagaactgtccttgaaaacaactcataaaactctttaccattagtgttatggttggtgttgtagtgtgcctcccacgttcgcctttcaggatcaggcactgtttctcccagctgtcaagagagttgcctgctgatgggctcacagctgagtcactccacaggaactgccacgggctgaagggatcttaaactcttctccccagaggcagcccccagtgaatcccaatgaatgccagagtacaaaggattggcttcttcatctttgcttcatttcagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaaccaaagaaaagtgctaatacattataggaatctagtaattaagtataaaaactaaaggttttaaaggaaaaaaaaaacaaaaaaaaagcccaattcaggtctaaaaatggctttttgcactcaaaacgtttatctttgtcttgtcatcctttttctttaataaaagtaatattttgacctttgtggctctattaagctttttaactgaatacaaaaagaaagtgcttctgattgaatccaaaaggttttgccttgccttggctatagaggtttagaagtgggcagacattctaatggcattttgacattaatgaggttgctgaaatggaaaagtttaagggtcaaagataagagcagcgacaagttattctagtgtttcttttacttaataatgtcatatcaaatatgcttaagaagttgaccatgattccttatgtagaatatgtaatgttttatgagtatactactttaagtattataatactttttgcaaataaaaaaattctaagacttactataaaacatgccacctcagtctattaatatgtttagttgcaacttctgcaaaacgtgtaaaaaattttaaaattgcttaatagattttattgtgtacaatatgataatgtgtatagtgtgtctttaaactgcagtgataaggctgttttcctagtcattcattatttaatgtgcttactctgtttatatctgtggcataagagtgcacgttagctttcagaagagcacaacatttgctgcttcacagcacacggccctccactcccaagcctgcacatggtgttagtgatagttaaagcacttgagtctaacattttatagattttgatgaaccgagcctttcagacaagttactgatatgaagctaattcaggctagaagtataatatgaggatagacactttctgctttcattgtcacttttaaaagcttctacaaactgcttgtgtaaactataaatcagatacattttagtttggtttatatcatatggttatggaaccatgcttggcttctgaaaatgatatcttgtctttcattgattgatttgctgccaaatgattagtgggttctgagatatagaagcaaatgtgccaaacactctaacagtatttattaacaactggtaagaatatattagtatatttgttagagtacagtctgatgtttatggagttaatatattttagaataaggtagagcgttatgcagtgcatatgattcagagactcttaaaacagtgactaacccctcaaaggctctgtagtctggtgaagaagaggagataatgtacagaaataactgtgataccaaatctcccttatagtgtaacaaactttcaaaagctggtggagaagggaaagtggtaagttatggcctgagaggggaaaaaatactgtatgctcgggatactgaggaggtctgttcagggaggtattcagcttctgtcccctttctttcacactctgtaacatggagcatgttcgccagtttctttttcctttcgggcattgtgagtgaattccctcctttcacttaagctaaggaggaaaggatctttcaaagattgtgtttatatatatctcaaaaattatgaaaatagtcgtacagaatatcatatttaaaaaactatttttaactctgtaatgtcagcatggaaaatagcactaggatttgagtccttaatattaactccgaaacagtaaggagttcaatctttttatagtagagaagagtaaggtacagtttgatattcacttgttaatttttatctgtatagatattattcagatgtggcatatttatggtattactatgtttccaaaattacaggtatttctacactttaggatataacagcacgtaatgtcttctaccacttttttttaaaaccagcatcacagatgaataaaaagttatctggctgggctcagtggctcatgcccatagtcccagaactttgggaggcggaggcgggaggaatgcttgaggccaggagtttgagaccagctggaccaaaatagtgagaccccatctctataataaataaaatataaaattacatttcccctccctgcctttcttcttttcctccttcttcctatttacctgtgatcaattgatctatctatgtatctgtctgtctatctttttaaagataatttcttgcttttgtgactgagatgcagcaaaaggacacttcccttgatctgtgctttttagaaagagctcattgggtaataggctgtagactgaatatttacgagttggtgttcagttatcaagagaatgccatcagcaatgccttgttgctttcttatcagctacttcctgctgtcagcttggcacttatttcaatagaaaaggatttgcatcaaatgtaatgccttattatatacagctaacgtggggtttttaattgtacaaacacatgagactcctgcagtggtagtcaatttgataaaaggattagattatgaatgttttgtcatgattaaagattagttcagatttatcagaagtaagccagtgaaatttgtcatatatttatcagtcaggtgagactccattaatctgagagtgtatgaaccacaagtagccatctctttataaaagtctgctgaatttggttatttatattcaggtgacaggtgctaaggattgtttttggccttccctacttgctctactgctcagagtatcccaagagtctatgtctctagcttttggtcactattttttttttaatctcatcttatagaatagtttggtaaacatctacacaaaatttctgtagtttttattaaagaaatgacaactagtgtatacctgaagacattttgaattgttcctttgattaaaaaaccttcagtaaaatacggaagattgagaattccaacttagaaggtatttaaattgagtacttcttgccataaacaagactaggcattgagatagattgaaaagaagcctgacatacaacagaaaggtgaaactacagtcccagacacaactaaaattactgtgtgaggcctgatacaacagtacccactgctcttggagtgtttgggaaataatataaacaaggacataagaagtttaccgtgtaattctagacatggaaaataattagtgagtttagcagcaactaaagtgcaaaatataggagatgccataaagcagaatgtgattaacttccaaattaataatatagagctgctgctctaggaaaagactacttccgattcaggtagtcagggaatataatcctgtttggccagcatcatttgtattggctttctgtataccacctgtgtggctgattcttcccgcatatgtgtgtgcctccctcaagtatataacagggagatcctgtttttaggattgcatggagggcaccactgggagttggaaaatagcagttcctcagactagaagcatagtatcctaagctctgataattttctacctcagggacttaacggtccttcaaatggatcttcttattaaggaagagatagttcaagaactgtacatagtcatttatgtgagaactcagttcagaggtatttgctagtgtgctagctgttttaaattacatagatatcaagattctcaaagtctacatagaaaaggttgcctctgttaggatgatttttgtagagacgagtactgagccatgcttatggagtagataatatcgtagagagatgtttaggagagagatctttcagatgcagtgattcctctagcctgtggtgttagtaagtcaatcagattctctgggccttagtatattgcacctatattaatgaagaattatattagatcggtgatttttaaactggatttcttggagaaaaccctcaggttgaggggtgattgaggtatatgggaggagagatcaagtggatttttcaggggtttggagccgaatttcgctactataattccagacctgtctcaacttctatttctaatccattctattaagcaggatttttttgttcattttttaagtaaaatttttcatgtcaaagagattgtgttgccagaatctgatactgatttggtactactgtatttgatgatgatacataatttatgctcatatttgttattaagcacatacttgctaacaacatttttaaattaagggagaaggatcctctgttagaacagaatacttgtatgaaaattcctgaggggagttgggatataatttgaccatgagggtatactctctataagtagatgataaagtgaattccttctatgtgggaaagaaggacataaggaaacacagatcaaatttgaaattcaatagttaatagaaaaagattcatggctttctgaataattatgtagcactttgtttttagaataacagttttcactttgttgaacctttggagaaacatgaactatgtatttcccttgccctccaacattaacttattaattcagttcatatattcagatattgcttgctcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactgcaaggaatttcaaaggtttctaaaacatagaaagttgtttttagaaaatcagcattgccatttcaaaatgcttattttagtaattaatgtggtatttttaaggaaatttttggagtttctaagttgtaaatgaactaaatattaaagtatgcatactttgtgtttataaattctggcataatattttactcaaatgcaaaggttatgggaagatgttattctgttttcattgactgaaaaaaagcacgacaacctcctagaattgattttccataggattttactgtcaagcttttgttgacttgccaccagttacttgatttttacttggggagtgaggactttctgtttctcttatacactatactccttttcagtcaaatggatttatgtttacacattgaaagtacagaaaaacattttgcatttttgcttatgattatcattttaataataaatgcaattttaaaataatttttatgcaatttcaaggatttaatcacaggtgcaattttaaaaaatcaggattatatttaaaactttaaaaaagtagaaaattgaatgtaataaaaattatattgtttatttttcccaaattatgtatctctgtgtaccagtattcatgcatattatgctagagattctgaaactaactttattacagtaatgatttcaaaataaataacacagtgttctataatgcaaattgtataatatcctaacatacctataggattaaattctatatgatggttagaaatctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttttggagcatgactggagaaactaatgttatcttgccaaaacagaagcccctgcttaatcagcagaacaagactattgattaaaacacctctcacaatagattacacatggaatctcgtctccatactttgcacttggtaaagtgtaataatgagcataagataatcaaaagaagagtaaaagcaatttgttgggcattgtacaattcaagattagagttggaatggaaacaaatttgcatgaatagttgagcctgtttttaaagctgtacacagtaaagagtacgcacagtgcagggactactgtggaagagtaaaagatgttctgcttctttaagatttgcaaatctgttcatcttacataggggacattgttattattggtatttttggtggcggtggtggtaatttatatttcttgatgtttgttatccaggtattgtgcagagagttgcctgcactatcccatttaaccttaacaaacttctaaagaagatactacgttttacagatgataatgctaaggttgaaaggtttaatacattgcttatggactcacaattaagtaagcagctgacctggaacttacacaccaatttttttctgattctacagcttctgcttttaaacactaatcttcccaattatcaaatgattttgcttttgaacagagataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaataaacaaaattcagtgttttgtcccatttaaactagtttatgacctataaagcaagacttttggattttctttgttgtggttgatggattttattaatgttttacgaattttaatgtcagaaataatacttttattccggtatttgaacttaatattaaaaggttttattattgggtttattttagttatatttggaattctcaggttgagtgttgtactctatatactttagaatagtaagaaaggtctttaaaattgtagtcagaaagttgcaaccagaaattatatataggtgatacttcgtgcgtttttaacccagtgatgtgaaataatgattaaatctttgtctttgtatgccaaatttgaaaattttggaaatgtgactagaaaaatactaaaaatgattatatgtttagaatttgggactgagtgcttatgtagttttatgtttattttctacttagtatttaatcatgaattataccctggaaatggtttttgttccttgtttttgtttttgagacagggtttcattatgttccctggcctgtgcttcagtggtgccatcctcccacctcagtctcccccaagtagctggaactacaggcacataccaccacacctggctaatttttttaaactttttgtagagatggggttttgccatgttacccaagctggtcttgaactcctgggctcaagagatcctcctccctttgcttctgcctcccaaaatgctgggattataagcgtgagcaatagcgcctgaccccgaaattgtttagacattattcgcaaggcctacttatgcctctgagttctctctaaaaacagaaagaaagcaatttctgtatttattgccttcctagagttgagccactttattaacatttatttgaataagtaagtcaaagattgaatataggaaaattggcagtgattacaatgggtcatatttttctgttatttttaatgacatacttctgtagaacatagtatatttttacatattctcaaaagttttatttccaattttagtgtttcgttagcacatttttagcaaaacattatacttcttatctgttaaaaaattggttcatatgtgatgtatacatgtactcagataatatacttatttcaattctccatgttaagaattgatgaataactagacagcttgctcaaaattagagcaactaaaactcttgatttctacacttagaattagcaagaagacatattaacattgtaaactgtattatgtacctcttacataagttgtactcatcacttgttttctgtttcacttgttttactaagttttatagagcaaaatcatgttttgccattcatatttattctttagtaaagtatctaaacctatctcgttttaaccctgtggctctcacacaagttgcactgatcagagtcacctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgcaatctcagctcactgcaacctctgcctcgcaggttcaagcgattctcctgcctctgcctcccgagtagctgggattgcaggcatgcgccaccatgcatgcctgcgtggctaatttttgtatttttagtagagacggggtttctccatgttggtcaggctggtctccaaatcccgacctcaggtgatccacccacctcggcctcccaaagtgctgggattacaggtgtgagccaccgtgcctggccaataatttgtatttctaacaagttttcagctgatagtggtgctgttggtatgaggaccacattttggaaactactgctttcactatcttaagtcatctgttcatctttataaatataaaatgaaataagaccagttatttgaaagttgaagtgttcaaaatatattctagtatctgcttctttatgatgaaccgtaattgtagttccttcaaattgtagtaaaatgtctactcattaaaaccctattttttctcttttgccttgttctcattcataccgattttttatgcttaatgtgtaagaaaattgtaggttattaacgtaataaacccacatggtattaccaaaatatactgatagtttgattgttaaaacaatgatacctttattggtaaagaaatcttcttctgtagaggaagggagagaaagtcatgccaggaactgtgcccagtactgaaaatacaaacgactaaacactttttctttcttggcttaactctaccttttcgctttcattagtatgagaacttgaagctgagcccttggcgggaatttactttgcttctgtggataagtaattgctttctttctggatctttttaaatgatagcaatttacacttttataatcttatcaacagcatattgttaaggaattttcagatttttcttagtattaatagctcacgttgggtgtttcccaatgtctttcttgtctcctcactctctatttggaaacttaatgctgcttgcaccctttataaaggaatataaatgtctgtatttctatttctgtaatttgggcctctaaaagcttagattcatttccatgaatcaagatactggcatgcaaagttctaattttcttgtactttttacagttggatttctctcctttctgacccttaactgttttagctctaaatttgccatttttctcaagattaatttcttgcacttctgatatctctgtgtatataaacatatgaaattttcaaatttaaaatgaatattttttatattttgggaggccctgaattctagaattttttataattttattgcaggagcttcattaaatcagttttgcttaagattatagttgtagaattaatacgttttgctgtcttaaagtggatgctttgtgtaatgtgattatttaaatcaataaaaattatgtggttggtataagtaatcataattgctttgacattaatttgaacctgtaattggtcagaggactactgcaaagttgttcagaaagagtaaatatggacagttattttttattatggtgttggtcctctttcaaacaaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaattcaggttttgactcttacgtttctgtttagttataggaccatttttaaaaattgtaatcttaattcttaatatcctagtaagatatatccaaatatcttaatatcctagtaagatatttgttgttgatcttgttgtcgttcagttcatgttgaatatatcaaaaattaaaatgtataacaatgataggaaactgttggccattatttttttacttctagttaaaatttagtgtgacccatgataccactgtattacaacataaagaaaacaaaactcttataaaatatttaataatgtagagtaacttaacatcacttgaatttttgttttatgtttctggttgcttaaagaaaatgagaaaaacttctatgttatatttaagtgaaaataatcaaataaattatgttacacaagtttgatacattttgtttttcaggtgcaacaatcgaacacagtgtatagtagttactgggtcagatgtgtttcctgatccatgtcctggaacatacaaataccttgaagtccaatatgaatgtgtcccttacagtaagtatgcagtttatatttttttacactttgcccagcattacttgttgatgctgaaagactacacatgtgaaagaagcatatgtttatggcctacaaaaccattatgtatgcagagcactaacagacttgggcctccaattaacttcatgaagtgtggaaggaagccatagtgtgatgctggccaagtgtctgtctgtgttcttaagtgtttggcttttaaggctagtgtttttccagaaaacaaacttgaattagctattcaatacggctgatagaaatctgtacttttgcccaataccagttgctgacaaattggtttggctcacagttttctaaagaaggaattgacttcagttttaatcgtgagctacttgaatggctacctgctgttgtagtaagtttagtgctgggtaaaagctaccattgcagtaactgaggcaagtgctttactttttgttctattgtctttaagggagcatttctttatgggattcagtgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattcctatatactctacagtagtgacactctataaattgcacggtttcaactaatattaaaatacaatgcaaagagccttcttagattattctaatcctatgtaggacagtgtcttatctctttttcccattttcctcaccttttgtttctttctacctctgtccattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgattcattaatcatcaaaggtttataatattttaaatctttacttttgagtgttacttacttttcaacagaattataaaatatatacaatatataatttatacttattttccttcaatatgtgatatcaattaaatctcaagtaaataaagactttgatattctattccctaactacattgtaattttagtttatcaaataacaaaattcagccattttcaatgaatggaaagcaaaatacactttctacatcttctattgaacttgttttaagttcttttttaaataaacattttaaaatgtattatttccatcctttacatttaatttatttcagtaaaattatcctttccttaggggaaaaaagcatacagctgtatataaattgtagtttgagtagtcacaacgctaatgatttctcttatcctgattttctcactacgcccttccgttattgattctaagcaggtataatattgctcttcgctgaggagtaattttaggactagtggtttatacaaaagtattgttttcaagacagtaatgttgaatttcttgtttttcagatgtagtcagaataacacattatagagcaagtatgtttcctgaaagtggttacatagaccaagttgattggggaaagttgtagcttaatgtggaaagttgtatgccattcctatggcaaaaatgttcgtgtgatgttttttcccataagtgtttcagaaggccaacatttaatcttgatgaattattgtaacttttaaaaattaatcaaactaagatcttaataaaatgtgcactactctgtctgagtacattttggaaatgcagtattagcaaccctgatgcattttaacaacagaaaagggagaaacagacatcagtcttgtcattttatgaaatttaggcaacatacttcaagcctatatacaatgtaaagtagtattttatggtttgtaagtattagaatacggtttaccaacaaggatcttacatagcccccttcctaacttcataatctgtttcttgaaactgtaggagttgtttttttttttttcctcatgtaactctactaatcaggtttgttttatgaaagcatttactttttataaggtctgtggagtcaaggtatttgctctgaatgctcggtatgattgttgttgcatgctagcttgctttctatgtaaattgatgatggtagaattgtcataataatctaaccataattctttcttcctttttctccttgcctactgtgcttgcttttcccttgtatgtattttgcttactttttttatagacttagtattacaagtttgagatatataatatagaaaatttaataagaattttataataaaatgtatatgtaaacctaactaagtaaatatactaattcttagtgggggagaaaggtactaccttaccctactcttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaaagtgtcatcttgcctggcttccagaaccctctccatagcatgccatggttacagggtctcctgattgtttcatcactgcttttcttgcatttacttttctgtgctcctaattgcattttccaaatacttatgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattgtggcattattagtcagcttaaacttttttcattgctaaaaatataatactaaccagaaacctgttagcagtgtttttttgtttggttgttttcccctacttgactgctgaattgattacaatctatgttcagaccttttaacttcttggcgccagtggttaaaggaaacgtgtgttaggaagtcccaggagaatggctaggcttgatgtacaatgccagatatatgcgttctaaagttttggtgtctgttctctcagtaggagagggagccatccaatatttttctagattatcatgtaaaattacatgtttttattttctgataaattagtgacagtttgaagtcaatatttctgtgactttaacgatcacatgaaccaaactttaaatgatcccaagtgatgacttgtgatgacagatatgcaagcattgtgtgatttgtattctctttatggaggatcattactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtgaataaagttgagtataattcagttcaacaaataaaaacattacccatctacttgccacaaagtacttcagcaaatacaaagatggttagtaatgtcatcctccacatgtgtcatatattctagcaaataatttgatccatttcagatgaaaagtctttgatagtttagatgcttttggaaagagcagttaacagccttgaaaatgagaagcttcggcagatgtagcaactgtatgttcctacaactatggtttgtcatccaaaatagccattctttataaatagtcccagaacatgaaaattcatattgaccccttattcagcccttagtgatgaaaagtattatctgacctaaatttctctcactgctgtttgacccatattcattctctctctctctctctctctttgtaatttatattatgcatttagagactcccttctctctgatccaagatgtgtgctacctatatgcatgtaggtggggtcttgcagaactattctggcccacaaatttaggtcaaaccaataagccactgtcagctttccagaaacaagatccaagaaactgatagaacagagcaatcagagaaatgaggtcttttgcctgtcataaagtagtgattgatttattttgctgaaattcgtagttcaggtcatctgtgctggatttgctatcacatatatggccaaggcataaattgtgctataaaattatccattcgttttttttcattatctatgtcatttttcattgtggactgtttaataatatattagcctcaatactttttcccatttataaatccaagccttttcattcctaaaagcacacgcatattatttttgtgccttaatctttttttttttttttttggtgagttttgagctctgtgtgatccctgcatagttcatttgctccactcccctaaacgaggtctgtttttcctgtttcaccttctccctctctggaatggccttaggaaaaacactttccagtcctgttttaactcttttccatttcttaatctggattgctttatatttacttaatctgtctgcacatgtgatatcccaaatattataaagaaaatgatgtgtttttacttggcttttggcagttcctcaacatttgggttagactaattaatgatgtgatacacttctgtaataccaggaaaaaatttttataaagagagccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgtacctctaaaagatttagttttgtcacttaagctttatgatcatgtttattttcatgatatcccaatatttcactgatttatttttgaagaataagttgattccctttaatctattttggtgatcaaaaggtaaaaagtggctgggcacagtcgctcatgcctgtaatcccagcactttgggatgtcagggagggcggatcacgaggtcaggagatcgagaccatcctggccaatatggtgaaaccccgtctctgctaaaaatacaaaaattagcagggtgtggtggtgggtgcctgtagacccagctactcgggaagctgaagcaggagaatggcttgaacgcaggaggcggaggttgcagtgagccgagaccacaccactgcactccagcctggtgacagagcaagactccatctcaaaaaaaaaaacaaaaacaaaaaggtgaaaaggtataaaaataaattatcaaaaaaaaaaacaatggaaacatggctgtagaatgttgcatgaaattttgcacatttaattgaggtccttttaatgtctaccttgactcggttattatgaatctcaactaatgcttagctaacaaatcactaattgtagtattaatacatatttcagtgattaaatatgtgctagttagtacagtgtcaagggatatatcaggtagtgtagcgctcaagcattttgctctgcccccttcttttttctgttctgattcccgactcccctttaagacttgattcagcagcagtcatttgacacttctgcaaaagattgtgatgcttttgacaaatgttaattgagaaagcactgaaagcctggctgcattgtaatcaaaagaaaattacagaggtttaacaagatgtcaagcaagtgctttaaagaaaagatagacaggtttgaataggtttctgcagcagctggctaggcatgatgtttgactgatgtacataggcatctctcatatggtcaataaattatgccctggaaataaaacacatgctttagaagtttctcttgaggtagagggggggaaaggaataaaacgtgtatagtgtacttactggtaacaagaagtatgtaactactaaagaactagaaacatgtcacactactttttcgtagtttactgtcagtagtgtcagaattaataaagaaagattgatggaccagagagcttaaaatagtaaacatatcagtgataatatgaacttgttttctaataaattctaatattctagcttattatctcatgtgtagataaagtgtaaaataagttgattttattaagatgatttgaaaacatagctatttttcatttgctctactacaacaatttaaattgaaggcatcatatatgtaaggttttaagagccaataatctgtaaatgttgatacaactttcgtgtgatttcctccaacagtttttaagtggtagtattaaatttttactgacagatttttgttgttgtttaaattaattcagtggtaattaatggaagaaacattgagctccactatttcttaaacctagtggatttaacagtttagtaacattggaaggcaaaaataacctttgaaaataatgaaaacatttttgcttttaaatgtgtaacgatagttcttttaaattctctgttaagggtgactaagatatgaagggttggtttgaattaggcatgatttgatctgatgctttatcttggtaagagattccacctctgactggaactagctgcttcttcatacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgtttacagtagctaactttatttttgtactttggtaatataacatctatggacaaagttttttaaactgtaaaagtcatttaagatcaggcactataaattacctctccctttcagagacctaggtcaagcctgagatttttgccccaagactctagtgagtcttccttacagctgcctttctcattataagcatcactttggatgaatcccaagaaaattaagggtttttgtttgtttgctataaatatatgatatttctatgctgacttcatatttaccatttataatctgcattataccctactttttgtcacttattgtcaaatacttgcattagagtttattcaaaatttaacacgcagagcaggatcatcatagctgattcccgaatgcatgcagaaaaatggtttcaatttcactgttgttttctacatctgttgtaggaactgcctcatatctctgcatgatttccactggaacatggaaccctaagggccccgatcttagcaactgtacctcacactgggtgaatcagctggctcagaaggttggttggaaccttttaatatgacacattggtgatttagggcattaacttctaacataaataatttagctttgtgtgttaaaaccagctttattgctctttgttcagtataaaagtaaaaaaaaattacgcatagttttgtctgtaaactgtttattgaaagttacatatgtttgggggtatcctgttctctatgttaagctttttagtgagtaatgcttgttaatttcattcatatttagttctgtttcttttgatgttcataagacaaaatgcattcgccgattaaataaaatatcattaagtttacaactgaatccacagaatgcaagcagatgtttatatcacacatgattatggtagaatgagtaaactactttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagttgccgtctccaggaatatattgttatcagtgccattaatttttcctattatgacaaaagttggattgctacttttcatcacactataagtgtttatattaggttcataggaacccaaaatctgtgcctaatgtggttctacctggttaaaaaattgacttttttttttactgcagtatatattttgtctctttttgtcaacatattttagattagtatacttcataaaatagaataaaaaactgtaaataagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaaggcatgacttcactaattttggttggcaaggtctaggaaaaaatgacgtctcactagttagtattggacattgttgaacttgagaactttacaagaaaaggtagtaggaaagtctgtttttaggtaataatggtctgaaagtccccttttagcctgtttaataggggcagagaaataactgctgaaatctatagaatttttttaaacttcaatgttcagttcacctttaaggtattagttaatgtatgaaatgtaataattggtatgttgcccaggacatacatcgcagttggaaaagaatagctttttttttttcctttggcagaaagagactacttcaggaatatgactaggctaatgatcattttgatcccactagacgagtacaaatagtaataaataaggagtgtttcaaattaataaaagcatgccattagcaagttatgtgtatatggagtaaatttcagcatgaccttaatttctgaccagtgtcattttcagtatgtctcaaatgagcttctctgttcagataagactaataaaactctttaaattacaaatcagaagctgacttacactatgcaaatgaagcaagttcccactttgtgacagaggattcatttgtaacttagattagagagaggctccagtctgtatttcttggtgactaatgaatctggcctctgcagaccaatttctgttccactctagttaatggctgccgcagtatcagtgtgagcatttcgactattctgtctcccattagagggagaaaaaaagcctttaacgccacttggaagtatcttccacctgccaggaaggtcgtggtgtctcacacggcagacagaacgaggatattaagatggattaagctaattaatcttactctgacagtagcttcaaacaactttcccccctgttcatatagtacctcacgctagcaatttttattgttgttctttttgtacagtgtgtgttctttctcttcagtaattaccaatagatcagaactatgtgtttatgggcataatgacacattatgactgggtgaatggaatagagtaaataaacttagtgatttcacctttccaaagcatagtcagtgcgtagctacagagtgtaggagtataagatcctgccttcagttgattaactgagttatattttatttaatgttattttgtgtagcaataaattaagcctacatatgtgcatatttacaacttgggtgtttatgaagacttgattctactttcctgttttctctaacttatcagtagaggctttaatttttattcctttctttatccctttaaaagcagatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacagactactcttccaccagaagcagtgctaacttcattagggcagcagatactgaatgaagacttactatctggaatgccatatcttaatgcctaattatgccttattgtgcctgcgtaagtcatgagactttatataaaaaatgcagatcaaaggggtatatggaagaaatggacataaatcaaattagcacctatatttgaattcataatcttaaatttattttatataagtgaatttttaaaaagaaatgaaatattttaaaaataatttgtttttatttactttgaggtttgggaatgaaaaatcagtaattaccgaagtggcatattatgacctcaatttgttttctaaatattctgaaaattattaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcgcatgcctgtagtcccagctactggggaggctgaggcgggaggatcacctgagcccagggagggagaggttgcagtgagctgagatcatgccactgcactccaccctggatgatagagtgagaccccatctcaaaaaaataaataaaatttaattaaatgaaactaaaggattatttttaatgttgatcttttttcatttttaattaaaaaacactatggagagactggcatctctaaaataatgcttggtatttactagtctaaatgctgattacccaagaattatcaatatgaaagtcattttacggccgggcatggtggctcatgcctgcaatcacagcactttgggaggccgaggcaggcggatgaggtcaggagttcaggactatcctggccaacatggtgaaaactcgtctctactaaaaaatacaaaaaaaaatgggaggccgaggtggatggatcacctgaggtcaggagttcccagcctgcccaacatagccaaacccagtctctactaaatgtacaaaaaattagccaggcgtggtggggggtgcctgtaatcccagctactcaagaggctgaggcaggagaatccctcgaacctgggaggcagagcttgcagtgagccgtgatcacgccattgcactccagcctgggcgacaagagcaagactttgtctcaaaaaaaaaaggtcattttacatattgtaataatagttgtgtcttttttatttccaaggtataaacaattttgggggtggggggaagggccctgatttactgtgagggaaacgttcacctttttcctaggacttgtcttgttctcttttcagacatgaggactaaaatagcctattatttctctatgttcccactcccttgaggacatggctataatgtcttaggttattaaaacaatttgattttcctccttagtgatttcttcttaaattcttggtttaacttcatagcatgatttacccttaataatacatgactccataaaatgatataattttatctattataattatatctaattgtgacatttaaaaacttggaggtataatttaaaatatgcaataagagcacctgttttaagtgtatagtttgatggagtatggcagttgtacactcttatgatcatcagcatggtgatatttctgtgtcctcagatgggcccttcatgctcctttgcagtcattctcctctgaccctagccctaaaaacatcagaaaccactgatgtgcttttcgtccatgtagattagttttgctttttctagatcttcagttgaatggaatcatatagtatgtagtactccttttgatcttgctgcttttatgcagaggaatattttttgaaatttatccatatacatgggagtgtccataatttaatcctttttattgctgagtattatccattgtgaagacataccacaatttgtatatctactcacttagacatattgaatttttttccactttttggctgccatttttggctgccatttttccaagtggttgtaccatattaaacttgaactgtagcatatgagagttccagttgctccacatcctcaccaatatttaggattggcagtcattttatttttagtggttcttggaggcatctcattgtggatttatcttgcatttctgtgattgctaagtaacattttgctgataacctcctttcatgtgtttattgtccattcaaatatacttttatgaagtgtttgttcatatcttttgcctatttttaattgggttgtttgtctcattaaatgaattctaaagattctttttatattattgttgtaagtctttttgtcagaaatatgcattctgagtatttttcctccagtatgtgactttattttctttatatcttgggaagagcagaagtttttaattttgattttaaaaattcaccttactgagctttagcagcatctggctaatcctgttccacttaactcctctcactcttgtaatattttaaagcaaattgtaaaatcctatcatgattactgtaagaaactttatatggatatatcccatactctttaaaaaaccacaataccattatcacactttaaaaaaataacaaaacgtttcaaaagataacaaagtgtgttcacattttcataaatttattaatactttgttgaaaccaggatacaagtccaagtaataaatctgatagatatgtcagttgagttttgtttttttttttgagatggagttccactcttgttgcccaggctggagtgcaatggcgcgatcttggctcattgcagcctccgcctcctgggttcaagtgattctcctgcttcagcctcccgagtaactgggattacatgtgctcaccaccatgcctggctaattttgtatttttagttaagacgggatttcaccatgttggtcaggctggtctcacactcctgacctaaggtgatccacccaccttggcctcccaaagcgctgggattacaggcatgaaccaccattcctggccaagtattttttcattaaaagttatttctctttgcatactaaaaaaaatattttttaaacattttttgtttttcttgaggaagtcaggtgggtaatttgtcttgtagactttgttacattcttggtttggcttatttcatccacagtgcatcatttaactctgcctggtatgctgatggttagatttagaggcatgatcatgctaggtttaactttctgtttctttaatttaacaagaactttctgttgcatcttatcaacaagcacataatctttggttttatttccttgtgattttcagatcggttccatggtttagatgttatcagcctgatccatccattgtaaaattcccttttatttattgtcttttttttttcttttttctttttttgagccagaatcttcctctgttgcccaggctggagtgcagtggcatgatctcggctcactgcaaccttcgcttcctgggttcaagtgattctcctacctcggcctcccgagtagctgggattataggtgcctgccatgatgccctgctaatttttgtatttttagtagagacagagtttcactatgatggccaggctggtcttgaattcctgatcaggtgatccacctaccttagcctcccaaagtgctgggattaaaggtgtgagccaccgcccctggccttatttattgttttaatgagctgagtggccagcatgatttttatcatcactttagacttagactgtggtaacaaaaaccccaaagtcacagctgcttacaacaacaaaggtttactactccttcctgctgcataattgttgaggctggacttcagctctgcttcctgtcatcttcagttctgctccgtgttgtttttattctgggacctaggctgatgccagctccttcccataaaggtgcaagtctcctggcagaggtcatagttcttcctctttcctctcattacagccactacttgctgaggaatttgcaaaatagtaagataaatatattaaaattctgtttacagtattggctgagtgaggctctgaatggctctccagtgaaccaagtgtattcatgttcagaaaatctattgaataaggcatatattatttcaagcatacagaaagtagaggatagcataacatctgtgtaccacttactcagctgagccacatattggtattttaccatatttgcttcagatttttttggaaaaagaaaatcatagataatgtcgaagttcccaggattgcctccttcctgattcatatcatgaatgaggtagctgtcatctttattacttagcattaataagcttaaaaaattttgctttgtaagtatgtacagtgaatacttttcaggtttttaacattaatttcacactgtaaatgtaattgtataattttctttctttttttttttttttgagacggagttttgctcttgtcgtccaggctagagtgcaatggcatgatctcggctcactgcaaccttcacctcctgggttcaagagattcacctgcctcagcctcctgagtagctgagactacaggcatgcatcactacgcccagctaatttttttgtatttttagtagagagggggtttcaccattttggccaggcaagtctcgaactcctgacctcaggtgatccgcctgcctcagcctcccaaagtgctgggattacaggcatgagccactgcacatggccataattgtataatttacccttagcattttattttttatatttacatatgctgatatgtgtatctgtagttcatttgatctgtttctaagaatgtaccagaattaactgctgatagacattttagtggcttctgcttttttcctgacagaaggaaaactgtaatgaaagtttctgtatgccttcttgctccaatgtgtgcctttctagacatacatgcgcacatacctgtgtgtgcctacacacacatactccctagaaatagaatttttgagtggtagagcatacccaccttcagctttactaaatactgccaaattgctctctaccttcttttaccaatttaatttttcaccagtaataccattactagttttgcagacactttattattgacataactgttgtcaatctaatgagtttgaattggttacgttattgttttaatttacaatttccgtgattgcttcatgttgatttttttaacagatttattacctatgttagttttctctcctatgaatttattgtttacaactttctcctgtttgattttttctttatacttctatgtatactggacactaatcctgtaaagattatatagtttacagatacttattctgtctgggctttctctttttatctttttaaaaggaatctgttgttttacataatgagtcagatatatcagtttattctttttagggttggtactcttggtatcttgtttaagaaatattttccttttggctttctacttaggaaaattttctctacattgagtttataaggatcttatacttcccttgtaaatgataaacctctgccttttacagttatgtcttgaatctacctgaaatttatttttaattatgatatcatatgagagaggcagctgatttgatttttccccatatgaataaccagttccttgtttacgtttagtgcgtaatccatttctccccctaatgatttgtaatgatatcttacatgttagccatgtctattatttgctgctttggttttttcagtaatgttaatatctgttgagtctttcagccttgctccttaaggaactgctttggctgctttttggcatgtctcttctatataaatttttaaatcaatggatccagttccagacacaaaaatcttgttggaatttttattagaattggactgaatttgtagattgattttgaaagaggtgccagggtgaactgttgcattctcccaaataacagcattatgtaattcttcatttttttcttaggtcttcttataaagttatatatttttcttatttttagtgtcttgcactttttaaaaatcagatttgttcctagacaacttatacttcttttttttattataaataatatcacttttaaaattacatattttaattgtttgttgtgtggtgtatagaaacacgattgatgttgctcatagcagccttgctaaattcttagtatttctgatagtttatcgttaacgtccctcgttattactatgtagttaattgtgtttactgtgaataatacttgttttttcctttataccttttatttgcttttcttgaattactgcattaagctaggtcttctagtacaatgctaaataaaacctgtgacagagatcattttgactttaaatggaatgcttctagagtttttcactattgtttgctatatatgttttggatacataaaggtttagcctttatctgataagaaaacttctatctggtcaaagaatttttctttaattcacattttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaagattaaaaaaattagtatccaagaattactgtacaatggtatgagatgatttttgtaaaaataaaaaggggattgtaggtgaatagctgatagatgatacagacattagagacattaaagagagtgacattcagaaaaaaagtgtggactgtattttttgaacttttttaagaatacagattatttttaaaatttcaatatcagaaattaatgaatttttcatataattccttagatttcatcaataaaatgttaatattgtaattattaatataagatagttaactcctgtaaaggcaatgtacttttccattccttttaaaatctaaatgaatgttaatgtaaaataattacaatctgtattgtgattcccagcagacagtaaacatttatattgttagtggttactattaagtatatttttgaaatgaagttagcattggcatgttgatcaggtagatgttctcagtgttttgtattgacgtgttttccttaagtgtttgtcaatttcgatacttggtttgaatttttgaaatttggtttagattgcagtggttgtcacacttctgctgtaaaggtccagatagtatatattttaggctttgcaagccatggtggtctctctcgcaaatatttaactggcattgtagcactgaagaagccataggcaatatacaaatgaataagcatgattgtgttccaataaaactttatttacaaaaacaaatggcatgccaggcttggcctgcaggttctattttgcccaatttgaatatgtaaagactgatggttactagtgagaattaatgggaagttttaacataatgacattttcatcataaatatattcttggctgggctcactatttttagaaattagaaaaaaaaagtattactgcaaacttgacctgtgtaatttttcatattaaagtggatcatagatagaaagagttgtatagatgccataaagtcattcaaatttgtacttcatattagttttaccactgccaagtaatggtcattgaaaagttacttaatataaagagccaaaaaatatcagtttgaaatatttttgtttagcttcatgatttaaatataaaaccttgaaagttatgtactattaattcatacactgttcatacttacaggctaacagattggtattagttcatgacaaaagagataaaaatatgaagaaggtgttagaatgacaatacaaaatttttttgagaagtgaatatttaagacttaaatcatttggagtaatttggtttttagtccatgatttttgttgaaacctaacagtaaaattttttaagtaggcaaaaagaaaacagtagtttccatacagttatcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtactaacaatatgatttacattgctgctagtgtatctcttagaactaaccaaaaatgggcccaaaatagaacatggatttttaaaacatttggtccgtatagaattttctcagaacaaatttatggctctaattttatcagaaaggaaaaaagattctaatgtaccatcaattgtaaaatcataaaatggaaattgtaattgtgtaaaatgggtcttggtaatttaaagtacactttagagtctttcggactataaagccccttttaagctagatatctgccttgtataacatagtccacaattttgctgatgaaaaactttatagtctgaaacatgcaaagtttaatctaaattaccttttatacatattaaacaattgctgttgccatcttagaatataaaatcctaattttatcttgtcattttatttcccagcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcagtaagtatttgcacttctaattagtagcagagaaaaacctcagagattcaaaacagcttgtataatagtcccattctttgggtgcttaccgtaactaaaaagcaaacaaagtaatgttgatttctaattgtttctacactgtccataaattttaagaagtcttggcactgttattgttacttctcaaaatcatatgctatgactttatagacttgtaagttttcctccttggggcaggtgcttggtagagacaacagaagatttaaataatgagcagcaataggtcatacaaaagagacagaaggctctcgagtttaacatgcccttcccatcttgaatgttcgaatctaattttacaactttccctttaagtttcctaaccactttgcacattgtgcaaagctgcatcttttgaaaagtcaaaatggcttctggaatatgtctcagtattctttcttgtgattaagacaatgacagccagaagacagaaatattttaagaagtgtagcatttccgtctcagatccgtagtatgtgtcaactctcaatatgtaagcatacaaaaccccaaggagaaaataaaaacttaaaacttggcttatgtgttagcttggaaaaatcattaaaatgtcagttgtttttaatcatgaataagtattctttattctgtcatgtaaatagtttccatgtgtttatgtagttaattcagtcatactttgaaatcattaggctcctttattgttttctaggtaaaatcttcctctctcatagatcattttttaagtataaaagacaataatattgaacgctattatgtgatcaaaatttatttttggtattgagccttttttgaacacatatgaatagtattcttcaaagagttcagtagtaaaagatgagctgtacatgtgaaagctgtctttcttctagttgatgtaatgcaggaatactaatgttcctcatatctttttattttcagtataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcggtaagcaccagttgagttcattgaccttagatctctgaaaattattttagtaggtgtgaggtgacatatgatactgatattaatgtttgaccttgtaacttgatagaattgatacggcaatattgaaagacaatttgtagtaaattaaaagactgtccaattattaagtaatattatgaactaattcattttatatattaagatacagtcgaatttttctgtgtttttattaagacataattttaatagaagaatgctgaggatacagtaatataaagatcctattttaaaaattcttattttgtttacatagtcattctgaccagtgatcctttctttgtattcatagcaattgattcatcatcatgaggtcttaatatcagaaacagaacttagttagttaatgcttcaccctatattcatctgcccttggataattttaagaatgttccagatatgacaggaactgggtaattagagctaggattttgtcattaaagcaaaattttaaaattccattatagaaaaaaatagaaataatatatttgcaaacaacacttttaaagacttgtgaagcaaatcatctacaagtggaatatttagatttcataacagataattcacaaattatgaagttttcttatttgatatttaatttcactaaaaaatgttatagtaatgttcttccttgatgaaacctagcacacttggcattatactctgtgaacatgataatcttcagatttgtcagggtttttagcttgtttccagttacgaaaaaaatattttcaggaagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaattcagtggggattccatgttatatgaaaaatgaaccactaagtaaaatctgtcttaataagtttatgcatcatttactctaatactgtgtgagttctgtgctttgatatccttttctagcatttatccattcctagtggaggtattatatttctgctacactgttttgcaacaaacataacatctgaacagtttttgggggttctgttaggttccatagggttaagcacttcagctcagacagatctgaaaggcaaattttgaaaattatatgtaggactttaaaatgatgagacaatttgcaatattgagtttcaagtctgtcttagggaagtcagaagtcttaaggattcagtggtggagtggtgtttattgtcttccccatacaagcacgattttgtatgcttttatcaaatataaaaccagcagtttgaagtaaataaattattttcctttgttaagtcaaagccaactcagaattattagaggtcttgcacatgataaatgaatcttcaaaggcaaatgtaaagatagttttgtctgttaggtttttaaaatcctattttccttgtgatgttgaggttccatagaaactactaatgcatattcttctcttttcataatagttgctggcttcatgttgataactactttatatggagcttcattggacctgttaccttcattattctggtaagcaggttctgttttcccttgctttttagcttgctgctttagcagtgctattcaaacaaggataatttgttttattgtttgtttatctatctatacaaagatttataaatatgcctgtctcacaggataatagtatattttaaatattttttataaacttgctaattaatatttctgaaaatctttactctaaaaagtactttttctcatttctaatttaataagctgacatatcacatcataatctaaaaaacatgcttacatataggccatgttataaattaaatgaatatgtcagaaaagtgaaagaatattaccttaatttttattatcttagtttccacatagtaatttaatgaattactatgtaattctaatgaattaattttaagtgaattttaaatgaatatccacatcctcaatgctttttagtatataaaaagttgtttaagcttgcattaacgaatgactattaaatcaacttaaaatttattagaaataaaattacttctataagactgaagataccaaatgaatatactagtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattagttcggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtcttaaaaaaaaaaaaaaaacttgctcagttgtagcactatggtgagaaatggtgttattaactctgaaaaggaaacataaatacttcctattttaagaagtttttcttacttttttttcaaaaacgtaacacaaatgagctcgtttggatcttttcatggttaagcagtgtttcatgaaattgagaaaaacttctagtacttgaaggaaacttaaaaccacttcaagtgtatatttgtttgtcattaaaattaattattttacacaattacttatacaaagtgaaatgaaaatttgagatgaatgcctgtatgaattaaaccagtaaaacattctcaagtattcctgggaaaactgatttctcatcagaattattaaatctgatgattgcccaagtttttgttcttggtgttcatatgttaacacagcctaagcctgtctagagttcaatggctgacatgaagaggcatgatccttgaagacataaccttccattttcctctaagaccttcgtcaaacacataagttgcaaaaatgtaaagactgctttagggatatttggccaatgaggctatcatgtgtttactccttttatactgtagttttatttatttgatatctgtgaagataagtactgactttagatcattaaaaaacatttcaattagcaaaagaagttaattttcaacatactcagcttttagtaagaaaaaagggtaaaggacattttattatgttgttcatttatagtagagcacactattactttataagtcttgtcattattgtcctctaccaaatccttcaggttgagatgtgaatggctttttcaacagcattctcaaacacaaaccccagtaggtagcaatcccagtacagatcttgttggaattctcctgcgattgctttgctttctaattttcccaacagagagaaattaagagtggtataggagtacaaaacagcgtcttgcaaaagaatatctaacttaaattgagatatgatatgatgatacagtgtgtgtggggaaaaaatatatatatatatcttccctctggtgatgataagacatgtaaactcaattcaggcacaaatcttaataatatagattgtattgtatactatccttttaaggaatattcccataacaacaattacctattgctattcctaggaaagtatagctttgcattttcagtttttctgaattgaaactgtttcacttagttgtattaaataggtgtacattctaaataataatctatgaagaaaaataatatgctaaggaagataaaacttcctacttctgcatttctataggatgtcttgcctacaggcactagagttattatatctatgagaaaagtgctggtaagtaatgagcagtgggaaaccattagtatgcctgaaatggtttaatgaaagcttggatcatgacacgtcaggagctgttcttatcatttggacagctccatctgcatcgttaataattaattcagttcagtaagagttcagctcacacactcatttagaagtcttcttcagagaacacctctctggctgctagtcccagggagaaataggtttctgcttggctaacagcaaagatctggagatacaagtatagctttagagttgcatttgccaggtagcaaaagctccagggaggacaaaaagggtcagaacgtgcacagttcagctaggttacttcagagtgatgtttctgttcttctgtcttatcatatccatgtcagcactgcaagctgtggaatgaattttaagctgctaagctcagacggatgtgattcaattgagcaggttgatgaccataaaacaaactgtgcactcctataatctgtggtacctttttctttcttaaaatttctttgtatttttatgttcatcaatatgggtgatgtttagctgtgtcatatcattaagcagtttgaattttatcagcaaattatattggtgggttattataaataataatttatgaaattattgtttggggataggtaaaagaatgatctttgtcagtgggagagaaaaaaaaatgtcccagtttgatgacttactctttttggctgaataaggattttttttttcttgatttgttctcactcaacagacttatcttaaaagatagccatctatttacctgtacacacacacctgcacacagacacacacacgcccagagctaagctaaaatctgattcttgaatgagttgtttcatccccagaattaattattagcatggacatttagcctggtgggttgtcatatgtatgtaccacaatcctaatagcctatacttactagtagtggcttctgtgtggataattgagtaactgcatgtacttaccaagtttagacaaatgtttgtgtgcgcagctgtaactccacctttttcctttctcactgatgcatgcagcctttcaacctatgccaaaatattatgtttaaacttcgtagtatttacactgaaaagaaaaaacaaagagcaagagggtcaaagagtggctgcattggaattcaagggagaagagcagcaattggatggtagagacattgttctctccctgcctctttgcctgccttccattgagaaataggggaaataccatgttggatggttgtgatttattttgtaaatgcgtatcaaaggcagaaaaataaattgggcaaaagtaaaagtaaggaggagaaagaaatcacttattataattggtgggggcgggggagaaggggaaagcacagaagtatatggatggaaagagccatttatgtcatgagaaaaatgcaaagaagaaaggaactcagacttgcagccagtagtttatttgaaacctaccttttttgtcttaaaatgactacagatttttatcaaagatgtgtttatttgcccctctgcctcttgttctcatttccacggttgtattttaagaaaacaagaaagaagtaagaaaggggaaaaaatttttggaatattttcccctgcaaaattataattatcagaatgtattgcctcctgaaaaagattgcagcaacaatatttattctatcaaactaaaatttagcattacatttttttaacattggagaaaataagataactgtaaaaccacatttttaaaaatgtatctgtgcttcagtatatgttctatttaattccagaagatattttattgtcatatatgttggtggtaacataaattgttgagcatcaaagtgatataaaaatttttgtatttctctaataagactagtaaataatatgtattggtgaaatttttttctttagttgggaaaaagaaaaatcttattcagtattattttgccatcttacgatttatgtcatatgctttatttcataattaattagtcttgaaatgatgatattttgtcctcttccacataccattgcctcattatttgtatgctttcaagtcatgtttcagaggctaagttagtgttgggtttaactataaatttctttacatctagatattagtgcattagctaaaagttttattttcagtttcttcaagttggagaattcagacacttgtaatttgagcgcaaagatccctcaaagttatgattatttttccaatacttttagttgtctttaaaggaactcactttcaaatcttttaaaacattccattttaagtatgttagaaacagctttaaaaaattttgttcttacatttgcacttggatttatgagcttatgtgatatttagcaatgtaaaagtataaatgacataaacaggtttagaaaaaatacaactaactgttgttaagcatgtgacttgactagtgggagtagaagcgtggccaattgctgattgtgggatgctagtgttttacaaaggaaatggagaattagttaattctggcaaatccgtcaggcagaagtcatttgatgagcatacctattatgtaaataacataaataggatttctttgaggcagtattttatatgttaatttatttatcttcaattcattcatctctgagtgatttttaagttggattactttttatagaaatggaaacttttaaatatagacttagtatatctttgttaggagacttctaatcttttcacccagaataaattggttaattttatatgggaagtctgtgggctgtagagcccagaccacagtatattgaatcccagccctgaaatatagtatctaagtaatctttggaaggacacatctcaattatttgtaaaacgggtatacaagtgctgcctgctaccactgtatataggattgtagctgtatttttcctctgtaattttctttattttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaactagaatgttatggaaaataaagccagataatgtttctacaattgtatttactttttctctagatgtattttaagacattattaaattttttttaaacaaagcactgtttttgtccttaagtaattaacatcaaaggacagaatgttacctgccaacacttgtaaaattttgcccattgacctcatttatcccttaagagggaattctccatctaagagaaatcatagggcacagtggacaaaatgactggatagatacacagcctacattaaagctttccttagctctgctcctaaactcatcattaggaaggacttggaaatttttatttattgccctatatcacttttcctaattataaagtcagaagtagtgaaagatgaataaaatagtgttaccatttgatcatgtgatattgtgactcagtaaaaatgatcatgttactgtaacactgttatgctgattatctgcaacaaggaattaaattcatccttacctataataggtgaaatgggtctttttctgaatatactatttctggtattctcttaagtaacgtacagctcacaaaatgacttttttttccttttaaaaagtaatctaaaaataaaatggcaaaaaaaaattcaggaacaatgtagcttagttctatttttggagcataaaaatggaactgcctcctcttcttccaacattctgccaggtgtctgtagaaacaaatgcaaattaccaacctttgtctctcagtcaaaacacagctccttttcctctgagcaagctcatgttgacctcttggaatccactcactttccttcttgtcagattccatcttcctcattttgcttttgtttgcacctagattctttgcatagctgaatgtttagaaagactcaaaacagcattttgtcagaatgtatctacttccttacaatacagagacatagaaaaaaaagactgatgatggcttttaacagttaaatggcaaaacatacctatataaactttatcttactttatataacaaacgtttatcatgttacttcatttgatccccacaattgccttatgaatagattggacagatgttattatcctcatttaatcagtcaaaatcaagagctagactcacagccaagacttatggtttcaaacccagcaattttgtagattacatgatgtacattatgtaaatgctccttctaaggaattcactttagtgtttccatcagatggtttttaggccctgaagtacatctagctaaagaaactaatttaggttttctaatttatttaatcattaccacataatactgacttaatgaggttgcaatttgatgtcaaatgatctattaaagaattgatcatacatagccagagtattttttatgtagactcaacttgatcattgcatacataaaaaaaattatatcagtatcttccatataaacatggatcgatacatttgcaagaactattcatttttcagctctttgttcattgtggtctaattctttatttgttacaacagctaaatattatcttcttggtgatcacattgtgcaaaatggtgaagcattcaaacactttgaaaccagattctagcaggttggaaaacattaagtaagtattttgtattttaattttaatacttgacaaactaagtaaaagatactctccacagggaacacagggatttctaccttctatcaactgtagaaattattcagaatgaagttttactgccctcaagttgaatctcagtgttactatatcactgatactggtcaaaaattagataataattgctgtcttgatctagagccaataaattgtttcagtggctttgtggaaattccatatcactgtagcaatttcatttgaatttaaaatgcagttcaaaatgattttcgtatttgcatggctgatatgattatattaagtttgttttgttaaatgactttttgctttaaggattctgagcagtttccactcctaatcctgttttcctaagagaatttactctattactattgttaacttgaagattatctgttgttttcatgctaaacaaatatttactttttcttaatgttgaataaaagctgcaatattctgtcaatggagaaaatgctatctaattaacaacaaatgatagctgttgttcattaaatcatcttatggaaacattttcagagttacctttaaaatatgtgagccttgtaatttagaatttgagaaggtattattcaagttggttataatgtgattgtaaaaaatactatttttaatgtcaaaaatggcagatctatagtaagggtaaatttttttttaattagatgttttagataggttagtgccagcttcattgcatgttgcatggtaagagagagagctaatctttagcatctctctcttttcttccttttcctctttctgtcttctcatctacaccagtaattaccgtgtttgtgatggctactataatacggacttacctgggtaaggtagaaccctacattaacaaatttatggcatgatttgtattttttacaaattcgtcagtatcatgaattgcccttaatttttataattattttgaaatatctaatttgctatagtatttttaaactataatatgcctttattttttaattgcttgcctctgcattttgactttcttaattttgactaatttataaaatatataaatgctttcttattactttctattttaattctgtctaataattttgtttctcttttctgcttataatgctttctagctatgaagataataagccatttatcaagtaagatcattagttagacatggaatgcactgactttaaatccttctcattccgtcctattttctacagttcttttcttcttaagctgttcatgacgaaatctctccaaaattattttattttgaagttgttctcatgtttttgtctcatttcagctaggcttcttcatgctttagttataaaaccttaggttcacctaagactagtttattagaatctgaagtttaggtgttaagtgattatctgccatttaacctttctgtatgtgtcacattatttagtgtcatgtgagtacaccataggaataaaaatacaggagtaaattaattaagcactccttaatttcttttatcaaaatgcacataaaagacaaagtcataggggatatgttacacgttgtattttaatatagttttgatactttgtttattctggaataagaaaaggtcatacctgctgttgctgttttcactggaggctgcagtactaaatgctattgttctttcttaatcagagaaaggttaaaaccaaaatgctgttgaatatgaatgtgaacatagagaaagtcaactgctactactgatatgttaacatttaagcgtgatgtgtgttttttgctcattgaacctgttaaaaaagttcactttatttttccaggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtaagtaattgaaaacacctaggggctcaggttactcattctttgatttgaatataatagatataataaagaatattttaagtcacatctggcatattgttaaagagcattatatttttaattataagttaattttcatacctgtctgaaaatttaggtttcacctataaaataataccagtcatcttttgtatctcagtttgggaatgttataaactagatacttaggttaagatttcttccttgctcgtagggtctataaaatgctaggtacaaaggatatacaaggtaaaagaaaaggttaaataaaactcattctttgctcactaaaggcattacagtgattcacagtgaaatggagtataaggataaatgatgttaatttttaaagcaccagacatacaaaaaattaatgttaccttttgagtaattttgaaggatctaaaaatcaataattagtaccttacatcttacttactgttttttcctgattttatgttaagtggagtcagatgaaacttacagatgaaaagctttaatctgtagcaagaagatgtaaacctaagggaattgcttaggtgctatttaagtataaaatttccatacctttcactgggtatcatcctttctctgcctacatatctaatgtagtcgttttattctgttattactagttggtcactaaattgaacagagaaatagaattgtggaagtgaaagctattatgttttcagtcctgacaagacgatagtgttgttacttccatcagttttgaataagctataattttgagataatgacagtggaatgtgcaatactgacagataatgtatattcacagcaatataggcattaggcaaaaccaacactggaaggtattatttggataaaataccattttgattgccattgtcttggttatacagcatttcatagcagttaacacccattaaatgtgttgaaatcttttgtgaggtatgatgtgttatttaataacaatgaactttaacttctaaacattgtacaggggtaacattagtaattactttggcttttatatatttcctacataagtgagcattttattattgtatgttcataatttttgtgctgttgtgccaaacatctttgacacaaatcatagacatagcagaaaaggagtgaggtagtcattatttcctcatatagttatgtgtattaaatggaacaggagagtctcttatgctttttagatttaacaattacattttaaatgcatcatgttatacttcaaaagaagtataacttagtcttggatacatccagttgggtgcgccaggatgagttgttaagaatatgatataaaatggttaagttaaaatcatggttttaactgcttgaatgagcatacttaggccaagaaaatgctttgaagactcaaccacattgttatttgttctaataggtataactaaataaagctaaaaagatgaaaatgtaagtgcgcttagatttaaaaggccatctactgatttttaattttctaattttgcaaggaataagtgtcaaagtcatggtctttacaggcagttactgcacacagacttctgagttgagggaaagcctttgagtgtttttgtaacctattagaaaaaatattttcttatgcagtttcttcttgtctgtcttgtaatttcacagtctggctctaacccacaagaaaacatgtatatgccagtatagctgcaacagtccagcagcaccctctccctcttaattctgtaccactgctttagatggggccctattatttagcagttgttcggacttcactttttaaagtttagttgaaactttttttagacctaacaactttttttttgcattcatatattcaagcttcaggggaaaagggaaattacatgggtaactcattaatgtgaatgaaaattgcataaatagttcccttgtgtgctaatgaagtgaatagacatcttagactctctacactaaatgttaaagctagacacatcagaaaatgaagaaaacattccttcctaattagaggcaaatgtatcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacacatgtattcttgaataaaagcttaatacattccaatttagtatgaaaaattatatggtattgtatatatccttggaaaggtaatttattacactattttcagtttgatatgtactgatttgtaatacaagttagaatttattacaatgaaatataatgacattttaaactgttgacattgttctagtgagattctcatttaaaatggaaaaaggtgtatgtgtggtagcaatactaacctgaattttaagatatttttatccaaattacattagctatgcaaaacataatcagtaagtatttaaaagtttgtaatttgtcagttagaatgaaagacgtgcatttcttctgttgctttggtattttacttcattctgttggcgatcaaaaagtaaatgcattattcaatgattcatttttgaaacctggcaaataacattacataatgaaaattcttgttatatagaatttgtgaatgatctaataattcattttatagtcttttttttctcagcatgtgtgcttttgcatttactaagagaagctttttgcaatgtgtcatactttctacctgtctgtgaaagttgttttcctcctgctcagttggtattaacacagatgttttcatgagggataatcccacacctgtaaattctgaaagtttgagattccctcttctgggcctcagtggttacgtttttaatattaagcagtaacatcttgaaacataatgttgatctctatgcatttaattgccatttttgtttaacagtgcttttgtataaattagtaaatgtcatcctcagcaggtgtttacttgggggatttagaaagcacctgtgaattactgaaatttaacttccctctcccttctctcctgcaaattagtagttcaaatacagtcagaacatttcaacagattttccattgccaacttgtccactacccttgatgaatataaaaaaaatagttgactacaactgtaacactaaaataagaaactgatgtacttttctctgtttttttgttgttttttttttttactttaggaatgactggcaattacctactaacaaaccctcttcttcgaccccacggcactaacaacccctataacacattgctcgctgaaacagttgtatgtaatgccccttcagctcctgtatttaactcaccaggtgtgctttacttacaaataaaactacctttctttgctgctaaacagagctatgatctttgccctgtttctaaaatattcaagttgtcatatatttattgttacattcttaatttctcagttaaaaaaaattacggtattgtctatgccaggcttctaaaactgcactatattatagtaaaagctcagtcatgatagtatttacaataatgatccatgtttttaacacaggtggcataaatcttaatatattattacaggactgacatcacatggtctgagagcccatcttcaagatttatatcatttagaggtatcctatctatataatatactgttcagttaattctaaagcttgctgacaaaatttgcttctggaatgaattagctaatgaagataatttggatgcctagctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatgaagctagagaattgtgtctaccaagttaaaggaagccttacaaataactatcacaatttcattttgttgcacatggaacatgatacaaatttgtcagtttttcagatgtagaagttgggacagtctttaagacaatacaaatcactaacaaatataatctctcattttctcatttttttgctaatgataatttgcccaacaatgatcacatatttattggtcatgaagtttgtgtcaggtgatacagatattttttttttctgaaggaaactgcattttctaggatatctgcagctttaagagtggagtgagcactaaaacgggaaatttcgtatttttttccaagaattaaattttttcctaaactcctccaagccttgcatacaatgcagcagcctcacagtggtcagcttcatttcaataacatcatttcattctttttttttacagacctatctgtagactgtgatttttttttttctctaggattttgagaatgaataacctaactttccatggtgcagaccatttaattttctcttgactttttttttcatttgcttgagaagcactgtgatgtcttagtttacatgtttatgtgtctgtagaaaatacaactctgattcaaatagagcatgttaccatgttttatttccccctcctaaacctcttttcctatcttcagcagacttatccagtctttcattcctttagagataaaaatatattagccaaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaatatcaagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatatatattttttttttttttttttttttttttttttttgggacagagtgtccctctgtcacccaggctggagtgcagtagtgtgatctcggctcactgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaatttttttaaaggcaacactgattattcagttagtcctatttctttctcttgaggcagttctcaaaactctaaagacatgaacactgcatcgtacctaaatggctactgttctctaacgtctttatcctatggattcaatttggaagccatcattgatctttggcatcaaaagaaaagtcatttttaaagcatttcttttcaaaaatatataaatattgccttaaattccatctaggattcccttagtacaaggtagtttcttaggtttgtaattactaaactactgactgttttaatgcagatgcgttattgtatttattaacccagtttctttgggtctgcctagacttcacctgaatgtacagttttcacattcttgattgtttctctttgtgatagtcacaactgtgaacttataaagtcacatttttaaagttcttcctagagacattcactctgtctttattaaaaataataataataataataaacgttatcttgttggcca

SEQ ID NO: 2314 - DNA, 193536 bp, Homo sapiens; identical to SEQ ID NO: 2313
  source 1..193536: mol_type = genomic DNA

SEQ ID NO: 2315 - DNA, 193536 bp, Homo sapiens; identical to SEQ ID NO: 2313
  source 1..193536: mol_type = genomic DNA

SEQ ID NO: 2316 - DNA, 192996 bp, Homo sapiens
  source 1..192996: mol_type = genomic DNA
ccgtgcgcgcgcgtccctcgccgccaccgccgcccggacagccctgcggccgccccgccggcggagccggggccggcctggtcctcgggcggctgcttggccaccgccaccgccgtccgaagggctcgagcccgtaagtatcccctttcgctcctcctccccgccgcttgggcgcacagccgcagcagctgctcaaatggagtggaaaacggccattgggcgacaatgagttatagattatctgctccacgttttgtacttagctgcctgtaatcttcttttgagtttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccggggccaccccagcgtcccgcccgctttgccctccggtcccgcactgtaagtggagcggggaggctgagcggctggagcgagttcgggggaagtggacggtgggggagggcttggacgagtttttgagggttgctgttccttctcgtcagtggttaggtggtgtggggaggcgaggatgacagtaaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgttttattagtaaaatgaaaaggccacttaattagtttttaattagtctctaaaacaatagaaattttgtgattaaaagactcatttgtacacgtaggtaactgttttttatgtgctaaataaatagggaaaaagtcagcggaggatgctgaaaattaaaacctcaaatgaacttgacacaacttctgttgcaaaaagaagcttggaaaagttttttttaagtgaagattcaaatttttgtgaattctatttaaatagataattctgtttaaatattgttttgtttcaaaatttttgtatcttgtcaaacagtaaactctagtattcagttggtttattttaaaaaatatagtttatttgttcttgcttttttatgtttacagagagaacatatctttgaatttcttttaacaattcaatatccatgaatgaaaaaaagaacaagtgcttgggtcatttgggttagttatcaagtgcagatgggtcaagggggaacttttatcttcaatttcttgggaagaattagttttatttatttgacttaagaatttacaaaacttaattctaagatggaaatgaatttcaggggagacttttttggagatgtaagctcatattttttatagttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggttaaaaaaaaaaaaaaaggccacattgatgtaattgctattattgcacttaagttgctgttaactagtctgctttgaatgcagagtgttataaagaaaacaacattatcctttacagctattagtgataatctaaaaattgtcttgaaaacattgctcttcactttatgtgagggtgatcttgaattcagtaaatctctaaaggtgcaaaatgtagtgaaaagaagatttttcaacatttagatgacaaaattggactacttagggaaaaattaatgtgttgtagaagaacttcagctgccattttcaatcactgggttactatgtgttggcaacagaaaacgaatttagaaatggagatagctctgggagcaggtagttggggaaatcagaatattgaatcatgtggggtagaacaaaccaattacttcaagttttgacttgagaatttccaataagtataattttttccaggcttttgactgtctgctttattaatggactaacatcaaagcaggcaacaaaacttccaaatgttataaaaactaatgtaaatatacagatctcacatgcagtaatacaagtctaaatttaagacaaacagttggggtttttactgctgcaattttcacaatcagcagaaacattaacaccaggcttctgggtgtttccttttttgaaatgagctagaagagagctttaaaactaaggtttacttagggttaatctttatttgatcattattgaagctttctgtgtttcattaaatttaaaatagcgttttagtatcttaatataagaatatgtgaattgagattgagatgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaaattcagacacagggattacaccttaatctttgaatttcagtgttgaaattagttatcttaaaagaagcctatttaaggctaaaaagtctttggaggactttttttgcggtagatttagtactttaataaaaacagaaatatattgttaaaaattgggtaggttaggcagatgttaacttcctgaaatatgtgaccaagtcttaattctgttttaaaatgcattaagtaacatttatatatatttttaaatctgataaaaaaagagatggagataaaaatgaactattagttcttggctatgagagatgggagaagttgaaaagatggttaactttagacttagcatcaattcaagcacatgttaatttgttagaacaaaaccagatacaatcctgtctttttttctgaatgaataagaaaaatcttcagccatcatactagcgaagaaggatgcaccatgaggttcctaataaaaatgggcttaattttgctattttcaattgttaggtagtacttgttaacccctttcttggtcacacatatgtacatacataaacacacattttatagtctgtttctctgtatatatcaatacttgttgtttattgttggctaaaaattaggaagttcaaaatgtaaaatatgtatgattaagatatctcttttaaaactgattttgaaaatggtatgacataaatatctgttttgctgtcaaatatatctatatctcctgcctgtggactgagaaatgcttgtactatccacactttgcctccttttataggtatttttacatcagtccacacctcaagctagttattactctggatttagatgacagcataatctaacctcaattactgtcaaaaatggcacttgactgctgggggtgggttaggtgaccttgttttgactaatgctttctcttgaagatgatagtaaatagtgtctatttatagagcgaacaaaagagaattctgttttcttcataaagtaagttctaattctaatcatttattcttaacattgtaagtactatgacagcagttctccatataatgggcaaaccattacaagattttagataaaatttttagttgatacaatatttctgttttatgcagactacgtttacttaatcagttttcagcttcaatttacataacaaataatcatgtttaaaatgagtttccctgtgtctttactttgaagcaaagtatttctatgtggaattattactcctttattaaactggttaccatccatacggaaattttctctgcattaaaagcctaccattttatagtgtttgctactgtggttattgattagaaattacagaacacatttcttatgtaccattttctccactcatctttgtgttcttaatgtcaggatgcttatggcgtattttagttcttacaattcctgactttcctatggttaaaatctaagacattttgggaaacattaattttgataatattctatgcttatgtatttttgtcctagtaattgtacatttttttttagtttgatgaaggcttaatgtattaaatgacagaagatatactgaagattcgtgtactgaaaataatacatctctccaatattaaagagatgagcataattctaaaacacgtcactttgcctcatatgcgtcgacaaataaaaattacactaaaattataatgtcctagacatgttcacttttactaaggacatataacttttttgcgcttttcagagttctctctgtcacaaagaagacaatgtttgaatattaggtgcttcctcttgatagctcaatagatgaataaataggaatgttctcccactttgctttttctactacaagtgctatgatacccatagcctgcacggaaatgacttttcatattgttacgggttttaaactagatctacagcctgaatatctaaaaatgtacatgaaacaaaatttgattactttttcttaagcagaaaaccccacaaaaaacactgctgatttgctgttgctgttcctcttacctcatttgtttcattgggaaaagatataactgatacctcagtatgatatttctgtatgttttagcatatcttataattttcctttgttcaataagaaccttagttttaaaaagtcacttcttataagcctgtcagttcatttctaggtaagtcaaactggctttgcctcagatttccagtcagtatttacatgttatcaaggtgatatgtttatgttggaaccgagacattttaagggagagaggggcatcagcgttctgcagcaacacgttttttataacacgttgcccccgagacttagaaactgttcttaactttctgttttttgctcccttggcagagatacatcacatcatatctctgtatacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgaccactaaacatatcaaagtgtattacattcctctacatttaattaatagaccagattagatgagttgcatatgtgcttttctaaacagaaaaacgatcgctttggcttaatgacttttacttgcaataatggacatgagttcaatgacattaaaacacgggaactactaataaggacctactattacatgatttagaaaactgctgactaacttgggaaaaaaatgaatgcaggcagaatagacagtacttgattgaaacctgaattctgtttatgactctgtgccagctgaatttctaaggaattgtaagccagatacttagggaagtacttgagagtttttcattcgggtgtttaggtaagcaggatgataagcttttagaggcatttggatattttttagtgagtagaatttttcatatttcctgcatacacttatttgtgccaggaaatttaatgataggatattatattacattttattaaaaaatcaattccagtcttttcatttttccattttggtatagtaacattattttagaatttgcttgttggttggtaaaaaatagaaaggttattatccattatgtatctttggaaagagatgtaatagttcatttctcttattttatcaagtaataatatgacaaaaatatttattttgcattttaaaaagcttcgtttcttaatgaaattccttgtttcagatttattattttagtagctaatctttactaatgtgaaaagtcacattgttactgtgacaaagaataatcctctaagtaaggaaacttgtttaataaagagatttgtggtactggtatgggcttttttataagtagtattctctcagcgtggccccgtattatcttaacaagtgtgtgccacatttatacagagcatttttataatggggtaagaatattagcaacagcaattatatttcaataggattaagatggtatgttttacaaaagtatacaaatgcttcttttccatacaattattggtagatactctttactgccaaatttatgtcattgtcttaaataatataaaaagatatttcttatcgtagctggtttttaatataataggcactgcaaaatgggatctgatgttatagttcattaccttttttccccctaatactaaaacctccttcacagtgaggtaagggttactggagatttcattccaggaaaatggttatgtgaggcacagtaactgtcatagagtgcataacttctgtgaggttactggaaaggcacagctagggtaagttctacctgttttgtcttaaatttgaaggtagactactgagcgatttttaaaatactgaaatctgaatccattgaaaagaaattgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaaactattttttttgagatacatgtttaagaagggaaaaaacccatttgttaaaattacttaatcactgagtttttatgtcatggtttagaaaatttattaatttttagtgctctttaaatcagattgttggtttaaaagatactgttattttgaccaaatataagtcaaagcggaaaggtagttgttaatactcgtgtcagaggccttaactaaaaagttagctatgttcaaggaaaagacttagtccaacattttactatttgacagagcatcatgctgtgttatctcttagtagtagttagtggcccacagtagctttggctaatgcaaaaatacctgtacttttgaaagtatttgaatttcacctcgagaaaatctttgtttcatctcgttgctctgtaggattcagataacagctacaacacagtaaggtattcaagaatacattccaaaagcacttttctatcattgtattctctgtaagaattagggttgattctcatcagagtctttattagtattattactgcttaaaatattttatagaattatggtgacagtttgtacaaatagggtgacatagaattataatgaacttgatagtcaaacataacctttacctactttaatactgtagttactccctcatacctcatgtgttttattttttactaattttcttatattgtgttactaataagaagtacctaagtcctctgacatttcagcttggaaacctgtcattggtttcttaaaattagaatagatttaaaacaatgattatttaggttaatattacatgattaaaacatccgataacgaagcataagtatcttagaattcacattttctggagttgcatttcttaaaaacatttgggattgatttttaataagtttaagagtatttctaaaaaaaaattagggagtaagaatgagctcttagaacaatactaaattgaatagcttgtagtgcaagcatcacttaagtatttttagaatattgaaaatcttgtagattacatacactaatggcctcattctccttattgcttgttaattctgtgaaaatcaagaggagcatatcaaggttgcagttaattcaccataatattagcttttaattgaaaataaacgaaaatatagctttgatttgttagcttattttattcaagtcagtttttcctatttataaagaataaatcaccataaactcttatgtatgtataaaattgatgttatcagatgtttatacaattgatgatattactagacatttttgcactattcttaagaatactttttattttgtatattgctttaatacttttaatatttcctcttatagaatgttttcttcagatgttttaatagtttgatattactcatttctgaatggatggttgagggcctttttcttttttaaaaaacatttttcactacttgccatgcaaactatttgatctcctaaagagaaccaggatataaatttagtaattagtatcaatgtataggtttttttatttaatgtggaattattatatggtgatgttctttggagtgttttcatgtgacttaatgtgtatttaagccctccatagttaaaaagatgtttacagtactttcatgtttggcattattcaactctttccaaagattcttttaatattttgtctgattatcatttattttaacctacaaatgctctttttatgcttgcctacttttattcaacctacaaaataaaactttattacatgtactttaccaagtccttaataagcttcagtattcagtattgccaagcacttattaaagcttcaacattttcttcctttattttgttaatggtatctcatgaatgttgaattcttagttttttggggctttttttttttcaagtatatttagggggtacaagcacagcctttttacatgcatgtactttatagtagtgtacccatcatccacataataaatgaacgttataccctctaagtaattttcacccctcacacttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataatacacatttttttaaaaaattgaagatcgttctcaattcttagtataaaaatcagaaatttgtctgggtctttaaaaatatagtacaaatatctaataatgtatttggttgtttagctgaaaggcagatgtttcagtctttggaattcaagactatattaatctaatactccttaaaccaacattttatttatagggtgtaataaaaatcataaagttaaatttgaatgagtaaaatcttgattttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagtccttggtgagaggcaatggcagtagacagatatgagaagttttgtaatggtgggttagaatttggcatttgattgaatgcgaggtaaaggaggagcaaagaatcaaagcccagaaccaaggttccagccaagtcttttatgtattccattagcctgctttagtggaagggagaaggaatgagcccattttctgatgatactttgagatgcatgtgttaaaagtccaaagtaccagctgctgagaaggttgatgctttgttggtatgtatatttttaaatgtggtatttgtaaaaaaaatatattttttcttccttttaaatgtttttaaatgttttcgagtgtatacctgcatatgtttttacactgcatatgtttaagtgatactaattttttttaaatactcacataaagtgaaaatttttattatgcgatattcaggctacatgatctaggtttttatttgtattttagatgagatttctagtaggtaatcaagactgtataaaagctatcgtaatctggttagaaatctttattttgctaaagaatacttttgtcattattagacctgttgagatactcttcattgttcagggccattttagtaacattcttaacagctctttaaacaagtaatttgatattctttggtttccttagataccagcctgccccttttcagaaagcttagggatatctgtgccctcgaagatttaaaaaatttcattgcaatttatcttcactgcagctttctcttttgttaccatgaacttctaatattatatatttattttattggtacgtggggaaatttccctgcttcacctgttctttaaaagagtaacaatcatttcctcaatagcttttcagctcttcatacccagcaatagttcttaggttttatagctgatactttgtatcatgttaattatgggtgacaaccctgaacaacaacccaaagcatctatcagcacctatccatcagtgattaactcagagtaggctctcaatgtattttttgaataaatgcttatcatcgattataatgaagatcacaaattgtgctggaacctaaccagttatagattccttgcatggatataagaatgataagagttacaattaaagtgttataacactgagttgtgtgtcctaatccgaaagtattcttgcttccatatagtagagaaaattttttgtgatgcagttacagtgcttaataaagcttcatacatggaaactctcagtaaatgcttattgttgtcattattggtgtaaattaaatctgaatattagttcacatatttaagtggcccttttggtatccgttttcactcttcagattttttttctctcattttttggggggaagactcttctttttttcaatgctgctcaagattttctattttttaaattagagaattttctattattgttgctaccttccttagatgataaatcagtagcaagctgactggtttttatcaaaattgatgttctgatattgagaacaggaagtgttgatgttgacctgtctgtctgaaaaaaaaaaacaaaaaaccccacaatattctgcttacactttcactgggcaattatgtaaaaaagatcagtagtttttccttgttttacttttataatctgatgcctggtgaaataaccacacagaaaacatgcaagtaggaatcttttgtagttctccatggcctataatccctgcccccaaatcatgccaagcattaggatccgcccatgtattaacagctttaagaggaagtcagtagaggatccttgtcagaattgtcctggtgtgtgatggcttgctgcttttttatgaaaggatcagtcatgccgaagacatagctatgcataaggtaatcagcatgaaataaagggaagttaattaaatatggttgtcaatactgtagttgtgaattttatttaactagttaaggaaactaaaaatatgacatccttaaaaagacatttttaatgtttataagataaaatacgtaaagaaagttttgacaatcttaacaagtccattgtcaaactattaccaggctgtgtaaccatctagttacttagcaacctaagtgaagcaatagcatttaatattttgtataaattttcagcaaaggcggcccaaatttttagcattagagacattttctgatatgcagggagctcttcctccacagttcctttctttagtgggtcattacataccacaggtggattatgtttatcttttaatggtgaaatgatagtttttctttggtggaggagctggttatctgtcttccaaaatgtcttctggtgacttgtattaagatcttattaaaatatcattgtgttcttgcattcacagcagaagactactgtaaattgcattatatgaaactgaataatatctatggtttaatttaaagtagaaataaaatctaaattcatacattcgagctgtagggtttcaagattttaatttggtgaaatgccggaacaatttcttatatttaatttgaggagtattacatgagaagtgcatcttatcaaattaggaaagaaacatatactatttacacagtctaattattaaagcatgttaaatttcacagttaatattcagatatctttctgtaaatgagttgctgagatttattgtcaatgttgtttgatttgtaaagtccattaagttgcaaatgctgatttgaggaatggtggcaagttaggatttcaaagtagccatgtttttttcagtaggctctgtaaatcattaatactaaaaagaaataacctgcaatgctgtgtgcattataggtaatatcagaaactttttttttttttttgcaaagcatagctgaagtttaattcccagtgtggaatgtattagtttttcgtatagaggtgagatagcccacaattggctgttgaactggagtgccgttgtctgtcttataattttggaggagaaaaaaaaatatgattttaatttttacattctttgttttgaaagatgataaaagtgttttctacacatgtttcccgctatcagaaaaaaatcactgttaagaggatattgctgatggaaacaatgttttctcaagttcagaatattgctagggaaatatgtagatgtggaaggctaccttgttaagaagttgtgcaagaaaaaaatctttaatttttatattttgatttataatttaatttttatattttaatattaaaattctaatatttttagtgtactttgaaaatgtccaatttgtacatttatataatccctgggttttatttttatttttaaaattttatttatttttacttctttttaatatgaggtcttgctcggtcatctaggctatagtgcagtggtacagtcatagctcactgcagcctcagacttctaggctctagctatcctcccgcctctgcctcttgagtatctagggctataggcctgcgccaccacactttgtaacacagtttttatttaatagcaaaattagcaagtatatttaatatagtttcatataatttcacattttgagataagtttgaaattattataaattgtttttgtagatactattaaattcctaaacttcatggaggaattattctactggatttgggcctgagttgcagattttgtttctgcagtaattatgggcctttctatttcttcatttttataatgaggagactctggttttaaaaactctttcttgaggggtttaatgatgaaaatgataaggtattgtatgtcaaacaatgataaattaaaacttccagaagaagtagtcatttttgttttctgccttatagattgacactctttaatatttaagtgtttaattaaaaaatagtctggcatagaaaaaaatcttgaaaatctctatttaggaggtctccgagttagttcccagttttttttttttaatttaactttcttacaccaacaagcaaagatgaaagtttccagttttaaaaaattctgtttcacacgagtttctgaattccatccactttgctttattctttccactattcatgttagtttccgtaattcagttcatttattcatgcctgcctcccttcctctctccttcccgttttttctctccttccttccttccttcttccctccctccttccctccttccttccctcccccctccctctttccttccctccccctcttcctgtctccctccttccccctacctctgtccctctctccctcctatgtttcttattgtcaaaaacatttattatgtgctagctctttgtcaggcactatgcatgggttatactcactggtaaggtagcactgaagtgatagacatgaaagccatctttcatcataactgtgttcagttagctcaccatcttttgaaaatgttacattgtgatagggatgagcactctgtactatggacaaaaatgacactgtacccctgatgtgtggtggaggtttagggaaccagtcagttagacagtcaagtgatggacccaactgagtcttggaaaaggaacagtagttagccaagggacaagtggcagaggagattccaggcagaaggaacagtataactataccaagaaaggtatagaagtgagagtaagcttctatgacccaagaacataagagcaaattaaataatatttaaaaaagaaaaccacgaagttaaaaaaggatggtcttcctcaagtgtagatatatttgctaaaaaataaatatttcaaaaatttaaatattttccagaaagtttgttaatatatttgatgtgtttttttaattaccaggatattatactagtcatcagaatcacaaagtgataagcgaaagtcatggtccataaggagcacttactctcttaattacattacataaattcgtgacattacttgtgcatttgtgtcatttctgtatcttctgaatcattgtattacttgcagtttaagcctcagtgccttgaacaaagtatgtacccaaaaaattttttaggcttggtttgaaaagatttatcttgaagaaagataaacatagaaaatttcaataaaagacattttatttattcatttatttatagacaaggtctttctctttgttgtccaggctggagtacagtggcctgatcatagctcactgtagcgtggaactcctgggctcaagcgatccttccatctcagcctcccaagaagctggaactacaggcacatgccaccatgcccagctattttttttaattttttgtagagatggagtctcttaatttgcctagactgaacttgaactcctgggctcaagccatcctcctgccttggctccccaaattgctgggatttacaggcatgagccactgcacctggctgcaaaagacattttaaaactagtttaaaagcttaattgaagaggactcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctctctctctctctctgtctttcagattttcaattaccattcccctttcattccagccccagttgcaactttcttgttgttaaaatacatacaatagggctgggcgcagtggctcaagcctgtaacaccagcagtttgggaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatgagtcaccgcacctggccagaccctgtctccaaaaaaaaaaaaaaaaaaaagacatactagatttgttgtgctaagttagagtgaaataataatacatgtacttttggagacattttagaaacatttctgagatcaacctttgtcaagtcagaaccccaactgtgttcttccatgtaaaattatttttagagtttgttccagttttatacacatttatggtttagggtgaaattaggaagattactagaggctggcaagatggatggaaggtgataaatcagctttgagatttttgcagatgttcagaaagaaagatgttaggacagagggattgaaagcaatgggaagaggattaaggtatttcagggtaagaatcaatagaacagtgaatgtgtacctctttaaaatgaagtaccttttgtattgacagagctatattttacccaaacttaagatgaataatgctccagaggatttttggtttcaaaactattggagactaggctaatttcatttgtttgtgtgtgtatccatgcatacatgcacatatatatttagtaagcttggtttaaagaaaatctgttacttcatagtagatgtgattttcttttaccatttcacactaatgcatttctttgttattataagttagcaattgaaggttatatgtataattcatgctaaattagtatattggtctagaaggtttttcaggagactaataatggagtagaggcttctttaatacatatgactatataaaacattattaatattaacagatgttgcactttaatcccctagaatgactggtaccagcaggagatttattaagcctgaattgtgtgaaattgtgtgtgcataagctgcaacttagactgtaaaaatgctactgaaaactgttaaaaagatttagctataatttggcagagaagtattaactgtgctaaaagaagtatgtgtgtatggttggcccttcgccttaacctttttatcatttatcttcttgtattaatgtcactgaattattaattcatgagccaggatgggaagggtgaaggcaccatttaaatgtgtggcaaatttatccttatcgccagagacatgaaaaaagtcattttgtgttatctgtaaaatggaaaggacattttaaaatttcatttacagtaatccacttcacttccagtcaaacacctagattattactaccataatataatgttattaaaaatttgtaaccttctccactcttttgtcttatatatataatgttgatagaaaaatttagccttgatttatttcagtgtgatacttgttaattgtaggttaaaaatgttacttttacgaatgatatgttatagtttgacttaaattttaaggaacagtagacttatgaaaaataaaaaatatttactgtaataataacaatcaggatattttcattgaggggagtccgcatatagggaattggaaagctctaaatatatgtttcaaagaaatgtttgcatttattgtgacttcataattatttggaataagattggtgatgttggccttgtggaacttttagcattatacaagaaacttagcaaattagaatttagcatttacttgttgaatgtaatgtggatctgggatatatccagtatttcatatggataagtagctatggtgacaggaatttcaagagtttgaagccacttttaccagcagctcttcgaaaccatcatgctaatggaagaatacctcaggggtcttgtccaaacctcatcacttttcattctcccgttatttactattttgattggttttatatactctcatgccaaacaaagtagtaagataagttactgtggtaatgtcctttgttttcttttctagaatttctccccgaacactctaaggtatacatatggctctgttatacacacactgaaaacacgaattgttttttttgagatagaatctctcttcgtcacctgggctggattgcagtggtgcgatcttggcgcactacaccctcagcctccccacttcaagcatttctcttgcctcagcctccagggtagctgggattacaggtggtgccaccacgcctggctaatttttgcatttttagtagagatgggatttcaccaagttgtccaggctggtctcgaactcctgacctcagccaatccaccggcctcggactcccaaagtgctaggattacaggtgtgagccactgcacctggcctgaaactctaatttgttttgatcagtaaataatgctactttgtttttcttattctagtatggttaatttacctttacattaacatttaaattaatttcttaaaataatagactaaagttgatttgattattttggcagacatgaatagttattagttcattatgtgactgaactgcatccagttatcttggtcttaggattgttcatctataaacaggggttgggcaaactatggctagccatcagttttgtaagtaaagttgtattggcacacagccaatgtcatttcggtatgcattgcctgtggcacctttcacactacagtggcagacatacatagttatggcacagaccatatcactcttaaagcctaaaatattttctgtctggtcctccatagaaagagttacctaacttctgatctgactgtctcaatctgcataaaatgttggttctaatccttacaaatgtagtggaatataattgataattttaagctcaagagattggaaaattcagtagtttttatcatcattggaaatgtttttttttaagcagatttttgcttttctttatatgtggagtagcaataataagtgatatttttcctgaaagttttctgaattgaaacattttaaaaaccattaaaatgttgcaaaaatacattagtctgttaccacatgaaggactcttggcaagtaattcaagcttctagtcatttttctctgctttttataacctatgtttcttttttattaaatgtcactgctttattactactttaatgttatttgaaattttaataggttataaaattatattttaaagttgaaaaagctcttttctaaaaaccacatacctctcctactccatgtttgagtagttaagaagcactaaaacataaattttaatttaatggaagaccttttggtttttaattttttcatacctaacagccactcaaaatgacacagtctgttactgtttcttaataggtgtgtccatgaatatttttcttaccgtctcatctaaatctcctcatatttttttttttcattttttttgggacgaagtcttgctcttgttgcctgggctagagtgcagtggcgctatcttggctcactgcaacctcctcctcctgggtttaagcaattctcctgcctcagcctcccgagtagctgggattacaggcgcctgccaccatgcctggctaatttttgtgtttttagtagagacggggtttcaccgcattggccaagctggtctcgaactcctgacctcaggcaatccacctgccttggcctcccaaagtgctgagattacaggtgtgatacatctcctaatattcttagaggaatcagctacaccaaacacagagtttcaggctgacatgggaagccaaagaatctattctgttcattcacttagactctagctttatctttagtactattaattaagttaattatttagaaataattggtatattccttttctgtacaactcaagaaaatccttttgttttgagttttacttgtagacacagatataaatggtatggaacatttggcataatcgggactaaccccagctaaggcatagaaacttgttctttcttaaagaagtccctgatgttgttttgaattttcgttatctgtagttttcccaggaaggcagagtgtgaaatatgtgagctaaatgcttcaggttattataatattcctgtcaatataataatctataagtagatttcaaaaacaaagattttctgaaacagttgcttctttttaagatatgaattagaataattgccgagacatattttgatagaagagacaagtccttagttaaacatattgcagaagcccccagatggcttccttaacattacttaaggtagaatcaggaccataaatttatcattgggaaaattggaaaatgattgaatcatagatttataatctcttcctacccttatatagttgctgaacttgagacctagatgcttgctactgcagtccttgtaggggcaggttgagccacgattctatagtgtgcacttgatctggatcttgacctcttcattaagatgactgattgatctaggtacacgtctcaaggaaacacagatccagaaactgctgttagttacttctcttagcttctcatcacatttactaccattaagttttgggaggtttagtaattattatttaatgcttattttggatcttggtcattttcttgcatatttaattctcataagattattaatttcttgaaggtggcagctatatcttaatctgttttataatgcctttagaacctaacacaggaccagttaatacagaaggtaaaaaaaattaatgaataacactcgttttagcactggatatccattaaaaatgtgtaggaagtactcactggatattcattgacttgactggacatacatgaaagtatagtgctaatgtgatctactttatgttaaaggcaagaaatgtaagtttagataacactatattgacatagtttgcaaatgaattgtatcatttaattacaaaggcaatgtgctatagcacttcacaaaacttcagcttcttactgtgtattctttatagttaatttttcacatatatctatattttattttatttttttgagatggagtctcgctctgtctcctgggctggagtgcagtggcctcatctctgctcactgcaacctccaccttccgggttcaagcgattctcctgcctcagcctcctgagtagctgggattacaagtgcccgccaccacgcctggcaaatttttgtattttagtagagacggggtttcgccacattggccaggctggtctcgaactcctgacctcaggtgatccacccgcctctgcctcccaaagtgctgggattacaggcgtgagccaccgcgcctggccaatttttcatatttatttttaagatcatttgatgtattttactcagattacctcattacctctaagaaacctctgatggtgatattgatgatctaatatatgacagatcctgggtcattattatttcatttagtggttgtatatatagaccaagagggaatttgaatattgattcggggaatggccagtaacggtgatttatgaacaaaggatccagtgcagtgagccaaacataagattgcatcttatgagtgagccacgttgagttttttctgttatacttacccgaatgatgattagtccataatcttgtagatgttaatattaaaacctttgttccatgactattaaagatacattgctagttatattggaggaaatatttatgtatttattctttggacttactatgaacaacttctctagtagtttggttgataaaatttatcagtgtaattagttatataatttaggcactttagtaatataaatgagtaaattaggatagctcaactggaaatagtaaaaattaagttaatatttagctgttattacctaagggatgtttagctcatgtaaacattttaaaaatcaactcgctattcttttggtgtttcctcacttttgtatctcaagatgattttgttctgtattcatttttttattctaaaggaaaagatagtaaaataaggttatctggtctacataattagtaacagtagtgattttagaacatgggcttatttctcagcccttctgcttgcttactttccttgagtaggttaagttttctgcttttaagataaaatggatatatttcttaaggttgttgggaaaattgcatggaagagtaagcacactgttatctacctagtttagctgtaatttttttgggagcctaactgtgtgcaaggcagttacaggtttttactaggacgagttatttttaaagtacagtgtaatctccctgtggatgagaaattttgtttctttttttcctcagtacacaacatatgtaataggtgctcagtaaatatttgttgaaggaataatttggtgaatagtggaaagaatggctttgtagatagccttgattgggatctaagctctgctgcttattagctgagtaatttcagttgagttattttacctctcggagcctcagatttctgacctttataatactgatcttgcttttttggtaaggattagtgatatgtatcttacagtatttcagacaacacagaagttagctttttcccaatttgaggtaaataaaaagttatttttaaatggcagtcctctccaattttaagacattgtatttcctccgaactttcttttcttctttttgatatggagtctcactgtgtcacccaggctggagtgcagcggcacgatctcggctcactgcaacctccacctctcgggttcaagcaattctccttccttagcctcctgtgtagctgggattacaggcatgcaccaccatgtccagctaattttttgtgtatttttagtagagacggggtttcaccatgttggtcaggctggtctcgaactcctgacctcgtgatccacctgccttggcctcccaaagttctgggattacaggagtgagccaccttgcccggcctgaactttctaatagtctagagtcctcaggcagtttttttgaattgaattacaagtaccatgactagaaatatttcctgagtgtctactatgtctgcgaaacgaagaaattttagtaaagggtaagaccagtgatgaatattaaggggacttctgtataaatagtttaattaatgtcctctagacttgatagcagtgcctgcagaaagaaaatgaagaaagagggtggtgactagtggctggccacgtggttttaaaatctctgtgagcattgccagccccagccctatccatgtgaagaaaagaaaataaactcaaacctcaaagaatgctgaatgtctgaagcttctaagaaagcctttctgattagggatagcaagggtttgcttagctgacttactgaaggaaaactcccaggggtaatgatgtgttctctgatgttaagaaggggaaatctagtctgtaaagattacacataaaatatttctgaaaagtgaataacctgattgaggttcagctaaagtgaaataaaactataatttattttttcattttctgagcctttgcacagaaaatgaaaaggcagaattgggttagtgtcatccttttttgtgtttgtttgttttggtaaaatacagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatatttgattatttattcgttctattcttagctgattgtggtttgttaggtatttcaactttcattaacatttgtttaatggaaggttgtttaaaacttgggtcacagcagtaaaatcttttgatttagtttccaaattgcacttaaagcttgaggttttggaaataattttatttgatgtaaaagcgattgggcacaggttgtagaatgataaaaataaatttgacttttttttttacttattcattacacaggcagattgacttaagctttatttttgtaaaagaagccatgattttatacattctagaacctgtttccatttgtcagaaacaaccacttacatggtctcataattgaatgatatgtatttttaaaattgtgtttcacattctcaaaccttcagaatacactgaatttttagtatataaaaattttcataagatattctttcctggccaaagaccacaatagaggtcttgattgtgtggtttcctcctcctttttcccttcacgaacagaggttttcctatcttggcagctgtttcctacaaagcagtcatcagtccctgatttcttccttcctcctccttcccacaaacaagggctctttgaatagtggatgactgaagacagactgatcttggatcactttaagaaagtggaaacgtgtgcaagagttgagcatgtgggcaagctgcctgtaggcactagctcattcaaatcaaacaatgaaaacttggacagtaaaaattctttgcttggaatctagagtggtccaaaggctgacttaattttacttgcagcacttcatccacgcgtttacattattctgattgcttgatcagatcatcgaacagactgtaagaatataagaaattgttcattgatggccttttaaatgtgacaagccatgagattatctgactttttaaaatgctttatgtagaataactttcaggtttaaggcaggcacattgctacagcagttgtaaactgcaggttcacttttggttttggttacctttgaatagtctatgggagctcagagtgaaaaatgtacagagccagccagctagttttgcagggatgcgtgccatgtgtctccatcagattaattttggatacatcattctttttgaggaagtttgcattttcctttgtttctttggacagataagcatctgaggtgttcttaaatggcataatactgatgttggtgatgcctccctctcccctgtgtcttcagtgctttcagagagagagctaaaacttgggccaattctgggtcatagagggatccttagggaagcatttacatctctgaaactgtgggcctgaatgatttcagattaatttcttacattatttttgttgtgttcttaataaagcaagatagtacctttataggtaataagtgtttcaaaccatttaacatctgcctgcttttccaatcaggttacattataatgaactgatagtagaatgtagtgtactgctaatagcatcccgtgtgataagctacatgaagcatgtagtaaatgcacagtaggtcagataatgtgcaagaactcaaaagttatcaggaaaattttgttttctaaattttctttatggtttagtgacagcatcgaaatgatgtaatgagtttgttttactgagttatgtatgcaacctcagaaagggagggaagagttccctccctgctgcactttgtaaaactctttagttgcagcaggttaaggataactggagaaaacttggtgtaagagtattatgtagaataaaataataggaaacgaacatgaagaaactgtaagatgttcctttaacagaaaagtttgtgatttcctttccctcagaggctaaatgaggaggctggatatatttgggaaatgccttcattttatgtgcattataaggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataattctaaaactcctaagttaaaatatgtagtcttttatgaaaacttacattttaataatagttcatctttttatgttgtttatatctttagctgtatatgtgtgtgtatatgtatattctttgtaatgttaaatttgcagaaatataactatttctttgtacttaaaaatagatgtggaatttttcttaagcactattgcattaaacatttttaaaatctaggaatagtaatgagtgtatttttcaagacagacctgatttttaaagaaataaatatacttttgaagcctaatgaaataattggaaccatcatttattaactatatagatttctggaatccattgttttcttagtcttaaatattatttccacatgaaaacaacacacatgcaggtgttttttagagcaggctagaagttaatatggagctaagatgtataaattttatagctagttgatagtggcagttattggcacgaaaatgtattaatcttgtaaagtttgtgaagggtataaaatctctgagaaatgcatataaattataatggattttaaaaaattccaattcttgaaaaaatgtttaagaattaaaaaattgattttatatgtacttttaagtgatctcacttataccgattattaaaatgataggtggagaaggggcatactgtcaactaatagaagtgtattattccgttgtctgtgtaataagcttcaaaatgttaacgttttaattttgctgaaagaattttacttgaattgcttgttccaaagttatattttatcatgttctccttgtccctccagtcccctacgttcagtatattgatatgatgtaatataatttaaataaataacaaatttagaaatacttaaaataagagtttctgtattcagaaagtaaatagtgttcacttggatttaagtcacacttggcagttacaatctttgggttaatattttattttcagatgacattgctctttgctttagaattgaagatgcatcatatctaacatcatatgtaatctgtgtgaatgaataatactatcataaacagtgaacaggaattgtgtttaataatataaatttctggcttggattgttgtgaaaatcttgtgtgtagtctgatgattttacatctcgtttttggggaagaaaacctaactgaattcctgctgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatccaggtcactgcaaatgctgttaattcattcctttttatggctgagtagtattccatcatatatatatatgtatttttttcatcatatatatatattttccatcatatatatatatattttccatcatatatatatgttttccatcatatatatatgttttccatcatatatatatatattttccatcatatatatatattttccatcatatatatatatattttccatcatatatatatgatggaatatatatatataatatatatataaatacacacaacacacacatcacagttcctttatccactcgttgattgatgggcatttgggttggttccacgattttgcagttgtgctgctgtaaccatgcatgaaggcatgattcttactcttgagaagctcatggtcttgtgcagggattgaaaccttaaatacttgttggtgccttgagaacattcgacttgaggtcagacaagaaagtgcttgtcagaggacctgtgattaccattccagtatttagcttggtttttccagtcttctgactttcagtagaaatcaaacattaggatttttaagtaatggcaactaattaagattttgtttaaaaaacaagcgtgtataccatagaatagccatgggttatgcctttccttttagatctttttttttcctcctgttacagttgtattttaccttggtacatgattttaaaggcttcacataattttggatttgctttacatcggtacataatgagacatacatttccaaattcataaggacttactctgtgttcaggcaaacattataaatgtcatattttgtgtacacatacaggggcaaatcactaagcatttttaaagtttgaacatggcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcattcctccttttttctttcattctttgatttacacacgcatataacaaaatctgtacatatatacacatatttgtgtatatatgtgcacgcgcatacacgtgcacacacacacaacatgcagtatgctagtttcataagggcagggatgttttgttgttgttcactgatgtcttcaagtgcctgaacaatgcctggcttatactaagcactcaatccatagctgtcacataaatagaataaatctttgaagaggttcatagtctgtataatgagggaaaagacaatgagcagttgtaataagagtgtgataagtgccataataatgatattcacagaggcattgggatgagcgatagttggatggttgcatgtgtgttaggaaattcttgtagttggaagtgatgatacggcagaatcacctggaagatctgcggtggggcccaagcattagttaacattgctgacaaattgcagggtgatgctgatggtgttgctcagcatcacactataagagccactgcgtattctatgtgcttaggggtggttgtggtgagggtaggggtgcatgggtgtagacatggtacaactttttcaaaagtatttttggaaaaaatgatgagatgattgatcatgattcagaagttagtatccagttgtttcttgggagttagtatctgtttctttgcagattgttctttattcccctgattaggcttcttgggaataattttagtcttcagaaaaggattttttttttcttttagcgcttttttttttttttttttttttaagatggagtctcactctgtctcccaggccggaatacaatgggatgatctccgctcactgaaacctccacctcccgggttcaagggattctcctgcctcagcctcccaagtagctgggattacaggcacctgccaccatgcctgtctaacttttttatttttagtagagacggggtttcaccatattggccaggctggtctctgactcttgaccttgtgatccacccaccttggcctcccaaaggactgggattatatgcatgagacaccacacccagccttttttgctcttttcaagagtatactcagaaaaaaattttgaaaaatttacaccaaattggaaaaaaacgtatttttcctcttagggataaatgctctgtttagtagagctcttaaaactcttgtttcaatttgtctctttcactctaataccctggttcttttcttgttgagaataactacatggccaatgctgtgataacactgaattgacttactgtggggatttcagatttcccaatctaacaaaattaactacttttgttcatttcagtatatttgattagttgaagtctaggaggtaaatttttagcaaggtacttggggatttggctgtaaacctaatgggagtcacaactcccattaaattaataggaattgtgtatttgtgcctgctgcatagcaaatgtaactttattttctaaattcacaaattatgtaaattaacacccagctaaagcaatgaattttttaaaaattactattattattttttgagatggtgtcttgctgtgttgctcaggctggagtgcagtggtgtggtctcagctcactgcaacctcggcctcctgggttcaaacaattctcctgcctcagcctcccaagtaactgggactacaggcacccaccaccacgcctggctaatttttgtatttttagtagacacggggtttcaccatattggtcaggctggtctcaaactcctgaccttgtgatctacttgccttggcctcccaaagtgctgggattacaggcatgaaccactgtgcccggccaaaaaaatgattttatttaagaaaatacttaactgtattgctcttaggacactttagatattctttattttgtttcatgagaatattgtaatttgattgcagcagctttcttctccataggtagcgataattcggttttaaaaatataaatcttaatgcctttacaaattgtatgatgttgttatcttctcttgcaaaaatcaaattattataatattactatcagcattcaagatgaaggtaaatatgttacaaatgtgactcaaagttgccgaaaataaaattaagcttaatcggatacactggcatcttttcaaaagtaaatttgaattatactttggtcatcttatataccaatatttagtgtcagaatatgccatgtttcataaatgaagataaagttcaagtgcttgattgtcgatttttttttcttcccacttttcctcatgctttcttcttgattccatcctcttttgcctctttttcatttgtggaaaaactttgtttatccacagtcttcgttgattcaccagtaggtctgttgttggcggaaaaagtattgcaaacgtgtatgtcattcacaacagtcacccagcagacctcaaaaacattatattgcgtggctgtttaatttcggtaaacctccattttctgacagaaaagaccatatcaaatatttagtaaataaatttgtttttaaataataatttgctaaaagtaaaaaggttattagctcatgcatactagagtaaattttagaaataccgattttacatgcatattaggcatttacacagttatttttatagtttgaaagaaccaatagtgtattacagggagtttaattaaaagcacaggaggcatttaaagcaccttaattttgtggaactgtgattctgttaatttctcattactcattaatttcagcattgaagctcttcattttttgaattaatacactttaattttttaatatacgatagcttgtgatattagagaataagataagtgattgaacacatctgaagaccacatcagaagactattgtagaacatgctgtgtctcaaaaaactgatttatctgccatattactaagggagtgtcttactaaaacttgataccccatggtactctattttcttttcccctcctctgcaagacaaagaatgacatatgacagccatgcaagctacacatattagacatcaatttggattagtgagtatctcatggcatctttcaaccctattcctgaactccttttgtcaacttgacagaagtgattccaggagaatacctagtcccagcctcgggatctcctggctaaaatgtaaagctgagaagggaatacgtatcagcacttcaggaagcagaaacaacatttataatctcttcttatcagcatgggactctcctgagtttgacttttatgtctgccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttcttcttctttcctttttgttatatagctattttcttttgtgagaccttccattattttatgcttaaaaatgtatatcttgatctcagttaaatatttattcattacatttccctgtagctcttaaatatttttatttaaattttgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttctccagttggaaggaagggaaatggaacccattgcactggtaggaaggctcattcagggaagtaaagaatgtgtattaggatccagagagaggaaagattcaggaagagatgtgtacagccgcagaagaaagatgatggaggtcatgctgggctttaaacatcttatttatctagaatagtgcccctcaaaagttaatgtgcatataaatcactcagggatcttgttaaaatgtagattcttgcttcagtaatctgggatggaccttctgagtctgcatttctaataagctcccaggtgatgctaaggttgctggtctgtaagataatgtctgtattagggagttttggttattaaaatgtttggtctagaaaatgagagtttacatgacagtgacttccgctgttaaaaatcgaggtttgttttaaacccaaacaaccatagttgaaatatagaaataacatcactttcagttgtataactcattttattaaaaaaggaactaagctaccttgaaactttactgaacatttttatattttgtggcacttctaatcctattttatatgccttctattgaccttttatgtggtgagttgctttgaaaaatccctgagtaacaatgcagcctgaccctttctccctaatatttccctctattccctattgatctgtcatactttcattctatcatacacagaaacagtgtttttaacagcattttaatacaaatgttttattatttaaagtaacactataaagtcatgtaatgcaaagtgtatgtttgtcttatttagaaaaagtttatttttattatactaatttttcaaagtcaacatatttaatcaactaataattgttgtttttgcctaagtattaattccttggcttatcagcaccataagagtataggatggaagtacttgattgttaactggtcattaaaaatggctaaatatgttttatctgccttaggttatctagtgatttttccactttttagtattgtatagaatcaaagattttcttcttcttagtggacacaatctccttttcccttttctttcagaggcaaagatatagggtactgatatgatttgttttaattttacgataataccaattataaagtaaatttatttcttaatgaattttattagactcttcaggctcttaaaccactcaaaagtaagttagtagcaaattttaaaaatagagactcctatataggtacctgagaggtcgaagtatttttattttgatttttttggtggaattaaagaattttggactttgaatcacagcttggatattagtagtgtagaatttttcattttacagatgaagaaactaaggcctgcagattgttcctttgtcaagctctacttaactgccagtccagttttcttgctgtagaactttatatttagcttcagatcattagtatattttcctatctcagcaggctgttactcaagaatatttaaagtatactttatattgcttaacattgcattacttaatggtaattatcaaacgagctaattatgtcagttttcttaatgtttattaccattttagatgaaaaactatgttaagatttgttttttagtgaaaattatgtagagtacaggaggaccaatcatgctaacacttcaactttcaaataatcttccaaagtttacagccataagcatatattttttaaaaagcacaatttatctttgaagttaccagctattgctgagaaccattaactgtcagaacaccgaaaacctgtaacaattataacaagaattgtaactcttactatgtttagttatcagtccacacagattatcagtcatcattaaaacagttaaaaggcatgctcctcctgagcccctccttcaggtatgtgttttggacattatcttttcccttttgtttgcttacaacaggaagctcgtttaatcctttgctttgttttagaggtaagcaaatagcaaccatccctgttagctttcaaaagctcttacttttgttgcattaatggcactcactgtagattgtgtgatcttgctttatttaccagaaagcttgcctttgagagctgtcactccattctttcaacaatgttgttaattgactgatagcactgattgagtggaaaaccttcagtgacaaaagactggatataggtgtgagtccatttgaaaggctggtgaatctttgcttcttaatcccatttctatttgcactgaaatactaaatacagcctagaagaacaaagcatatttaaaagcattcagaaatgttaagcaacaataaaaccccgtaaccatttaaatgacagcagctgactatttgaattaactttgtgtttggcttaatttggggccctaattattcctaacttacgtgagtagatttcaattatagtatcctgcagggatttgtagctaaggcaactaaaagaatcattttacataaagtacttttgttcaactgattagacaagttaaaacgtaatgatgtaaaattgaaacccttctggcaaggtccaaacaaatggttctagtaattttgtccaaaaaagattaatctaagtttgattttaaatactattttggtcttttaggacgattgactttcctgtaatactgataagtatataaaaatgccttaagattgcatgttttggtaaaggagtaagactttaaaggtgaggacaaatttgtcacagtggatggacaccttcctaagtaatgtttatttgctttataatcttcgatacacagtttgacagctttaaatgcatagatttagaagataaatacatacaaataacgtgaatgactagtacctatttaattctgtattttggaatacatttcagttgaacacagatcagaggctcatttatggatttgaaatgctatataccaagaagggacacaacatggttgacattgtgctatagtcagtggacagactgtttgactcgtcctgccgaaatactcctccccactacaaacagccacattaattttaaacacctttaccagaatgaaagctactttaaacttaattactggtgctggagcacaatattaaaaaaagcattagccagcatccatagatcattttgaggcttaaccatagcatttcactggagtcttacagctgtctaatatcagtctattgtagtgagtgaagttaagaggcagcaactctgttctatgtcttgtcttagcactgctttaagttctcttcgttgtcttctttctccccctcctcctcttttaccccttctttcagtttttgaatatctacaacatgtgagtcattgtcttttcacacttgatattttcattatttcctttaagctagtcaattctatgacctgtttttcactaagtgaaacaaaatctaaaaggcatggtgtgaagttcacagacctcacctttttgacttcaaagtgaggttttcctcccatagcacaaatgaagctatataactgcttcttgaaaacaatgtcaataaattcattctttgacctattcagttcctttttgttctttagtatactttttgaaagctagtaacctttaggaggctttttctaatctaaacaggaatcctctgaatttatatagcaacacagtacaatacagtaagccacaagtagttattgaacactggaaatgtgactaatgtgactgagaaaatacatttttattggtcagagcaattttataggtacttctttcctgtaaggctttgttgttgttgctgttgttacctctttacacctcctttatatgtttcagctaattcattgaagttaagcacaatgttttatttatttctgtatttttcatagtgcttaggcattcaaaactattttaaatgattgagaagcacattcaaagagacttagtaccaaagctacattttaaatatatacttaatttatagggcagggatttcactaatgatcacccaaaaaccaatatggttagtttatgaatatcgaaaacaaaggagtgtccatgcatgcatagtgtatatcttgcaggaattcagcccttaggattaacagctaagtatactttaagcatattttaataattatagcaagccctagttatttactgcagcctcaattcttattaggagattttgatagttgtttaaattatttggatggtaataacctacactgaagtcagctaacgttggcttctcttccctaaatatggaacttccttcttaaaatccattgatgaacccagctaatattgccatttgctttttatggtttgagaatatgttttagagtataagtaattatgaaggtatcagttaaaaatgatgagtaatgaatatctctagtcatttcgaaaattcttgtgatcttgtcttgtgaattctttagtaactagaaaatcctctgtgattttagcttaaatataaggaggacattttatcttcataatgggtaatgatgtattttattataatgatattttatatagatttatacatcacacctgaaaatatattacttttttggttcttaatgacttttggctctttttcttaattactttactgttaatattaaaatgtttatagcttgtaatttataaaaattcgtagcttttttggggaaattgtcataaaatgccacttaaatttgtgtgtgtgtgtgtgtgtgtgtgtgtgtatgtgtatgtattctggctgtcagaatttcttattttccacgtacgtttgcaaatgaatttctgatttaccattctgtctctgggtctaatttagaaaaagaagtagtaaattctatgtttagtagaaattgaggtaaatgcagagtacaactataggattttttttatatattaattttgaagaggaaagcatctgacttagaatggcgaattaaaaaattattatattctgtacaatgatgaactattctagcttcaagtacttggtaactaaaatgtttgctcagtaaacgtaagaatttttcattgacatattcagcatggatttgaggtttcagaagtgctagtttctaatcctaacatctaatggttcattaccacctcgttttaaaacaatagtgatatctctcaaatgaaagcattattttgtcagactttattcctgcatggtttacatttgttttagaaagtcagtccactttaaaaatgaaagtttggtaccagtgaaagtagctgaaaagaatgtattgctgtttgataagtcaaatagaagaggagtgttagaacagatgaaaaaccttccaggtaaccgcctggtaagagaaagatggaaagatatagcttcttttcggaagagatacttatgaatctaatctgagatgtatgtgggaaaaaaatttttaaaaagctgtattctgtaagcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacggcaaaaaagtggaggttggtgtttttaagaaaactggaacattttattaggttttatctttgaatctctttaaaaactttatgatttgcaacctatgtgaataagcagtgaaattttcaaagactgtaaaaaatgaaagcaaataaagtattaataaagaaatattaaagatgatttttttgtttcttcgagctttgtggtcttactggaaagatttactataacatgatataaggttaaggtttttatttttctgtcatttttttctaagaaattgtttcataatatactatgatgtttgagaacaaaattgagaattttatgctttataaatttgtatcacaagatgttactaaatactgctcaaattaaagcagtatttgagcagtatgctcaaattgaagcatttataactgttacctttcttgaaatttaataagttggatcacagaattatcctttaattctgttaatcatgttttctttttttgtcataaatatatttttaaaagagtttatggcctgccttttgcctattctatgggcagtgaattttcttaataaattttccaatgtaggttgcattttctgtttctgttttctaatcatctttgcattatggcaagataaatgccaagtgctcaaaatgaagattttatgaaaatgttttatagttttccttggactctgaaagttgtcatggcatttctacagccattcacattacagggatactgccgaaccactggatttatcctgtcagctttgatttaggattaggcagtgtagtcatttgtattgacttggtctctgttttctttcactgacataccctgtagtgaaattacatttgtacgagtatttcatgggaaagacagaaagtataatatactcaaaggcagcaacttttggtgtaacgtccagtggttcaaattctgactctcatcagctatgtgaacctgtacaagttatttaacttgggttttcttgcttattataaaattgggaaaatgcctctattttagaactgttgatgcttagaaatgaaatgtttaaacatttattaatcagtgattgttgaacatttgccatgtgctcagactatgcagtgtgctaggtatgggtattatcttaaaggaacttaacaataatggtggtaccttatgacacctaaaggggaatccagagagagctgcataggtggcatactcagctgaaactcaaacagcagagatatctgaatgagcaagaggtgaccagctgagaaaagttcttctgagctccaggagagtgtgcaaaaatattgccactaagaaatggggtgaattgcaaataggtcaatgtgtgccgaaggtgaggggtgacaaaagatagctctggatgaagttggagccagatgactcatgtggaagagttagaatttgatcatgtaggtgagagataatcattgaaaaatttcaaaggtgattatatatttttattctggaagtatttctttaggctggatggggttgactattgaaagcgttgagaatattgaacaagttcctgtgggaccagggaattaacataaacaagtgaagtagacaggatataaagaaatgatacaaaactggaaagtgcatgcttgtctaaagtaggcagaagccaggcacagtggctcgtgcctgtaatcccagcactttgggagactgaggtgggaggatcacttgaggccaggagttaaagatcagcctgggtaacatagataagaccttgtgtctacagaaaatttaaaaaattagccaggcatagtgacatgcacccatggtcccagctacttaggaggctaaggtgggaggatcacttgagcctagtagttcaaggttgcagtgagccatgatagtgccattgcacttcagcctgggccacagagcgaggccctgtctcaaaaaaaccaaaaaaacaaaactaaacaaaatcaagtcggcaggtgctattcagcttcaggtgattattttatcagtattttgatactttttcttcctcttctttttctttttcttttttttactttttaatattttttccttgcaagcaggaagttatgatacattttcaatgcgaatatgttgtcaattgagctgatatttttccccaagaaaagtcggacattggatttgaatgttacatccccatattttgaaatgttggcagctaattcaaacagacactgagggggcaaatgaaatatacctgtgagctgaattcatcctgtggtctgcccatttgtgccctttttcttaaaaaataagattgttggagtaatccaagcaagaaagaatgagagactagaaaaaatattgaatgagagtagataaaaggaatgaattgatgaaatttccgaagtcatattcacagtagaagtgaggcaatttggcagatcgctgatgagggaaagggtgatttatatagtttgttcgtggtaagggacagaagctgatgtttgggaataaagtaaactggactttcttgcaggcatccaggggaggtcatattgcccagctggtccttgtggagtttggaaggtggtgtggaaactggtcatatatagcacagatgcataatctgaagcagcaggtgcttctgggactctggttacttgcttagttgtttggctcatggattccctttgtatctacctgcttctgcctaatagcaactagctgttctttccctcaactctttttattttttcccccttgcagttttgttttaggatatctggggtacttcacccagtcttgtgccaccctgtcagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagcttctgaatagaaaggattttgttcttgatctatagagatgcaattgaaagattatattgtgatttgaatataacacttcttattttaaatttctcggttcttgatacaagacaatattaaataaattattggatacatgaagacatttttaaaaatccattttttggcatttttggagagaatatcattgccttaatgatattattaatataatcatcttggaatttttatcttatttatacagcaattaatcttctttatccttactactatcaaccaaatctttcctttttgttaaattgatatttttagaatggcccttgaaaatgtatgggaatgtattttatctcaaacgtgaaattaagatttatggttagttgcgattagggaaataggaaaagttaaaaatgactacatttggaccagtggagataagactaggaatcatagaggataagagttaaatattatataatctctaacactctgaggtataagcagttagttctggccactaaaactcagtattattcttttggggataatagcagtgttggtttagattaaggcttcatacataaaatttgaaattctgtaaaaggtacatcaaaataaggaaagccagatccaataacacataggacacagaattaataactgagcctatagtactactattccttgatttgatttattcatgaagtcatttgttatttcattcagcaaatgctatgtttttgcagtttttactaaatgcaacttttttggtagttggtggtgcaaagaactgaaactaaggacaatgaatatcattttaccgttcctgtaaaattcctcttagggcaagaacaaaggtggtataaaaatgtttagaaccaagacttaagagaatgtatttctttcctatttttgctgtcttcctaaacatgacacatccttacctctttagatgttcagcttccaccgactgcacagggtcagtatttgacttggtgttatttcttaaagtatcagaattggggttgagtacttccgtcagggactgtgaaaatttagcacactctaaaaaatgatagcaagtataaaggtcctgaaaaaaaatcatttgcaaaatgtaaacataaaagacaccaaaatgtagacatatttaccattttttcccggatgtaatataaagtgcgccatttgtaacttagagtgcttatttcctattggctgtggtttattttcagtctactatggagtttttatgttatggcatgttaacatgccattttatagtcgtatggcagctattattatttatttttactacatattggacagtgttgactgagtaaatgtaattttgatatatacctctatgaaattaattgtttagaatttatttaagtaattatgtttgaacattcaaattatttgataactagagagattaagaagatgctactattaaagattgaaaataatggacagtttaagatggtaaaggaaaattttgtcactgagtttttaccttttaataatttgagcatcagattattttaaaacatttgccaattcagttctaacatgattttgtatacatgtatttatttgtatgaaaagaaatagtgttgtttaaatcgtgtcaattcagtgctattttctctcttattgtgtagtattctttgagtgttgaatatttgaatattgtagtttgttttgttcttctatattagaaattctcatgtaagtaaaatgaccatagaataaaaccttttttttttttttttttgagacagggtcttgctctgtggcccaggctggtgtgcagtggcatgatttctgcctactgcaacctccaccttctgggctcaagcagtcctcccacctcagcctcctgaatagctgggactacatgtgtgcaccaccacgctcggctaatttttgtatttttttgtagacacagggtcttgccatgtttcccaggctaggctcaaaatcctgagctcaagcaatccacccaccttggcctcccaaagtgctgggattacaggcatgtgtcaccgtgcttggccctgaaataaaatttttaatgttatttaattaataatcatttcatgtcatttagactttaattttttgtgaggctttttaaaataaaagtatttttaaggactttattaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttctaacttcaaaattttccttgcctttagttttctttttattctttattgttttcattttatcttatgaaactactttcagcatgtgataggtgattgttcttaagtatgcagttgtccaattgcataactttggcctattttgataatttttgttacatgtccttattaatttaggatatgtacatatttcactgactttttttttttttttttttgaggtggagttttgctcttgtcgcccaggctggagtgcaatggcacaatctcggctcactgcaacctccacctaccgggtgggttcaagcgattctcctgcctcagcctcccaagtagctgggaatacaggtgccagccaccacgcttggctaatttctgtatttttagtaaagacggggtttcaccacattggccaggctggtttcgaactcctgacctcagatgatccacccaccttggcttcccaaagtgctgggattacaggcatgagccactgcacccagcctcactgatattttaattggatgataaagtagcaaagtatttttatcatagctagttttgcaaaggttttaatgatttcataatattaagttaatttaagaaattcatctagcactttataagagatgtcagaatatcatggcaggttccatatgttccatatgtttgactaaaggtgttaccgtgcagtgttatactaagagaaatttatattttattgattatgtcggtatcaattataaactatcttttaacatttaatgctgttctttatcaataaacacatgggccatgcacagtggctcatgcctgttttcccagcccttcaggaggctgaggcaggtggatcacttgaggtcaagagtttgagaccagcctggccaacatggtgaaaccctgtttttactaaaaatacaaaaactagccagttgtggtggcgcttgcctgttatcccagactcgggaggctgaggcaggagaattgaacctgggaggtggtggctgcagtgaactgagattgcaccaccacactccagccagggcaacagagcaagactccatctcaaaagaagaaaaaaaaaaagaaacacatgaatttgcttggtttagtccttaaacatttttcattatgtgttattttgttgtagaaaaatttataattgttttttgttaattacatccgtcttttttgtcatcgtagaatgcggccgaagatactttataataaaagaaatattacgtttacgctggaattttgttttgcttgctgaagttaaaacaagcaaaatttgtaacttaaggtaatagaaaattaatatggtaaaatgtcagattataatgtggacacttaatatgttagttattaaggaatttaaaaaagagactaagatggatgagacagaaaaaacttcctaaatttcaaaaatagataattttaaagaatagattagacatattgtttttacgttatgggtaaatttcccagaaaaagaaattaaaaaaagcacaactgattcataatgagccaaccccttttagggcatagctcttgctacccttttaatttgtggcctataaattttagcccctatcaactctgacagttactaggtaagtactcttttcatttagccaatagctctgtattgatatctaatattaagataacaaatagatcttgattcaaagctagtcttacatagccttgttatatcttaataagagcaggtaccatgactttgtcactatatatgaatgaatgaatgaatgacagaaaaaatgaatttcccagcagatgactatgttaatagaacatgagtaagccatttttttgttgctggatttgtattttataaactttagggaaagaagaataatatttagtttttttgtagtacttttactcttttaccaagcaagtttacttaccactttcgcctctaccagtgtctcccatgcactgaaacacatctgatacagaggagataataactgttggaggagtgaataagtgaatgattcctaccccattcacactattgtaaacaagaaaagctttttcaaaaccaaaatgtgttttgaaaaaacaaattccccataaaaccaaatacataagcataatactggtttctaagtactaagtcaagaaaaacgaacaaacactgaaggctgagaatctgatttttggcatcatgtttatactttttcaagggaatattctgtatagactttttaaagacaagggtttttaaaaattttatgggggagtctaacagtacagtgaagttagatgatttgtttgtgattaatagccggtgctagctggtgtcagacatgaattagaaacctggttgtttggttcccatgctgctgatctttgcaggattggttgccttctcactttgggccctgtcatatatgaattgagggtgggcaacagacagctcaggttcttcttcattactgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaatacgtatatatttagtgaggacctatttctgatttagaaaaaaattgattgtaatttctacaacattgaaacagtgtctagaagaatcctttccccacccccaaatagctgttactgacatgtccagaatattgcacctaagaatgaattgacctatgacatattaaggataaattttttaaaaaattaagtgaatattgcattgtttctatttaatttgatagcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaaaaccttacggcttccagtataccactttgtaggtagcagattgtctgtgtattttgatgtctctgccctttttctctatttactatttaaacaaacaggctttactcttacagagacaaagttagcaaaagtaccccattgtttttcaggtttcttctacattcccaaagctgtaaccttattttgtttttctaaaatttaatgtagttctaactgttgacaaagctagttgtgacactggccaacattttctttattgagagttgatgaatgacagccatgtctgaaatctccagtcagactcctcctgatataaagataaatgtgaaatattagaactggaagtattttagcagctttcactacatcgaagctattttttgtcacttttatttggggatatggaatgttcacataaattctattttaaagatgtttaagttttttaaaaatatcctcttcacttaccaccatagatgaggagcctacctattctagaaagaaaaattgtctctaattcttaatttattatgttttctcatgtgagattagtagtttcattactagttttgagccgatggtacatttctcctgagagatacccagggagtgaagtggactttgttagtaacctttgctacttgccctgcagacaaggagaacttagggagacaattcatcaccctaaagggaagcagaggagagggctgacatcacaattgtctatgaaatcttgatcattttaagcagcattgaaaattttgttggaaatggttttattaaaaatgttctgcataattgtgacatttaaagagaaaacagtttgtatcttctaagttaagaaaggtaaaagtgacagcagttttgaagaagaaggaattgagcattttctgtgtgatgaaaactttttgtgccaacagtcataaaatagggatcttattttctccattaaatagattagaaaaagggagctaaaaatgttttggtaacttactgccaagatcacataactgttaagttagagctgagattaaaatcgaaccttcctttctcaagtccatggtttacactgttaagccttgatgctcgtagcagaataggaaagaaataacatttcatgctcttttcttctttctaaaacatgttacattttttcttgcctctggcactcattcctaggcttgtcatatcactgactttttcgcatcctttaggccttggttctaattaatgtcaaccccagagaggcttttcatagccattatatggaaagcacctcccaattacatcatcctatttattttctccttaacagtcttagtacctgtaaatactttatttttatgtctctcccactataaactctatgtataaaggacagggacctgtcattttcctttttgttcaaagttttgtttcatagaatagtacttggcatatattagtatagtaggcagctattggttcaatggatgaatacaactttttatatattctggcatccttttaagtaatagagacaagtactatttcctcaaagaatgtttaaaataaataattaaaaatttaccttcagttttaaatttgaattgttactgtggcaggcaaaagttattttaaagaaataagttatatataaatttctctgaaaattattgaaaattcttattgaaatggtgttttactgagatgacatttgtaattttgtatcttgcaaaatgcaagataatctttcattattcatataggattcatttctgcaagcatagcttaatgattcagttattaacttcattgtatatcttaccccaaagaaactaatctctgatatttgggatgtatggggtttttttggggtgtgtgcataaaatagatactctctggatcttgtccataacatgcataggaatcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagtcatcttacttgcttttgggtaataaattacttttatgattagtgtttgattactaaaatcttaatgttttgaaatgtctactttcctaaaactacagccaaaaaagcctgtatataaagtgctttgctatactgttgaacaaggtagcattgttattgaaccccatgggaaaaaaggagtgctgttttgggtgtctataaaaacgaaccaaacttcttccctggagtattctgactgctgttgctatgtgctcatgggcctatgccatgtggctcttttcagatttgtatcagcaagtcagaagttaggaggcagctctactgatccatgagagaaaaaacaatattgaagctgatgaatgagttttatatttctgtacttgaaaatatttagttaaattactgtgcaaaataatgtctgattatctgtaggttaattcttatctacaaacatcagatttttaaaaagaagattgtgaactacttttgtttacatggaattgctaatactaattacctaaatgaaataaatttataaaggaaaaccaaatacttcattgcaaagtcaagaataagtaatattcaaaaaaattttaattcataagatattctgtagttgagtgaataatcaggagttaacttatccatttgtgaagaacttagattttatttcgttttctgttctattttagattattatctctttatatcgtatggtaactctaccttacagtgttagttgttcttaaaaatttggagcttatagactctttggagaatctgacaaaagctgggcaaccctcccagataaatatgtaggccaatatgggcacaaataattatgccattgtaatccacttaataaaaaagctccactttgggcaaggctgtgtgtgtgtggtgtgtgtgtgtgtgtgtgtgtgtgtgtgtgtgtgataaaaattattttccttttacattgaagaggttttattgttaaaatccgtgccactgctatgtgctaggcattgcagtaggcagtgctaatactgttgaaacaaaactactcaaagttcttgcctccatggaacttacacttggttaagatgttgcggagacatgcattgactaaattacaaatagggtatgttctacaaaggtggttgctttgtgtggtggctactttcatttttgtcctcctgtttttccatttattccccatagcttagcaaagtgaactttgtgaaatataaattggatcacttttcctatcaaaaactctcagtggcctcagtaggcacacaactctaagcagtttggccctggatcctctctccagcttgccatggagctacccttcggtaagctctcctgggttcagccatactgatcttattttagttcctttaaacgtttcagtgtctttatacatctatagtttctttgcctaggatcgttgtctcctcctcttcttatgataacttcttttttagaacgacatgtaatttttcctatctcagagaagctacctgcccaattaaaacacccttctcccctacaacattcatacctacaaaactctgttaactttgcttcttctttagcacttattacaaacatgaacctgtttatctattttacatcttttttggggggaaaggtccctgttatttgcactagaatgttggctctatctgggcaggaatactgtttttgttttactcagccactcacaggtaggatactgtccgtatttagtaaccaaagatgcattggaatgtgtaatgtggatattcatactgcatataaagtatatgcaggggatttgaaaggatgttgtgagagcagtagaataaatgatcaatatgtggattatcttgctacagtagagatggtgtaaagaaaatagtttagagatgaaacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctccccccacccccaacaggccctgttgtgtgatgttccccatcctgtgtccaagtgttctcactgttcagttcccatctatgagtgagaacatgcggtgtttggttttctgtccttgtgacagtttgctgagaatgatggtttccagcttcgtccatgtccctacaaaggacatgaactcatccttttttatggctgcatagtattccatggtgtatatgtgccacattttcttaatccagtctatcattgatggacatttgggttggctccaagtctttgctgtagtgaatagtgctgcaataaacatatgtatgcatgtgtctttatagcagcatgatttataatcctttgggtgtatacccagtaatgggatagcggggtcaaatggtatttctagttctagatccttgaggaatcgccacactgtcttccacaatggttgaactagtttacagtcccaccagcagtgtaaaagtgatcctatttctccacatcctctccagcacctgttgtttcctgactttataatgatcgccattctaagtggtatgagatgatatctcattgtggttttgatttgcatttctctgatgaccgatgatgatgagcattttttcatgtgtctgttggctgcataaatgtcttcttttgagaagtgtctgttcatatcctttgcccactttttgatggggttgtttgattttttcttgtaaatttaagttctttgtagattctggatattagtcctttgtcagatgggtagattgcaaaaattttctcccattctgtaggttgcctgttcactctgatggtagtttcttttgcagtgcagaagctctttagtttaattagatcccatttgtcaattttggctttttttgctattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaaagggatccagtttcagctttctacatatggctagccagttttcccagcaccatttattaaatagggaatcttttctccatttcttgtttttgtcaggtttgtcaaagatcagatggttgtagatgtgtggtattatttctgagggctctgttctgttccattggtctatatctgttttggtaccagtaccatgctgttttggtaactgtagccttgtagtgtggtttgaagtcaggtagcgtgatgcctccagctttgttcttttggcttaggattgaagacactgtttttattgtctagtcaaatggtaaacataagtgactacattattgctggaagatgaaaaataaaactatactttacagttcacatatttcaacaggtgatacctcatttctcattgattttaggtattgtcactagacaaattagtctctctgataaccagagagagattaatcaagtgttggtgcttactggacttttgtgtttcagtttggctgttgtaatactcacatgtcagactaagtagaaggaggcatatgcccttggaaattattttaattattttagatcattttttctaaaaagtcattgccaagagaggacacttagctatacatatctacatggatatttttctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctatgaatattatcataatctttgaatagagaatgaggtcaattaaggtgtaatcacttgattcttagtcccaccctgcatatggaaatatctaattcttaccaacaaacacatccaaagtgccaaagttgctgaaaataatttgatttattttagttaagcattaataaagtattgaaatttactattgactcatattccttctgatggttgaaagatgaaaaatgtacaaaggtctctaattatatatgtaggtaaaaaagatggagtgtgataaatatttgtcagtaagtatttaactccagatttctatgtaatgtttagggagttttatcctaaaaatgtgtaaagagtttcttagatcttttcccactcataaactttcaaaatcacaaaatcatgatttgttttggttgggtagctactccaacattctttcttcacattcttccgtggcattgaaaacttgccatttcagtcttcatggctccctttggaaacaacttaattatgtgaaattgtcatgtagctttaagcccttctgaagatcataggtcaagctgaaaattaaaggggacccttgctttatagtgtcagttgtaccttttggaaccttggcagaatattgattaaacattttaccaataagtttcagattgatttacatattgtgtaaaatttatcaaaagtaacagtcaacatctgatggaattatgaagttgatgggattatgaaggtaactagaggtacctgcctcttttcctcttaatgaaattagtcataaattaaattgttactgaaacttaaaaccaagataaagctgaaagtgtatccttgagtttttctgaaatgtttctccacttgctttcttcctgatctgagttttctttctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacacttgccttttatttgtagcttgatatgtagtctgtccttttgttattgtttttggagggggcttagggtttatgtgtgacttaggtgctgctgtgaaatggagagcatcacctatatctggcatttgcatttttgtaatattgttttcaaaatgttccagagaggtacattttcttccaccccgtctctctaatgcacagttaacagtatgtccttcacttgaactttctcccttgtaaatcaattatgcatttgctatagtagttcagctttttaaagtgcataaggagaatactgtataaaaagtgcttgtaaaacaagtctttttctaagagtctagaccttgagaattatgtttttgtttttcaataaatggttaaggtattgtaaaaagttggacattttaccagagttaccatatttgagctaatttttagaatattttttaaagagttaagttatagtgctttccacgcaagactttatatgaaataaatacattaagaatgtagagtttttgatgccttgtcaaaagtggaattaaggttggttttattatatgctttgaatgtgtttctgaaatattttttgaagcggatacttgtaagttaaataccttttatcatttatttttatcataattttatatatactctgtcagggaataatatttaagaatcccaacatttgtttttatggtatatctttacattgtaatctgtagtattttaatttcctataaacctcttaataatactagacaatatgtgaccttttacactcattcatatgtgctataaaattactttttcctttgattctattaaatcctttcagaccactagagaaatccctgatttgtacttaacagaggttttcatgtattaacaagtagagttacctggctatcaataagtacttgtttaactagagtgactaagttaaagacttgtagaagttaggactttctgaagctaataatccaacaccctaatttgtgactcgagggatcagatgcacagtagttcaagacttgatgtttttgttcagggtaaggtagtaatttagtgacagaatccagataactcaaatcctcagactagagaaaaattattaagatttcttgacatttattgttattccctacctttagcttttacacagctaaatctacttgtggaagttcagcttcaaaaagttttagccatagtttcaaagctgttgactgtggttgaggtttattaacaaccttggttttctaatgtagtggaattcaaagtagatcaaattccttccctgagccaggattctctgagtgctcttcttaaccactcctgcccaaccgctcattctacaatattgagccttaactcctgttcctgtctcctggccatcctttttaatagttttgtattaaattgtccatgatcaacaacattttgttttaatagatattctcacttcaaggtggcataaaatagtatatatttctcaggattgactttcccaattaagagtatttgccttcatctctgtgcattaaaatttattgctgcaattgacatgactaaggtggcataacagtgctgtgagcataatctagagctagtctgaataagtctgaatcatagctcttctgttcatgaccttgggccacttaccctttctgtgctttgttttacatatctttaaaatgaggattaaaatattactattaggattaaagtaattataatattattcataaagtactgagaatcttgcctgatatatatagtaagatgctacatcagtgttaaatcatagaaggagccagtaaattgtttcagtattttaatgtgtgtacttgaggttctggagatattccaagaacaacacacattcctagtttgacctgaatgaaccaggaatatttaaatacatagcatttatttttagagccacattttactgaaactaaacctaggaacaatacgtggctttttttggggaggggggaggttgttgtttgctttaagaaccttgctttgttaaaaaaaaagcctaacttgcctttttgggaaggcaagttagacgtagaccttaaaagaaatctagctactgccatttataggtggttatatggataccttacctttagaagttattgagtgtgacttatctgcttaatagcgattaaatccgtttaaaatgtttaccaggtgttaatcataagtcaaggttgacatagccagttaaatcttatttgaaagaaagaaaaatctctgtaaatcatgtttacagattttttaaaaactggctggcaatgtttattataaaaatccataattttccatttgtttgctatattagaatactatgcagttgtaatgaataaacatttatagtttctgctcctaaaaattggactacagtttcgtgagtttagtctcatctggtaagctttccaagagattcagggaagccatagctttccaagtatgcaaatctcttacattcaaagcacttccctcaggcacaagaagactatttcagtggcatgctttgctcttttcccttaacatatctaacatgaggaacatagataggggacagcctatctatgtttgaatagatgttgaagaaattatatgagaagaattgatagaaagttttatttttaattgtttgctttgtaatatatttatttggtgactgtaaaaagtagatttcagaagatttatttatactatcaatgcatgttttaaaattattcgtttgagttgtaaataattaatgaaaaaggcattttatgtggcactgaatcaacctgttagtttcagttgttcaccctggatttctttcatttaatcgtcttcttcttactgcaaaggaggacatttattcattactttgcccaaataatactaacacactagcagatggtcactttccaactggtttgtcttcagaaaagaaattaaaatattatagtgccagagagagatgttgtaatgtgtccctttcaaattaacaggtcattcttttcaactattttgtaactgtaaaatagctcaatgtcacataaaaggctaaaagctagagtaaatggtgtcatgggaaacatgaaataaacacagtgtaatggtttatagtcttgtcttgaacacactaagaatatttcttttctaaaaagacacaaattatatgctacggtagtattttggttttactggattctagtttaattagttcatatcaaaagttagcacttgttttaaaacgtgtatacattctgaaagaagatacttcccccaaaacatttaaaaataccttgaatatattcttaaacaaatatgttagcctagcaaacaatgaaatgaaaaccaaatatgaaaataatgtatcttcttcctttaccccttcaatgaatgatctgtaactctgataaaaagattagtttagagattattgaattattttaatactaggaccagactgaaagtaacattgtgcatttagaaatgcaacatataaatgagtagaattggagccccacatgattgggaaataagctggagaaactgaagtatgcttaaaacacagagtaattagcgagcaagctcaggaaaaaaaaaatctcagaatacttagaagtagtgtttgaggaactagaatcatcacagtttaaattatttgttttgacctttctctgccactgaattgctgtgtatctttgggcagtcacttagatcatttccttgactagaacagtagcaagttggcttagacaactcttaagccctttttttaaagtgttatagctatttggttggtgatgaattacttaacccagaatttaaaaaaaaaaaaaacaacttaaaatgcatttgcctaagtgagccaggtagatttataatgagaaagaaagaagtttttataatattatttattcttcttctgaaaaaaatcaagtgataatagaaacccaaatacaaaataactgaattcgatttgcattcctcctaattactagcactgtgaacaaaaacaggtcgtttaaatatgttgtatgggcttggtgcagtggctcacacctgtaatcctagcactttgggaggccgaggcgggctgatcacttgaggccaggagtcctgaggccaggagtttgagaccagcctggccaatgtggtgaaaccctgtctctattaaaattacaaaaattagccgggcttgttggcacgcacctgtaatccctgctactcaggtggctgaggcatgagaatcacttgaatcctggaggtggaggttgcagtgagccaagatcttgtcactgtgctccaatctaggcgatagagtgagacattgtatctaaataaataaataaataagttgtattttggatcctcaataaataagttgtattttggatcctcatccgaacaatggaaattataatttttctggttatctcactgtgtctaaagcgatgtcctactgtgttgcctttttcaaagagtgatcatttgactattcctataagagcccttattggaatgctttctagcatattatttgcctcagatactccatctgtgtggggagttctttctcaaatagttggacactttctgtctttttaagggtaaaatatatgagacagccttttctaatttgtacagagatgaaaaattaagtcagccttaagttctttcttaactgagagtttttcttagaaagtaattttaagatattgatgcaggttattttcctccttagcttaacaaggttcaggttcttgtctcagtaccaggaagaagtaggcatgcggacacttgaagagtgagtggtgtagattttattaagcgaaaggaaagctctcagcaaagagaggggtcctgaaaccaggttgccgggttctccctttacagttgaattcgagggcttctatatctgcttgatggggctgggttttctatttgtataaggcatgaatttcttctccctcccaccgccccccgccccattccgtccagtgcacacgcgggcccttagtctgagccattccacattgatttatttcccttactgtgcatgtgttaagggacagaatttttcaccacgggcatgtttaggcaagccccctgtgcacaatgacattggtgggttggatgttgtcctgggacccttccctatctgcctaggcatttggctgtctcctgcctctatcaatatctttttgtccttccctctcaaatccctactttaaccagcgaagtggaatatttgtcttaaacattgtggtgttattactcatcccaccccatttcttcctatatttgtttgaaatgccagtatactcatattgcataatataggataaacaggtttatatgtggaagtgtgaaattatatattgttatgaatggtaggggaattggtagatctgggactcaaaatgattgctagaactttatatatatatatttttggtaaggcattaattcactgagtacttcaaatattttattttatttttgagacggagtcttgctctgtcacccaggctggagtgcagtggcgcgatcttggctcactgcaagctccacctcccgggctcacgccattctcctgcctcagcctcccgagtagctgagactacaggagcccgccgccacgcccggctaattttttgtagtttttagtagaaacggggtttcaccatgttagccaggatggtctcgatctcctgacctcgtgatccaccagcctcggcatcccaaagtgctgggattacaggcgtgagccaccaagcctggtcgtacttcaaatattagtcccatgttcatgtttgaaattgtttaatcaaaagttgttacaaatagtactgaaaaaggaaagaaacctgcccttgtgattgttcttgctcatggttatcctctctgttctgtctgttcatcctgccagggtaagctgagatctcccttcctccataatgtattttacagctccagttctcattagtctttactctgagttcctacaccgcttacagtatgcaccacataattgagtatttacttatatatccttccgtgtatggattggtgatgtttcatctgtttctttgcttcccctgtagacctcagactatacaaggtgaagacaatattttgtttaatctttccctaaatgttcctaagaatgtgttagagcacctaagtggtgctcagtgaatactagattgatttgtttttttccttttctccatttcctttcactgagtgtgaaaattgctagaaatcacacaccatcccccctttttttcctgagtctatctttttaatgggcctctcttctttcctggtatgccaagatagatgtactacaaaagtctgtatatagaatttgtacaatttgtttcttgattttaagtatatgaagaaaaacgtggacatagagaaatgatgattcataatatgttctaattagaaatgtgaaagttggttaaacattaaaaaatcagcttggtgttacagatgtgttttttttccctttcttaattgtttgaagtttgcagaatttactgttttctaccgtaactaagagatatgctttctggcagacctattgaagaatttggtttatgccaaatatactactaataatttaaatgtcccacatagttaggatcttttggtattcatcagagtaaaaattaattttatcttaaaaactagagtaaaaaacctttttttaaacagtaaaaaatctgctttctgcaaactgtgtccagataaccagagctgtttagctggataatgaaacagtaaatgtgaaagcaatttgaagaacatacacattaacattatggttagaagagtgagggatggaatgccttttgtatccatgacatatttcaaacagaaaaatatgcaatctgttttcatagttcataagatgctccacaatcccctctcaaccagttctggtagataattaagacctaacacatttattgtatgtaatgaataatttctctaatgcatctagaattcaacagaattgggaaatagccctcaaataattttatgtggggctttattttcttgtggaaccctagttgagaaaggctatgcaatctcttttaacctctatttgaacagaatcttattttgtcacgtatatgtttgaagaccttaacccttctagattatttttacttgacccaattacttagtggttaagaatgtattgcctatacaatacagtccaaatctggttggccctatttgttttctaaagttttaaatgtagctatgttttattgacagcatttttgctacttaattatgtcttttcttgacagctcaaactatctctgtttactcttatttagaatgcagctggcaacagcagttggtttgtgaaacccaggcatataattaacttccccagttaaggtatggtttgtttcattggaagagaaagaattttgggggtatgtttctttagtctgagaagtaatgcagtttattttcagtatggtatattttatgtgacagaacataagcagagaattttttaaaaaattataacattctaacattacttgagcactaaagtgctacaaaaaatactttgttattatttgaaccacgaaaatcagatattagcattcagcgtaaatgtcaaattaacacaggccagtaggaacatttgtgatcatgttcttctcacatctacttgcatggataatgaagctttgactattgctttgatgtagatttttggaggaaatcctcctcctatttccaagacactttgtagttactaattctaagagagtataagcgaatccatttatttaaaataaaataaaaatggggggaaagatatttaagcaataaatttcataccatgagattttttatatcctggttactttaaaacccagtaagctgccctgggttctctcctgatactgcacagaacttttgttttacatcctcgtcttcctattattagttcaactatattgtttttctctttccagcactctatctggatttttgtaattattactgtcttcctattactagttcaactatattgtttttctctttctagcactctatctggatttttgtaattattactgtcttcctttatcagttttaaaagttaagatatgtggtatttttgagatcagaattgtagccattatattgatgtgctgcagatattaagagaaaaagtccttagttgccagctttttgtatactcaagtgttatggattcttaagaataaatgtttctttgttttcatatgaaattgtcttttttttttttttaggatacatgtcttactttgtcacccagtctagagtgcagtggtttggttcccttcagccttgatctcctgggctcaagtgatcctcccccctcagcccccagaatagccgggactttaggcatgtgcgacaactcccaactaacttttgtactttttgtagagacggggttttgccacattacccaggctggtcttgaactcctgagctcaagctttgtaatcccaaagtactggaattacaggcacgagccaccgcgcccatcccaaactgccttcctttttgcccagcccatgagaacaacctgtgctagtgaatgatttttaaagaatcttgctacttttttctgcctgggattatgtgttgactgaatatagtttcctaagagatactgttgatttttttaaactaaacgtctaccagactttctgctctgttgttccaaaattggacaatttcctgcctggtattttatttttaagttgaaaatgggaaaattgctaatgatgttgaaagcaaaaatggtattgaatgctttctgactaaacatatattgaacaaagcaaaacactatgtatctgctctttcatataacattcggaaactcttgtgacataatcagggctattttctgtataagatggggaggtaggcttataaatatgctacgtaagtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaattatggcagaggcaaagtagttactttgacaaccagattgaggattcattgcgatttattatttactacttgaaaatctcactctgatttaattaagggttgagatttccatgaagtctgtcttttctaaatttgagcaccctgttactgttgtttatgtgtgcactgaaataatctcaaactgatgttactccaaaactgtgacgaattaggcttaacatgtagttttttgaaaatttagacaggtcagataacagttaactgaaattaactggatcttatattgggcgatggtaatcaatgcttactagtaacttagtaacattgactccctgggtatcttcaaagcagcctggttgtaataagtgaattttatcttttttgttgaaagcagctttaaataatttatacctgatttgtatttcagtgtatcattttagatatacacgttatttctttgcagttacttaatggtacacttttttgggtggggagacaaagtcttgcttttgtcaccaggctggagtgcagtggtgcgatctcagctcactgcaatctctgcctcccaggttcaagcgattcccctgcctcagcctcccaagtacctgggactacaggcatgcaccaccacacccggctaattttttgtgttttagtagagacagggtttcaccatgttggccaggaaagtttcgatctcctgacctcgtgatctgcccgtctcggcttcccaaagtgctgggattacaggcatgagccaccatgcccagctggtacaccttttatattgcccaaattatagtctataaaatgtgattgtaatcagataattcttggccagaaaacgaaagttcaccttcttagagtgagttaaccattaggtaattttgtattttatgtttttttcttcccaagtattcctgaaatgctttttacctttgcagatgtaactcagttgactacttattcagcattaattaataataaaatatgataggcttttcaacctatgatttttatttaaacaaaacctttcaaataaaaataattttaaacctgtatttgatttctatttaaaatggagtgttttcatatactcttttaaattaaaatagtgtctgcttagctcgtttacattctttctgtcagaatgtctgcctcaggattctatatataattaatgtaagaaaaacaagagggtaatcccttggtagaaaactggtaatggattaaaagaccatagctctgaaattccagtaatgtgacacattttctctgaaagatgcacttaggcccgatatctagagatattaaaaagtgccccctattttaattagctaaagatagacattcctaatatattttgttgtatgtttaatatggaatattataagtaaattcatacactgatactaaatacgatttgagaagaattactgctttggtgagaagagagctttgagtgtcacttgaagcttcaaatttcttactgaaccaattgataaaatgtacaaaatgtgtattgagaatgtgcagaacagccacccaggtagtttgatcagtgtctttctacatagtgcctaacatgaactagtttaagaaacttgaggaatccacataactatccttggttccaattttttaattaaaaagtttagactagagcagtgcttttcaaattgtgatttccaacccattatcagtttgtaagcacagtatttagtgggttacaatcatcacttatgaaagagagcaaatatcagagcacagtttatataatgagtattatttcatgaaatttgcattaattatatgttcatatcttaagggtacattgttttgatataacatgtcatacttaaggaatgcagtaaaaatatataaaaggaaacaccgggctgcatgatcctaaaaatctctcccagttccaacattcccgagtgaaattttaaacatgtagctcttccttaagtagcattatatcattatgttatttcaatagaatttgtcacatgcagatgcattttgggagaaaaagaggagaaaggtgcaagacttgatattctgagagactaatacctatataaattgtaattattcctaattgctatgtgtgataatttaggcctgcacaaaattgctgagagcatatcaaacaaatgattagttctcattgtcaggcccagaaaatacctcgtgactaatattagagtacatcctttaaagatgagtatgatttcattcatttgggatagagaattcagggaaagagtctggatactttggctgtggctagacagtcaagcggccttctatgccatacttaggcatttggaatttatcttaaaagaccagggaaagctgtcaaacccattcagcctgctaggattagctctccttttagaacgatgaaagtagtaatgtgattgttgaactcaagtagagaaaaattcaaggtatggagacaataagttacaagaatttcagaaggtcagctataaacgtagaaactcctcttttgataaagagtgaaatacaactctttatcaaaagcttgacagtgctcatacaacatacgaattgagtttcactttagtattttggaaatactggaacagctttcagtacctttgcaaaatgcccaagtaaatgtatgtgaaatgttgaaagacttaaatgagtccggcatataggaaaaccttgttttattgagctttgtagatattgcattgtttttttattttatttatttatttttttgagatggagtcttgctctgtaacccaggctggagcgcagtggtgcaatctcgctcactgcaagctctgcctcctgggttcacgccattctcccgcctcagcctcccgagtagctaggactacaggcgcccgccaccgcgcccggctaattttgtttttgtatttttagtagagacggggtttcaccttggcaccttagtagacccaggatgttctcgatctcctgacctcgtgatctgccccccttggcctcccaaagtgctgggattacaagtgtgaaccactgcgcccggcctgctttttttataaattgaaggtttatggaaaccttgtttcccacaagtcttatcagcaccatttttccagcagtatgtgctcacttcatgtgtctgtgtcacattttgttaattcccacaatatttcaagtttttctattatatctgttatggtgatctgtaatcagtgatctttgatattattataactatttgatgtgtattattgtaattggagtgccatgaatcatgcccattccagacgatgaacttaaggaatattaggttttctgactgctccaccaactggcccttccctgtctctccccctctcatcaggcctccctattccctgagacacaaaaattttgaaattaaccaattaataatcctacaacggcctatatatgttcaagtgaaatgaaaagttgcacatttcttcatattaaatcaaaagatagaaatgattaagcttagtgaggaaggcatatcaaaagcttagacagaacgaaatctcggcctcttgtgccagttagccaagtcgtgaatgcaaggaaaaagttcttgaagtaaattaaaagtgctacttcagtgaacacatagatgataagaaagtgaaacagcttttgttgcttatatggagaaagttttagtggtctggagagaagatcaaaccagtctcaagattctcttaagccaaagcataatccagagcaaggccccaactgtcttcaattctatgaacgctgagaggtgaggaagatgtggaggaaagtttacagttaccagaggttagctcatggggctgaaggaaagaagccattgttcccataacatagaagtgggaggtaaagcagcaagtgttgatatagaagctgcagcaagttatgcagaagatctagctaagatcattgatggaggtggctacactaaacaacagattttaaatatagacaaaacagccttctgttggaagaagatgccctctagactcttcatagctgaagagaagtcagtgtctggcttcagagtttcaaaggacagactgtcttgttaggggctaatgcagctggtgactttaagttgaagctaatattcatttaccatttcaaaaatccttgggccattaggaattatgttaagtctgaggaatacagatgtacccacccttctctttgcctttttatcaagactcagtgtacaaggattgtatgtgtgggtcacctcggtctcctctgctttaatgctcctcatctctggcaataaattacttctctttgaaaaacttaacatttattaatgtgaattttgggatcttatgcacataatttatacgagcactaacttgtcatcctgtctctgaattgaatcttttgatagtttcctgatatagtttatgctgtgtcttctgttagaggaggctttaaaaggagggagctcttgatccctataggagaagcagagcagatagaagggcattccaagtggggagaatactgtgaagaacgctacaaagacaggaattcacataccagattttatatagtgaatatttaagactcaattccatagtgtaaacagattaactttgttatttaaataaattatatggaaaaaattaattttggaattttctactatagcagcttggtgccacaggtaccatttgtttcttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaatttattgctattttgagatcagatttacccatattttcttgttagtattattgttattctaacactgaaattattaacgcatttatgtttggaggtcttttgtaactagaacttagtcctttgcagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagctctttaagggatagaacaaggattccaagccaagtcagttaactccttgtccggaattacttttcactgtaaaatagttacccattttagaattaaacacttcagatttaagtagtttgatctcaataatatctgtacagattaaattaatatcttagggggaagtaatacttaagaggagcatttaaaaaatgtagttattgacctaattatttccccacccaccacactccctgtaggattttcataagcagagaattatattctaagattgtgttcttatttcattagcactgtgataagccataagaattgtgttttactatctttaatctgttctactccatatcaaaacattcattgacaagaggagattgtagtctattcactgattttgtccaaaccagttggaatagtggtcagcaactgtcttccataaatggctagatggtaaattttttagactttgtaggccaaatttaagggtgttgtatagatatttatataatgagagaaatgaatatccaacacatttattgacaattttcagatcttattacttgacactgacaatttcatacatttttatgtgtcatgaaatattgttcttttgattttgtttgaacattaaaaaatgtaaatggaccatgggaacactagtagtccaacccttatttagaagggactgttgtgggtatctggtagatcagatttgaattccatttgtaaaacatttgagtatttactttataataatattaaatataaattaacatcacagttttctgaggaaactgaagttcatttgtaaagaaacttcttcaagttttgccaagtcagtaaatggcagaactagaattcaaaaccttatctatttttcagtgcctgggttctttcatgtgttcattgttacatcttctgtgccaggcatggagataggcacagtgcatactggcatgaattagatgagttcctgcttctacatagtccttagtcatgatgctgcacagatttgggaaatgtaattttctaaaacctgcctgtcattataaatcagattcatctacacttactctcattttctgataaaaagtatttgcttgtttttgtgacttatcaatcctgtcttgtatttttctttttttcttgaatagtacaggaacttttttatctggtaacattcagcttcttaaggatgaaattaaaactatttgaggttgtaaggggaataaacatttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgattagttgttcccacaagctctgtatatcttttggaaatctatctttatatctgtgagataaaaataatcttcagttattaaaaaagagtcatctgtgttagtagtgacaatgtatattttagaaatttcatgtatgtagcatcattgagaatcaaatatgaaacattgtttaaaggaaaaagagtagaaattaaaaaaaaactttgattgtataagttattttttgagatgagaaattatttcaatatgttttttttttctctagaaacctgttggaaaatgccttgttactccagcagaaaagcatgtctattattaccaatagaattagtgtgttcagaaaaagaaaaggcttaatttacagccttttgaagttttagggaaaattccttttttaaagcatgcaggaggaaagacatgacatcacagccttaagtgggtaaaaggttacatggctgatactttttaagtgattgaattattagcatgggtaataatttgtggaaggtgaagaggtgccactagtttcagtgtgttaatcttccccacttaaagtgagaaataaatacctcataagaatatatatggggatatagtgtctttcctttctaagacacttgcttgagtcagcagtggttgcgtgtggtcacctttggattagtcttcggattcagagaaatgagtgggtggtttcagtgcagtttcaatgttgttaacccaaataagttctagagttggtattaattggcccccttatagaaacctttgaggaggaagctgttgttacacaggtaactttatacctttagagtttattgttgcctagtaaaaattaatatggaaatataataaaaattggtagggaactctttcattcatctacattgtggtcactcatgtgattcaatttaaatgtatcttttttttttttttttttttttgagatggagtttcactcttgttgcccaggctggagtgcagtggtgcagtctcggctcactacaacctccgccacctgggttcaagcgtttctcctgcctcagcctcctgagtaactgggattataggtgcccacagctagctaatttttttgtatttttagtagagacggggtttcaccatgttggccaggctggtctcaaactcctgacctcaggtgatccacctgcctcggcctcccaaagtgctgggattacaggcgtgagccaccgccccagacctgaaagtacctttttaaaaaggaaattttggttaagagttttttttgtgttagtgctttaaaaaaattgcttatatttaaatacaacaacgtattaactaaaaagacttaaaatccaaatttttactctgtttgatctgggaaacctgcctgggaaatacttaaaatgaagtctccaccctaatgagttttagcatcagtgacaaaaaaggagtggaaacctttacctagcaatgttggagtgactcactggatatgggaacaaatagctcatttctgcatttttgcttcttatttaattatttttaagaataaatacatactcaggctggatggaggtgggagtgaattaatgaaatttctaataacaaaaggatagtaaaaattataagagattacattaaataacatagagttggaaataaattatacctgcggagatgatgaaattgtcgtttacttattctgtaattgtttgctagtttctttgttgacagtgaatacattatacagagttacttaagaattttaatttgctaggacaatgcgaatgacttcagatattaaatttttgttagaaacttattgatgttaaactggttttaactagttataaaaaaaaataataattgtaaagagtatttcctgtttccctgtgagggtgggagggggacggagactctggaatgattttgaactctagcaggtcgtcagtcatttaagagcatattttcatagttgagtcccactgattaggggactctgatgaaaatgtcatctttgtcctgtttgtattctttatctcttgatatctggatttttgaaaaaacattttctgatgatgttcatgtcttaaatttataaactcaaaactttaatatatatataaaagttaaaactgtggtctttttgtttcttttcctcttaaaacaacttttatgttcttgagtatgtttaacatcttctggtacataagaattatagtaataaataaagcataaagtaaaataaagtaaaaataaaatgcctactgtgtccctgaataactaatattcagtttttgttgaaaagctcagagtccagtaaggaggtaatataagtacaaagacccttagaatgtgttacctgctctgatagaggagctcataattgttcattcattcatatatccatttatttaacatctttattttgtcactccataaagaacaccgtaaattggtcctttcctacgttttggcattatagtagtgaaccagataaatgacacttgtcctgaaggaggtctcatcccccatgtttgttactcaggaacagggattattgtatttttgttcctagtatcccaagtgtctagaagagtgctaggcacatagtagttactcagtagatgttaattggaggaaacaaaacaaatgacccaaacctaagctcaggttctcctttccctgttttcaagacctggtgtcttgaactgggttttgaagagtaattgttgcctaacagaaaaatgagtggaacatcctgtgcggaggagatagtttaaacagaggcactgaataattgggtaatattgaagctcagtgtgaaagtcactttttttttttaagtaaatcggaattaaagtattctgcctttgtgaacttagaagttgtaactatatactgagactaatagcatctctttgtggcatatattatttttaatagatgtgcttatcaggaatttttttaagttaagtattaaacataatattttataactgaaatatgttttcatggtacttgtgaattattaattagtggtagataatttagaagtttttaggtaggagaaattaatttctttctagtaaggaatttaaccccacagtgtttttgactcataatgtgtactttctttttaaaatgtcaaaaggcttttcagaagtagtagtatttgaaactatcagctaatggttttctaaaagtatatttttaccttagagcatctagagtgtccagaattttgtgactcttagcaagtccccaagttgaaaatttttaccttgtagcttgcataattggatttaaatatgtattttcattatgcatgtatttgttagaaaatattggtgtatttcttagtgtaacactattttgtatttaagttgattttacttaagatttcaaataaactgttaacattcttcttagaaaaaatttttttgaagtacttcattatttaaaatatttccaaaataatcaacagcttatttagctgggcatggtggcatgagcctgcagtcctaactactctggggtgaggaagaggctgatttcgagcccatatgcttgagcctagaagcttggggctgcagtgaactatgattgtaccactgcactccagctggacaacagagtgagactctctccctaaagcagacaaacaaaaaaacagcttctaaaccaaaatgacacataaaactaaggcatatcacttatttggactgagttgatgattgtgtagttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcacaacaaaatgtactgtttgttgtcagagcagcatattttcttgcagaaatgcttataagtgatgccaaatttaatgatagaatttcaattctggtcttacaaattcccatccggtagcagtgcatctgtttattaggaattacccctgaatgtgaatgatttcagtcttaagttgctgcacctgttgccgggaggtatttattccgatcagtagcctaaagcagagagagttatatcttgacattttatagcttggggggaaaaactgtcttttcaaaatcatttgttcagagaggagaaaatggagcaaaacagttcattttactctaagcaccgctatttggtggtattcacatttgcacagcacaaagctgcaatattgattttttgctcacagagcctcccaccagttctctcttcaattgtcagggttgcaagatggattagattacattttgctggttgggatgcttatttttttgttgttgttgaaatagaaatagactgaaaatacggcttggaatgaatatcacagtaatagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaataaataaatgttttcaggaatgggtttttatgtcttttataagatttatttagtgaaaatgttgggttttaaaagttgatactaattgcaataattttattaaaggcttttcaaagttcctttaaagtagcattgttggtggaagaggttgagctatatcccttgaagttttcaggaaaatagtgtaaaatggtcaaagaaggcacaacaatttatatttttcttaaaaatgtgtgtaaactttttattttccatcagttgttttgccaagattaaggacatgcccgtgccacagcctcaggagctcctgacaacatgtgcccaaggcggttgggctacagcttggttttatacattttagggagacataagtcagaaatcagtacatgagtgatgttcattggttcagtttggaaaggtaagacaacccaaagggtagagttaggattccaggtaataggtagattcaaagatttcccgattggcaactggttgaaggggtttgtctattaataaagacccgaatcaatagaagaaagtgtctgggttaagataggggttgtgaggaccagggttcttattatgcagatgaagcctctaggtagcaggtattaagagagaatagattggaaatatttcttaccatatttaaagaggcagttctggccaaacgtggtggctcacacctgtaatcccagcattttaggaggccaaagtgggcagatcacctgaggtcaggagtttgagaccagcctggccaacatggcgaaacctcatctctactaaaaatacaaaaattagccggtcatggtggtgcgcacctgtggtcccatctactggggaggctgaagtggaagaatcacttgaacctggtgggtggaggttgcagtgagccaaaattgcaccactgcactcctgcactccagcctgggtgacagagcaagactccatctcagaaaacaaagggtggggggcagttctgtcagtcttaaggtctctgttttaatgttaaggatagtcagactgtgtcagaattccaatgaaaggaaagtacaatgaggcatgtctgaccacccattcccatcatggccacaactagagaacttttccataattgattcatgtttattttctcttttccactaagtcattgattaaaatagttaacctaggaagatgttttcctgtgatttgtgtgaactctgcttagtttgtcacatggacttttgaaaattattttgacagtacctcacaatctatatggatgtgcacagcacatccatgttaacaatgttgttatatttatattttaagaaaacagagcaagttgtttattaattatcgatcacttgaaatgttggaatagcatgtgtacttgattaaaaggagcttgcctgtttagacttacagattgaggaaattttataagactttgaaatggctttaattcttcagaaaaggttttaattaaaacccagagaagtaaaatgactttgcccaaagtcacaagactgacccatatactcatacttcagtgttcagtgctctttccatgtgtacctacagtatagcatttgctgtctttatatttatggtacacatgtttacatttctacaaatatgattttcactactattcatgtagttttgtgaacctttacaataattatttcttgtcagttttactaatatattctttggtgattttcagattgtatgaagacttataaaataaatcttgttattttatcagcaaaatggcttgagtagtcagagttgatcagagaagggttctggagtctaagctccctgcatgggttagaatctaacgtgtggtaagattgagaccctaaatttactactatttgatgccttagtttcatactctgtaaaattggtactataacagcaactattccattgtttattttttatgttgttgaacataaaacaaagtgatccatataaagcatttaagccagtgccagcacatagtaattgctttgcaagtaatacttatttctctcttcatatttgttttttaaagaatatatatatattcattatatatatatatacattatatatacacattatatatatacacattatatatacacattatatatatacacattatatatatatacacattttatatacacacacacacacacacacacacacacacacacatatttggttggaaatacagactttagataagagaaatgtataaatatgtaacccatctgtcttatgacaattccagtgatacatatataataataaattgacaatttaaatatttttttggtgggggagatggcatataattttcattgataagtagtttgccttgtttttaatgttcaccatttgttttcactaccaaaggaaatagacattacaaaggaaagcacattgcaatttatgttgtgttaatcactagtttaattcaacaatttggttccacatttataagaattatgtatcatgtgctattgtaggcattgagattataactaagagccttactacagtctagcagggtagatatatatatatactaaaagtgaatatgcactgtatcacatgttaataagcacattagtaaagattaatatatctgcatatataaagtttaatcaaaacaggtaagagaaagaatttagaaaagaacattaatgatttaaatcaaaatacattgtaggattaaataaagtggtatttgctattaagaactcttagtgcaatttctgttgctataggaaaatactcagactgggtaatttataaagaaaagagttttatttagcttatggttctggggttctggggtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactctaatcctgcaaactaacaacaacaacagttaaagggcttgggttttaaaaaccacagtgcttcataatcagttctatgttttgacaaaatagtaagaattgcgagtgtggctccaagccagtcttttaataatgtgttccaatattcctagcattttctaataatagatttattctgttttattatagaattgtaattgcaaattgcctctgtatttaaaataggttgcatttcaaaattttatttgatgtcgtttgtttgaattttcacatagcttttgccacagaaatgtgtcagcttctgaagccataaaaatattttctattaaaataaatatggtactactagtttaagctgaattatttgtatagatatttcagtacaaggtcaggagatggagaaaaaagcagagtgtgtgtgtgtgtgtgtgtgtgtgtgtgtgtgtgtgtgtacatataaaagtttatgaacttgttggggaagaaatatattttggaagtttggcctgtgtaccatttgtcctgacatttacccagctctgtttctgtatcccttctgcattagtagtgcacctctccacatgctacagtactctccatatactataaaccttgttagtgaaaacctaccaagtttggggtttgccacaatctcctgaagatttctgagttccaggttaggtattcttttcttccctcttcagtccagttacacctttagttttctctgaagaactgagagttcagccaggtttgaaaattgctgctttttaaaatcataccagtatgtcacccagtactgctttggaagaatatacttacatctcagaaaagatcatgttcaggtctttgaatttgttgagttggatgggagcagtgctagctcctttgaatgtccatctgctgattcctttcagtgtcagttttaaataaagggtatttaaatggaaataagttattgtgccataagcatcttattgtcataaatatcttagttattgtggggaaaaaactgctaagatgaaggtattttttaagataatgcaatagcaattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacagagtgtttctcaactgaagatactttgccccacagcagtacatttgttaacagtccatgaacccacattgacacataattatcacccaaagtccatagtttacaataggattggcttttggcgttgtacattttatgagttttgacaaatgtattcaccattgtagtatcatacagaataccttcatgtgccacataatgactactttttggttagtgatgaactgcgtgtaccatggtggttccatagatgctaatggatctgaactgttgcctagtgacctcttagccatcatcaagtcgtagtgtgacgcattatcttttctattttaaatgtgtttagatgtacagacacttaacattgtattataattgcctgtggaattcagtacaataatatgctattcaggttgtcgcctaggagcaatagactgtaccttatagtctaagtgtgtagtaggctatactatctcagtttgtttaaatactctcattgctgttcctgtaatgataaaataggctgacaatgcatatcccagaaagtatccctttgttaatgatgcataactagtttcactgccctaaaaatcctctgtccttggcctgttcatccctcttatcctcctaactactggtagccacagatattttccagattggcttatttcacttagtaatatgcttttacatttcctccatatcttttgttggcttgatagttcatttctttttagaatggaataatattcattgtctggatagacacagttgatccatgcacctacagaaggacatataggtagtttttaggttttgtcaattatggatagagctactgtaaacatcagtgtgcagtttcttgtgtgagtataagttttcagtttatttgggcaaataaagtacaattgctggattgtatagtatgagtatgtttagctcaaagtggctataccactttccatttctaccagcaatgaatagaagttcttatttctccacactcttgccagcattcagtgttgccagtgtttgaaatccattctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagttgccttttctttaaaatttagatgtaaggaaaattttgcccacgttcaaattcagtatcattcaaattcaagacagtataaaatttgacataattgtttgattgttggaggtactgtagtttgtattaaggtgttaaagatggttataaattggtgtttagccactttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaaaggtaaactcataatttctactttattgaatttgagcagttttttttcttcactgagccccagtttattatagaaagtagataatacatcattggttaattttgtgttttaaaaatggtgtgtttgagaatgtgttataaactttaaagctatataaatgatacctcttaactggactgttgccttcccacatataagtataatacagaaaactgctgagaatggatatcattttttctgtattagatacgagacacctaactcttggcacctttttttttttgttttaattgtggtactccgggcatctttattagaattttcctatatgtaagatagtataaataattattgcttatatagaataacttgtccttttttaaaaaaaaaacttaaaaatcccaaaaccctaatagtttagcagattttcccctttatatttctcaaaaaatgtgatattcagtcatgtagtgatgggagacatgtttatttctttaatgtagaaagtttgtctttgaaaagttcacattaaaacattagaatttttccattaaatttgaaagccccccttcctttttttttttacatgtgatgatagagatgggcatagaaatttcagtaccattaaaatatgttttcattgtattttgctcctcttgtgtttttcactccctttcttccatgttatctcttcagcagttgagaatcaagtaaataaatacacttgtaattcaggctgtggacatggtaaaaatattgtattcactctccattttctatttcctgttcatttaaaagtgtgaaactaaaggctctagtagtaactgattatagtatactgtcttaagtattctgagaggctcatcctaaaaagtgagaaatgaaatgctttcttaaaatgatatttgttttaatattttatagaacagtcaccatttagtactctttaaagataattgttggggggggcaacttaaaaatatataaaagttataacactttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagacggtgaaaatatgtgcttcagttagtccctattgtagtaaggtgtattttgtataaaataggccccctgcctcccattttttttttttttttttgcggggggatggattgaaattgcccagggaaagtaaggttatggcctagatttatggaactagcctggctccttcaaagcttttaaccaaaaaaattttacttaagcacagttaaaggtagcacctgactagaacctcatagcctacttacattatgatgtttcttttatttttttttattttttatttttttttgagatagggtctcactcccttgcccacgctggagtgcagtggcatgatctctgctcactggagcctctgcctcctgggttcaagcaattccccagcctcagcctcccaagtagctgggattataggcgcgcaccactgtgcccggctaatttttgtattttcagtagagatggtgtttcaccatattgtccaggatggtctcgaactcttggcctcaagtgatctgcccgcctcagcctcccaaagtgtttgtattacaggcgggagccactgcacccagcctatgtttcttattaagtaaaattcattatatttttggttgttatactatccattcaaattccttgaagtttatttcagaactgggtggcatgtaaataaatagtgcagcaagccattgtttatacaggtttggcacttaaagagtagtcaacaaagaatgtaaaggagaaacaaatgtaaacataaagttgaatagttgccagtgaataaatgatatcacccacagagattatgtaatttgagtacgcaaaacctgctagacaacatctgcatttgaggagcagaggtaaaattgccataaaaaaaaacggaacagacgtgggagaattaatgttttagaagccagtagcaaagtacaaaagagatacttgaattttcttgatgatgatgaagatttttattctattttgacagctcaaataaaagaacatgttaggattttcgagataggagagtttcaagatagaaatcaagaaatagcaattagccttgccttgcatagaccagcaggaattaggtagtactctggtcacatggagccagatgatgaataaatataagacctgaatttataaagtagggataaacttctaggatttttattctatgagaaagagaaaaaaatctagctttagaactttaggtatagtttaattaacttaagctctataagcaacaaagctgatttcaaagctcagtgttttctgaaaggttgggataatggaagtaagctctaaatgtaggcaccagaataatctattccctttctataccccattcggtaacttttctgttcttgaatttcccttttctaaacttatcaatatcctaacctattatctctaagtataataattacactttattttactttttaaacttgagagcatatggagtggtgagaacttcttgtgtgccagaggctttgaaggaatgtgttgttgtatatgtatgtgcattactttgttctgtggttctttacattacagtggatgcagagtgagactggaaaattgagtgcatacttccacattcagttagaagtaagactacatggaaaggaccatgtatgccttagtctggaataagcagaatgatcttaccctctaccatgacacctcccattcttgccacgaggcaagccatataaatagggactctgtaggggatgggagagtttataggccatggcttctattttaagggagttattgagattgttagagctacggaggagcttgaggctcatcatattctaattccctttaattacacttggggaattgatgtcattataattggtacacttagttcacatagctacatgtatattctcacttttaaaaaaatctccttgagaaggagtggcaatttgatattctttttacttcgcaagcctttagaacaaggttggattattttccacaggggctgaaacctcaaatcgcctgtacctagaacctcattcatttaatatcttactggcatgaaaatgtattcataaataactttgaagttcagttttgctatctagacttttaacatgtctattattttcaaatatactaatagatactaattttatataaaatatttaaacaagggagatacttaatgcacacatacacacacacacacacacacacccctttactatgggaagtggtgaatattggaagcctctcagaatttaatcaagaaaattcattacaatgcactcacagttctgccagtgtactctggcagacttcatgattatagatttcggcttgtgtatactctcgttgacgtacagtcctctcaactttttacattgatcatccattcttcataaagaagctttgtatccaagtcagagctatatgaaagatatttttatttaattaatatttgttttctgatttttcctataggttacaataaactgtaaactcatctttctaaaatcttcatatttcttcctcattaatggcatttttcaaagggaaaaattagtgcagtatgtcttatggtgtttcataatattttggggttggtatattttattcctgaattattatgaatgcttactagtcagggttactcttgcttagcatattcattcagtatacttactcattctcttaggatctaagcctgccatgtctcagaaactgcattcttacccttatgttatttatcccaggtgcttttatctacttgacatgtcaggtttatccaccacttgtccattagggtaaaatacatacgggggaaatgaaataacttggccgctcctaacccatcatgtctatgcaatctacttaggttattttctattagttgatggatttctactaattctctcactcgtggcctagttgtttcaagacaactaactggtattacaagcacatctctgtggccagtctactaatatagattcttgaattttagtacagtaataaataaccattaaagctcttattggtatacctaattggacacatactttgcatgtcacttactgatggacattaaagcaaagcactcataggaaggggagactgttggcagtaataaacatgaaacttattaaacattcacatttagtgtgcaagaaagactaataaattttgaaatggtttagaagataaattatctaaatatcttttatgaccctgcttatcaaatgtagaaaagagagaaataatgtcacatcaaaaattctgccctataggatccttggtttctccttttttttgacagggtcttacagctggagtgcagtctctgctcactgcagccccagcttcccaggctcaagtgatcctcccacctcagtctcccgagtagctggtactacaggtgcatgccaccacacccagctaatttttgaaaagtttttttacagacagggtttctgccgtgttgccctggctggtctcaaaactcctggacccaagagatccgcctgcctcagcctcccaaatgctaggattacaggtgtgagccaccaggcctggctctgtttttcattttaaaatgaaaatcagtaaaacagttctactagatgttgaagactgagaatacaggtgtgaattggctcattttcactggtacttctcattaatttagggggtttttaccttttgtattatgtccattgattggttgaggaaaccagagtattttccataaggacattacattagtggtcttaagtattccctaaggcttattcagtgaaattcagaagcttgaaagatactttaaaagtttgaattttattttatttttgaacagatataggctggataagggtaagggaaattagtttttgaaagcaaagccatatctcatttcaactttggtgattttgcttcagtttttatttttagttttgaaaccaaagcggagagatgaagaaataagatcaaaatcaatagacgtgaacgtgaacatttcatttgacctctgcatttcaatatgatcataatgatctttttatagtgcttttcatatccttagggattattatgtattccacctttctcatttgaaaggagagtattatggatgggatgacaatggtatttctgtggtgtctatatcatcacataccttgtagtttttcactcacctagaacattccttcctgtacactaaaacatcggtttctatttacaaagtatgacatttaaacaagttaattgacagaactgtgtttgactggtatctctaaaatgtactaaacaatcaagtgttaaatgtatttacttactgtctaaggaaaattattgtgggtaattaggttcatggtggcattttactaatacacatttatctaaacgaccacgagatcagctttcataagactattttcagatacccattcaaggactttgttgttcctaagtatgatttcttttcagtatggatctgcttgttgatgtcatactaataatataaaaattttgcttacaagcatcctttttaaaaagttatactttgaacagataagaatagatgttcagttacagttgtaaaaaatagaaatgaaattttattgtaaggtttcacatcaaggcaaagtcaactatttttgcttgtaatttggcattttcttctgttttttttctttttttgacaccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaaggagatatctaaataaataaaatgcctagctgtatttaatagagaaaacatcttactaaattggtttaccccaaatccatattttgtttttgtactaggttaggaacacgatagcatgatgagtcagtatactgtattgactaattttattgaatgaagagaaagagagaaaaaaaaaatacatatatatgtctttttttttctttttgtggggaacatggtctcactatgttgcccaggcagatcttgaactcctgagctcaagctatccttcttctacctccttcagtgctggaattacaagcatgagcaaccactcctggcgagataatttgatattaaattatttaaagatcttaaactgtcatttattatggccctattaattttccatatatcctatactgaaattgcataccaaaactatgatagtaacagcagcaacagcaacaacaaaaaacaccagtacctactttgtacattatctgaggagaataattgtgggtaattaggcttctgatggcattttactaatacatatttttgtgccttgcatattttaaagatccattcttttttctttgctatgtattttctttaagtatattatagcaatgtagttagattttttttagtgctgtttattactccactattagttttagaggtaatacatctcttgtggatgttagaaggaaaaatctcattatgaaaaaaatagaagtaaatgattttgtagtctttaacacatttaaatgttgtataaataaatcagatatattgtgaaactaacacgtcacggttctctcaaaatttgttaacatgtcatatgtgaagaccaagaaagacatagttttagaactcacctatctacattactcatggctttaagaaagtgtctgaaatgagagttgctctatttaatttggcttgagatgattccagtggtctttctgtttgttttttcagaccgcagatctgttattgttattgaactcacctgtaatttgtggaaatcttactctgtctctaaagatagattcatggtaaacccatgaaggtaatgaatcttaaaacatcacagcccttcacttgcgtgggtctcttctaaggcatttgaacaagttcatggggtcaaatacatacagtaaaaattggcagaaatacaatatttaaacacaatctctaaaggctctgatttcattctctgacttttctgatatacttcccctcatttatggtggcttaggaatagccaagcgcatttagagatgcagttagatggaagttcagttggtgttaaattcaatctaggtttagtggagttatttttacgtggtttgtagacacttgtatacagttttgttactgctaactattctggtgaagaaatggcctctagaaatacttctgttactcattatacttccttcctgatcgtgacataaatgtgcaaagccagatgtcatattgcaatttaaatatgtcctatgacacctgagatatgtgggtagtggaagagagataatgtttgtagtgtatggagccagaagctagtctatggaaaaatcctttcattcattacatatatatatataacattaagggacatttggttttcatagatagctaatccaaagagaagttttctcttacatattcttggtggagtatgtagagtacacagagcacatgacaagggtagtacttaaaattaccaatgtaccatactttccccctcttgatgagtaaaatatgaaatagaatttatcagaatgccagtgtttgtaaggcacaggctggagcagtgtagcaagcacgagctcttgtggcagtgtgggtgcatgttttatgcatcacaactatcagtagtaaaaaacaaatttggatcagctgttcacaggaaaagcaacattatagaaagtaaactgaaatttttacatgaagagacactcatagactatgtcgctaaaaatattgaagtattagaaaggaatatcaggcaattaattaaaatgctttagttttctggattttgttggttgtggttcttgttggcttttacaaatttatttcttgtgatttctttttctaaataaccattcactttggtatctaattttctatatgtaatttttctattttgttttttatagaaggacccttaaattttacaagttttagaccccacaaaacttgaattcacgcctaccttttttatttatcaggtgatagtttcaagaagttggcatagcattcccctggacattcacaggttgatatgtacattttaggatatttcattgtatctttagatatcttctttgtatttcagagatttaggatttgggagaagagagactgaaagattaaaaattaaacaaattcattttttaaaggacattatttaagtttataaactaaaacatttatttatttagtaaaagctttgagctagaataacccattttcgcagtttatgttaaataaatgcttggcttaaagccctcctattataatatggacaaaactaaatggaggaataaacagattttaaataaatttcactaatatactttgcttttatactctcctcccccttcttctcctcctaatttttggaagtttccctcaccctcaactcccattacagactttatatgaagaaaactattatttaagttacttttccttagtaatggtgtttctgttagatttataataaaaaacatcctttagtaaatgaaagctttttttttttaagttttactcttggtacttagaaaaatcacacaggaatagaatgtatgctgattttttaatgatattttataattctgtaatttttttcatacatttgattatcttatgacatcctaaagtgttcttatcattaattaatagaattctatgtaaacttgaaagaatgtttgtaagtaacttttgaaatcaaattgtgaaatatgtgaatgagactgtacctttgaaaatgtacaaaagcaggtatgttagatagataaatagtggtcataacaaatatattatctaataagttggttcaaggcacttttatatatcttgccatttatttcaacccttgatgagtagacctttattaagctgtgatgattactgaatatgaaatgtaaccaagattattttttattcaaatataatttaaatattcatcaaagagaagttatgcttgagactgacagagactattaacatcaaaaaatataattaactgcattgggtatcatgaagcagagttagccaaatagccgagaggtctaattgctctagagtttgagaagcaatggttttattttatgctgtagctgtggaattaatagtaatgcggtttcctatgtgggccaattaaaagctgcctgttaaggttcactgctctataggaaacccattgaatatcgcttagtaaacaggattgacatgtcaatgtgtacaagaagataaaatagaataaaaactgtgaaaatgagaagtagtattaaaagaactgtccttgaaaacaactcataaaactctttaccattagtgttatggttggtgttgtagtgtgcctcccacgttcgcctttcaggatcaggcactgtttctcccagctgtcaagagagttgcctgctgatgggctcacagctgagtcactccacaggaactgccacgggctgaagggatcttaaactcttctccccagaggcagcccccagtgaatcccaatgaatgccagagtacaaaggattggcttcttcatctttgcttcatttcagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaaccaaagaaaagtgctaatacattataggaatctagtaattaagtataaaaactaaaggttttaaaggaaaaaaaaaacaaaaaaaaagcccaattcaggtctaaaaatggctttttgcactcaaaacgtttatctttgtcttgtcatcctttttctttaataaaagtaatattttgacctttgtggctctattaagctttttaactgaatacaaaaagaaagtgcttctgattgaatccaaaaggttttgccttgccttggctatagaggtttagaagtgggcagacattctaatggcattttgacattaatgaggttgctgaaatggaaaagtttaagggtcaaagataagagcagcgacaagttattctagtgtttcttttacttaataatgtcatatcaaatatgcttaagaagttgaccatgattccttatgtagaatatgtaatgttttatgagtatactactttaagtattataatactttttgcaaataaaaaaattctaagacttactataaaacatgccacctcagtctattaatatgtttagttgcaacttctgcaaaacgtgtaaaaaattttaaaattgcttaatagattttattgtgtacaatatgataatgtgtatagtgtgtctttaaactgcagtgataaggctgttttcctagtcattcattatttaatgtgcttactctgtttatatctgtggcataagagtgcacgttagctttcagaagagcacaacatttgctgcttcacagcacacggccctccactcccaagcctgcacatggtgttagtgatagttaaagcacttgagtctaacattttatagattttgatgaaccgagcctttcagacaagttactgatatgaagctaattcaggctagaagtataatatgaggatagacactttctgctttcattgtcacttttaaaagcttctacaaactgcttgtgtaaactataaatcagatacattttagtttggtttatatcatatggttatggaaccatgcttggcttctgaaaatgatatcttgtctttcattgattgatttgctgccaaatgattagtgggttctgagatatagaagcaaatgtgccaaacactctaacagtatttattaacaactggtaagaatatattagtatatttgttagagtacagtctgatgtttatggagttaatatattttagaataaggtagagcgttatgcagtgcatatgattcagagactcttaaaacagtgactaacccctcaaaggctctgtagtctggtgaagaagaggagataatgtacagaaataactgtgataccaaatctcccttatagtgtaacaaactttcaaaagctggtggagaagggaaagtggtaagttatggcctgagaggggaaaaaatactgtatgctcgggatactgaggaggtctgttcagggaggtattcagcttctgtcccctttctttcacactctgtaacatggagcatgttcgccagtttctttttcctttcgggcattgtgagtgaattccctcctttcacttaagctaaggaggaaaggatctttcaaagattgtgtttatatatatctcaaaaattatgaaaatagtcgtacagaatatcatatttaaaaaactatttttaactctgtaatgtcagcatggaaaatagcactaggatttgagtccttaatattaactccgaaacagtaaggagttcaatctttttatagtagagaagagtaaggtacagtttgatattcacttgttaatttttatctgtatagatattattcagatgtggcatatttatggtattactatgtttccaaaattacaggtatttctacactttaggatataacagcacgtaatgtcttctaccacttttttttaaaaccagcatcacagatgaataaaaagttatctggctgggctcagtggctcatgcccatagtcccagaactttgggaggcggaggcgggaggaatgcttgaggccaggagtttgagaccagctggaccaaaatagtgagaccccatctctataataaataaaatataaaattacatttcccctccctgcctttcttcttttcctccttcttcctatttacctgtgatcaattgatctatctatgtatctgtctgtctatctttttaaagataatttcttgcttttgtgactgagatgcagcaaaaggacacttcccttgatctgtgctttttagaaagagctcattgggtaataggctgtagactgaatatttacgagttggtgttcagttatcaagagaatgccatcagcaatgccttgttgctttcttatcagctacttcctgctgtcagcttggcacttatttcaatagaaaaggatttgcatcaaatgtaatgccttattatatacagctaacgtggggtttttaattgtacaaacacatgagactcctgcagtggtagtcaatttgataaaaggattagattatgaatgttttgtcatgattaaagattagttcagatttatcagaagtaagccagtgaaatttgtcatatatttatcagtcaggtgagactccattaatctgagagtgtatgaaccacaagtagccatctctttataaaagtctgctgaatttggttatttatattcaggtgacaggtgctaaggattgtttttggccttccctacttgctctactgctcagagtatcccaagagtctatgtctctagcttttggtcactattttttttttaatctcatcttatagaatagtttggtaaacatctacacaaaatttctgtagtttttattaaagaaatgacaactagtgtatacctgaagacattttgaattgttcctttgattaaaaaaccttcagtaaaatacggaagattgagaattccaacttagaaggtatttaaattgagtacttcttgccataaacaagactaggcattgagatagattgaaaagaagcctgacatacaacagaaaggtgaaactacagtcccagacacaactaaaattactgtgtgaggcctgatacaacagtacccactgctcttggagtgtttgggaaataatataaacaaggacataagaagtttaccgtgtaattctagacatggaaaataattagtgagtttagcagcaactaaagtgcaaaatataggagatgccataaagcagaatgtgattaacttccaaattaataatatagagctgctgctctaggaaaagactacttccgattcaggtagtcagggaatataatcctgtttggccagcatcatttgtattggctttctgtataccacctgtgtggctgattcttcccgcatatgtgtgtgcctccctcaagtatataacagggagatcctgtttttaggattgcatggagggcaccactgggagttggaaaatagcagttcctcagactagaagcatagtatcctaagctctgataattttctacctcagggacttaacggtccttcaaatggatcttcttattaaggaagagatagttcaagaactgtacatagtcatttatgtgagaactcagttcagaggtatttgctagtgtgctagctgttttaaattacatagatatcaagattctcaaagtctacatagaaaaggttgcctctgttaggatgatttttgtagagacgagtactgagccatgcttatggagtagataatatcgtagagagatgtttaggagagagatctttcagatgcagtgattcctctagcctgtggtgttagtaagtcaatcagattctctgggccttagtatattgcacctatattaatgaagaattatattagatcggtgatttttaaactggatttcttggagaaaaccctcaggttgaggggtgattgaggtatatgggaggagagatcaagtggatttttcaggggtttggagccgaatttcgctactataattccagacctgtctcaacttctatttctaatccattctattaagcaggatttttttgttcattttttaagtaaaatttttcatgtcaaagagattgtgttgccagaatctgatactgatttggtactactgtatttgatgatgatacataatttatgctcatatttgttattaagcacatacttgctaacaacatttttaaattaagggagaaggatcctctgttagaacagaatacttgtatgaaaattcctgaggggagttgggatataatttgaccatgagggtatactctctataagtagatgataaagtgaattccttctatgtgggaaagaaggacataaggaaacacagatcaaatttgaaattcaatagttaatagaaaaagattcatggctttctgaataattatgtagcactttgtttttagaataacagttttcactttgttgaacctttggagaaacatgaactatgtatttcccttgccctccaacattaacttattaattcagttcatatattcagatattgcttgctcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactgcaaggaatttcaaaggtttctaaaacatagaaagttgtttttagaaaatcagcattgccatttcaaaatgcttattttagtaattaatgtggtatttttaaggaaatttttggagtttctaagttgtaaatgaactaaatattaaagtatgcatactttgtgtttataaattctggcataatattttactcaaatgcaaaggttatgggaagatgttattctgttttcattgactgaaaaaaagcacgacaacctcctagaattgattttccataggattttactgtcaagcttttgttgacttgccaccagttacttgatttttacttggggagtgaggactttctgtttctcttatacactatactccttttcagtcaaatggatttatgtttacacattgaaagtacagaaaaacattttgcatttttgcttatgattatcattttaataataaatgcaattttaaaataatttttatgcaatttcaaggatttaatcacaggtgcaattttaaaaaatcaggattatatttaaaactttaaaaaagtagaaaattgaatgtaataaaaattatattgtttatttttcccaaattatgtatctctgtgtaccagtattcatgcatattatgctagagattctgaaactaactttattacagtaatgatttcaaaataaataacacagtgttctataatgcaaattgtataatatcctaacatacctataggattaaattctatatgatggttagaaatctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttttggagcatgactggagaaactaatgttatcttgccaaaacagaagcccctgcttaatcagcagaacaagactattgattaaaacacctctcacaatagattacacatggaatctcgtctccatactttgcacttggtaaagtgtaataatgagcataagataatcaaaagaagagtaaaagcaatttgttgggcattgtacaattcaagattagagttggaatggaaacaaatttgcatgaatagttgagcctgtttttaaagctgtacacagtaaagagtacgcacagtgcagggactactgtggaagagtaaaagatgttctgcttctttaagatttgcaaatctgttcatcttacataggggacattgttattattggtatttttggtggcggtggtggtaatttatatttcttgatgtttgttatccaggtattgtgcagagagttgcctgcactatcccatttaaccttaacaaacttctaaagaagatactacgttttacagatgataatgctaaggttgaaaggtttaatacattgcttatggactcacaattaagtaagcagctgacctggaacttacacaccaatttttttctgattctacagcttctgcttttaaacactaatcttcccaattatcaaatgattttgcttttgaacagagataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaataaacaaaattcagtgttttgtcccatttaaactagtttatgacctataaagcaagacttttggattttctttgttgtggttgatggattttattaatgttttacgaattttaatgtcagaaataatacttttattccggtatttgaacttaatattaaaaggttttattattgggtttattttagttatatttggaattctcaggttgagtgttgtactctatatactttagaatagtaagaaaggtctttaaaattgtagtcagaaagttgcaaccagaaattatatataggtgatacttcgtgcgtttttaacccagtgatgtgaaataatgattaaatctttgtctttgtatgccaaatttgaaaattttggaaatgtgactagaaaaatactaaaaatgattatatgtttagaatttgggactgagtgcttatgtagttttatgtttattttctacttagtatttaatcatgaattataccctggaaatggtttttgttccttgtttttgtttttgagacagggtttcattatgttccctggcctgtgcttcagtggtgccatcctcccacctcagtctcccccaagtagctggaactacaggcacataccaccacacctggctaatttttttaaactttttgtagagatggggttttgccatgttacccaagctggtcttgaactcctgggctcaagagatcctcctccctttgcttctgcctcccaaaatgctgggattataagcgtgagcaatagcgcctgaccccgaaattgtttagacattattcgcaaggcctacttatgcctctgagttctctctaaaaacagaaagaaagcaatttctgtatttattgccttcctagagttgagccactttattaacatttatttgaataagtaagtcaaagattgaatataggaaaattggcagtgattacaatgggtcatatttttctgttatttttaatgacatacttctgtagaacatagtatatttttacatattctcaaaagttttatttccaattttagtgtttcgttagcacatttttagcaaaacattatacttcttatctgttaaaaaattggttcatatgtgatgtatacatgtactcagataatatacttatttcaattctccatgttaagaattgatgaataactagacagcttgctcaaaattagagcaactaaaactcttgatttctacacttagaattagcaagaagacatattaacattgtaaactgtattatgtacctcttacataagttgtactcatcacttgttttctgtttcacttgttttactaagttttatagagcaaaatcatgttttgccattcatatttattctttagtaaagtatctaaacctatctcgttttaaccctgtggctctcacacaagttgcactgatcagagtcacctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgcaatctcagctcactgcaacctctgcctcgcaggttcaagcgattctcctgcctctgcctcccgagtagctgggattgcaggcatgcgccaccatgcatgcctgcgtggctaatttttgtatttttagtagagacggggtttctccatgttggtcaggctggtctccaaatcccgacctcaggtgatccacccacctcggcctcccaaagtgctgggattacaggtgtgagccaccgtgcctggccaataatttgtatttctaacaagttttcagctgatagtggtgctgttggtatgaggaccacattttggaaactactgctttcactatcttaagtcatctgttcatctttataaatataaaatgaaataagaccagttatttgaaagttgaagtgttcaaaatatattctagtatctgcttctttatgatgaaccgtaattgtagttccttcaaattgtagtaaaatgtctactcattaaaaccctattttttctcttttgccttgttctcattcataccgattttttatgcttaatgtgtaagaaaattgtaggttattaacgtaataaacccacatggtattaccaaaatatactgatagtttgattgttaaaacaatgatacctttattggtaaagaaatcttcttctgtagaggaagggagagaaagtcatgccaggaactgtgcccagtactgaaaatacaaacgactaaacactttttctttcttggcttaactctaccttttcgctttcattagtatgagaacttgaagctgagcccttggcgggaatttactttgcttctgtggataagtaattgctttctttctggatctttttaaatgatagcaatttacacttttataatcttatcaacagcatattgttaaggaattttcagatttttcttagtattaatagctcacgttgggtgtttcccaatgtctttcttgtctcctcactctctatttggaaacttaatgctgcttgcaccctttataaaggaatataaatgtctgtatttctatttctgtaatttgggcctctaaaagcttagattcatttccatgaatcaagatactggcatgcaaagttctaattttcttgtactttttacagttggatttctctcctttctgacccttaactgttttagctctaaatttgccatttttctcaagattaatttcttgcacttctgatatctctgtgtatataaacatatgaaattttcaaatttaaaatgaatattttttatattttgggaggccctgaattctagaattttttataattttattgcaggagcttcattaaatcagttttgcttaagattatagttgtagaattaatacgttttgctgtcttaaagtggatgctttgtgtaatgtgattatttaaatcaataaaaattatgtggttggtataagtaatcataattgctttgacattaatttgaacctgtaattggtcagaggactactgcaaagttgttcagaaagagtaaatatggacagttattttttattatggtgttggtcctctttcaaacaaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaattcaggttttgactcttacgtttctgtttagttataggaccatttttaaaaattgtaatcttaattcttaatatcctagtaagatatatccaaatatcttaatatcctagtaagatatttgttgttgatcttgttgtcgttcagttcatgttgaatatatcaaaaattaaaatgtataacaatgataggaaactgttggccattatttttttacttctagttaaaatttagtgtgacccatgataccactgtattacaacataaagaaaacaaaactcttataaaatatttaataatgtagagtaacttaacatcacttgaatttttgttttatgtttctggttgcttaaagaaaatgagaaaaacttctatgttatatttaagtgaaaataatcaaataaattatgttacacaagtttgatacattttgtttttcaggtgcaacaatcgaacacagtgtatagtagttactgggtcagatgtgtttcctgatccatgtcctggaacatacaaataccttgaagtccaatatgaatgtgtcccttacagtaagtatgcagtttatatttttttacactttgcccagcattacttgttgatgctgaaagactacacatgtgaaagaagcatatgtttatggcctacaaaaccattatgtatgcagagcactaacagacttgggcctccaattaacttcatgaagtgtggaaggaagccatagtgtgatgctggccaagtgtctgtctgtgttcttaagtgtttggcttttaaggctagtgtttttccagaaaacaaacttgaattagctattcaatacggctgatagaaatctgtacttttgcccaataccagttgctgacaaattggtttggctcacagttttctaaagaaggaattgacttcagttttaatcgtgagctacttgaatggctacctgctgttgtagtaagtttagtgctgggtaaaagctaccattgcagtaactgaggcaagtgctttactttttgttctattgtctttaagggagcatttctttatgggattcagtgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattcctatatactctacagtagtgacactctataaattgcacggtttcaactaatattaaaatacaatgcaaagagccttcttagattattctaatcctatgtaggacagtgtcttatctctttttcccattttcctcaccttttgtttctttctacctctgtccattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgattcattaatcatcaaaggtttataatattttaaatctttacttttgagtgttacttacttttcaacagaattataaaatatatacaatatataatttatacttattttccttcaatatgtgatatcaattaaatctcaagtaaataaagactttgatattctattccctaactacattgtaattttagtttatcaaataacaaaattcagccattttcaatgaatggaaagcaaaatacactttctacatcttctattgaacttgttttaagttcttttttaaataaacattttaaaatgtattatttccatcctttacatttaatttatttcagtaaaattatcctttccttaggggaaaaaagcatacagctgtatataaattgtagtttgagtagtcacaacgctaatgatttctcttatcctgattttctcactacgcccttccgttattgattctaagcaggtataatattgctcttcgctgaggagtaattttaggactagtggtttatacaaaagtattgttttcaagacagtaatgttgaatttcttgtttttcagatgtagtcagaataacacattatagagcaagtatgtttcctgaaagtggttacatagaccaagttgattggggaaagttgtagcttaatgtggaaagttgtatgccattcctatggcaaaaatgttcgtgtgatgttttttcccataagtgtttcagaaggccaacatttaatcttgatgaattattgtaacttttaaaaattaatcaaactaagatcttaataaaatgtgcactactctgtctgagtacattttggaaatgcagtattagcaaccctgatgcattttaacaacagaaaagggagaaacagacatcagtcttgtcattttatgaaatttaggcaacatacttcaagcctatatacaatgtaaagtagtattttatggtttgtaagtattagaatacggtttaccaacaaggatcttacatagcccccttcctaacttcataatctgtttcttgaaactgtaggagttgtttttttttttttcctcatgtaactctactaatcaggtttgttttatgaaagcatttactttttataaggtctgtggagtcaaggtatttgctctgaatgctcggtatgattgttgttgcatgctagcttgctttctatgtaaattgatgatggtagaattgtcataataatctaaccataattctttcttcctttttctccttgcctactgtgcttgcttttcccttgtatgtattttgcttactttttttatagacttagtattacaagtttgagatatataatatagaaaatttaataagaattttataataaaatgtatatgtaaacctaactaagtaaatatactaattcttagtgggggagaaaggtactaccttaccctactcttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaaagtgtcatcttgcctggcttccagaaccctctccatagcatgccatggttacagggtctcctgattgtttcatcactgcttttcttgcatttacttttctgtgctcctaattgcattttccaaatacttatgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattgtggcattattagtcagcttaaacttttttcattgctaaaaatataatactaaccagaaacctgttagcagtgtttttttgtttggttgttttcccctacttgactgctgaattgattacaatctatgttcagaccttttaacttcttggcgccagtggttaaaggaaacgtgtgttaggaagtcccaggagaatggctaggcttgatgtacaatgccagatatatgcgttctaaagttttggtgtctgttctctcagtaggagagggagccatccaatatttttctagattatcatgtaaaattacatgtttttattttctgataaattagtgacagtttgaagtcaatatttctgtgactttaacgatcacatgaaccaaactttaaatgatcccaagtgatgacttgtgatgacagatatgcaagcattgtgtgatttgtattctctttatggaggatcattactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtgaataaagttgagtataattcagttcaacaaataaaaacattacccatctacttgccacaaagtacttcagcaaatacaaagatggttagtaatgtcatcctccacatgtgtcatatattctagcaaataatttgatccatttcagatgaaaagtctttgatagtttagatgcttttggaaagagcagttaacagccttgaaaatgagaagcttcggcagatgtagcaactgtatgttcctacaactatggtttgtcatccaaaatagccattctttataaatagtcccagaacatgaaaattcatattgaccccttattcagcccttagtgatgaaaagtattatctgacctaaatttctctcactgctgtttgacccatattcattctctctctctctctctctctttgtaatttatattatgcatttagagactcccttctctctgatccaagatgtgtgctacctatatgcatgtaggtggggtcttgcagaactattctggcccacaaatttaggtcaaaccaataagccactgtcagctttccagaaacaagatccaagaaactgatagaacagagcaatcagagaaatgaggtcttttgcctgtcataaagtagtgattgatttattttgctgaaattcgtagttcaggtcatctgtgctggatttgctatcacatatatggccaaggcataaattgtgctataaaattatccattcgttttttttcattatctatgtcatttttcattgtggactgtttaataatatattagcctcaatactttttcccatttataaatccaagccttttcattcctaaaagcacacgcatattatttttgtgccttaatctttttttttttttttttggtgagttttgagctctgtgtgatccctgcatagttcatttgctccactcccctaaacgaggtctgtttttcctgtttcaccttctccctctctggaatggccttaggaaaaacactttccagtcctgttttaactcttttccatttcttaatctggattgctttatatttacttaatctgtctgcacatgtgatatcccaaatattataaagaaaatgatgtgtttttacttggcttttggcagttcctcaacatttgggttagactaattaatgatgtgatacacttctgtaataccaggaaaaaatttttataaagagagccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgtacctctaaaagatttagttttgtcacttaagctttatgatcatgtttattttcatgatatcccaatatttcactgatttatttttgaagaataagttgattccctttaatctattttggtgatcaaaaggtaaaaagtggctgggcacagtcgctcatgcctgtaatcccagcactttgggatgtcagggagggcggatcacgaggtcaggagatcgagaccatcctggccaatatggtgaaaccccgtctctgctaaaaatacaaaaattagcagggtgtggtggtgggtgcctgtagacccagctactcgggaagctgaagcaggagaatggcttgaacgcaggaggcggaggttgcagtgagccgagaccacaccactgcactccagcctggtgacagagcaagactccatctcaaaaaaaaaaacaaaaacaaaaaggtgaaaaggtataaaaataaattatcaaaaaaaaaaacaatggaaacatggctgtagaatgttgcatgaaattttgcacatttaattgaggtccttttaatgtctaccttgactcggttattatgaatctcaactaatgcttagctaacaaatcactaattgtagtattaatacatatttcagtgattaaatatgtgctagttagtacagtgtcaagggatatatcaggtagtgtagcgctcaagcattttgctctgcccccttcttttttctgttctgattcccgactcccctttaagacttgattcagcagcagtcatttgacacttctgcaaaagattgtgatgcttttgacaaatgttaattgagaaagcactgaaagcctggctgcattgtaatcaaaagaaaattacagaggtttaacaagatgtcaagcaagtgctttaaagaaaagatagacaggtttgaataggtttctgcagcagctggctaggcatgatgtttgactgatgtacataggcatctctcatatggtcaataaattatgccctggaaataaaacacatgctttagaagtttctcttgaggtagagggggggaaaggaataaaacgtgtatagtgtacttactggtaacaagaagtatgtaactactaaagaactagaaacatgtcacactactttttcgtagtttactgtcagtagtgtcagaattaataaagaaagattgatggaccagagagcttaaaatagtaaacatatcagtgataatatgaacttgttttctaataaattctaatattctagcttattatctcatgtgtagataaagtgtaaaataagttgattttattaagatgatttgaaaacatagctatttttcatttgctctactacaacaatttaaattgaaggcatcatatatgtaaggttttaagagccaataatctgtaaatgttgatacaactttcgtgtgatttcctccaacagtttttaagtggtagtattaaatttttactgacagatttttgttgttgtttaaattaattcagtggtaattaatggaagaaacattgagctccactatttcttaaacctagtggatttaacagtttagtaacattggaaggcaaaaataacctttgaaaataatgaaaacatttttgcttttaaatgtgtaacgatagttcttttaaattctctgttaagggtgactaagatatgaagggttggtttgaattaggcatgatttgatctgatgctttatcttggtaagagattccacctctgactggaactagctgcttcttcatacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgtttacagtagctaactttatttttgtactttggtaatataacatctatggacaaagttttttaaactgtaaaagtcatttaagatcaggcactataaattacctctccctttcagagacctaggtcaagcctgagatttttgccccaagactctagtgagtcttccttacagctgcctttctcattataagcatcactttggatgaatcccaagaaaattaagggtttttgtttgtttgctataaatatatgatatttctatgctgacttcatatttaccatttataatctgcattataccctactttttgtcacttattgtcaaatacttgcattagagtttattcaaaatttaacacgcagagcaggatcatcatagctgattcccgaatgcatgcagaaaaatggtttcaatttcactgttgttttctacatctgttgtaggaactgcctcatatctctgcatgatttccactggaacatggaaccctaagggccccgatcttagcaactgtacctcacactgggtgaatcagctggctcagaaggttggttggaaccttttaatatgacacattggtgatttagggcattaacttctaacataaataatttagctttgtgtgttaaaaccagctttattgctctttgttcagtataaaagtaaaaaaaaattacgcatagttttgtctgtaaactgtttattgaaagttacatatgtttgggggtatcctgttctctatgttaagctttttagtgagtaatgcttgttaatttcattcatatttagttctgtttcttttgatgttcataagacaaaatgcattcgccgattaaataaaatatcattaagtttacaactgaatccacagaatgcaagcagatgtttatatcacacatgattatggtagaatgagtaaactactttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagttgccgtctccaggaatatattgttatcagtgccattaatttttcctattatgacaaaagttggattgctacttttcatcacactataagtgtttatattaggttcataggaacccaaaatctgtgcctaatgtggttctacctggttaaaaaattgacttttttttttactgcagtatatattttgtctctttttgtcaacatattttagattagtatacttcataaaatagaataaaaaactgtaaataagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaaggcatgacttcactaattttggttggcaaggtctaggaaaaaatgacgtctcactagttagtattggacattgttgaacttgagaactttacaagaaaaggtagtaggaaagtctgtttttaggtaataatggtctgaaagtccccttttagcctgtttaataggggcagagaaataactgctgaaatctatagaatttttttaaacttcaatgttcagttcacctttaaggtattagttaatgtatgaaatgtaataattggtatgttgcccaggacatacatcgcagttggaaaagaatagctttttttttttcctttggcagaaagagactacttcaggaatatgactaggctaatgatcattttgatcccactagacgagtacaaatagtaataaataaggagtgtttcaaattaataaaagcatgccattagcaagttatgtgtatatggagtaaatttcagcatgaccttaatttctgaccagtgtcattttcagtatgtctcaaatgagcttctctgttcagataagactaataaaactctttaaattacaaatcagaagctgacttacactatgcaaatgaagcaagttcccactttgtgacagaggattcatttgtaacttagattagagagaggctccagtctgtatttcttggtgactaatgaatctggcctctgcagaccaatttctgttccactctagttaatggctgccgcagtatcagtgtgagcatttcgactattctgtctcccattagagggagaaaaaaagcctttaacgccacttggaagtatcttccacctgccaggaaggtcgtggtgtctcacacggcagacagaacgaggatattaagatggattaagctaattaatcttactctgacagtagcttcaaacaactttcccccctgttcatatagtacctcacgctagcaatttttattgttgttctttttgtacagtgtgtgttctttctcttcagtaattaccaatagatcagaactatgtgtttatgggcataatgacacattatgactgggtgaatggaatagagtaaataaacttagtgatttcacctttccaaagcatagtcagtgcgtagctacagagtgtaggagtataagatcctgccttcagttgattaactgagttatattttatttaatgttattttgtgtagcaataaattaagcctacatatgtgcatatttacaacttgggtgtttatgaagacttgattctactttcctgttttctctaacttatcagtagaggctttaatttttattcctttctttatccctttaaaagcagatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacagactactcttccaccagaagcagtgctaacttcattagggcagcagatactgaatgaagacttactatctggaatgccatatcttaatgcctaattatgccttattgtgcctgcgtaagtcatgagactttatataaaaaatgcagatcaaaggggtatatggaagaaatggacataaatcaaattagcacctatatttgaattcataatcttaaatttattttatataagtgaatttttaaaaagaaatgaaatattttaaaaataatttgtttttatttactttgaggtttgggaatgaaaaatcagtaattaccgaagtggcatattatgacctcaatttgttttctaaatattctgaaaattattaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcgcatgcctgtagtcccagctactggggaggctgaggcgggaggatcacctgagcccagggagggagaggttgcagtgagctgagatcatgccactgcactccaccctggatgatagagtgagaccccatctcaaaaaaataaataaaatttaattaaatgaaactaaaggattatttttaatgttgatcttttttcatttttaattaaaaaacactatggagagactggcatctctaaaataatgcttggtatttactagtctaaatgctgattacccaagaattatcaatatgaaagtcattttacggccgggcatggtggctcatgcctgcaatcacagcactttgggaggccgaggcaggcggatgaggtcaggagttcaggactatcctggccaacatggtgaaaactcgtctctactaaaaaatacaaaaaaaaatgggaggccgaggtggatggatcacctgaggtcaggagttcccagcctgcccaacatagccaaacccagtctctactaaatgtacaaaaaattagccaggcgtggtggggggtgcctgtaatcccagctactcaagaggctgaggcaggagaatccctcgaacctgggaggcagagcttgcagtgagccgtgatcacgccattgcactccagcctgggcgacaagagcaagactttgtctcaaaaaaaaaaggtcattttacatattgtaataatagttgtgtcttttttatttccaaggtataaacaattttgggggtggggggaagggccctgatttactgtgagggaaacgttcacctttttcctaggacttgtcttgttctcttttcagacatgaggactaaaatagcctattatttctctatgttcccactcccttgaggacatggctataatgtcttaggttattaaaacaatttgattttcctccttagtgatttcttcttaaattcttggtttaacttcatagcatgatttacccttaataatacatgactccataaaatgatataattttatctattataattatatctaattgtgacatttaaaaacttggaggtataatttaaaatatgcaataagagcacctgttttaagtgtatagtttgatggagtatggcagttgtacactcttatgatcatcagcatggtgatatttctgtgtcctcagatgggcccttcatgctcctttgcagtcattctcctctgaccctagccctaaaaacatcagaaaccactgatgtgcttttcgtccatgtagattagttttgctttttctagatcttcagttgaatggaatcatatagtatgtagtactccttttgatcttgctgcttttatgcagaggaatattttttgaaatttatccatatacatgggagtgtccataatttaatcctttttattgctgagtattatccattgtgaagacataccacaatttgtatatctactcacttagacatattgaatttttttccactttttggctgccatttttggctgccatttttccaagtggttgtaccatattaaacttgaactgtagcatatgagagttccagttgctccacatcctcaccaatatttaggattggcagtcattttatttttagtggttcttggaggcatctcattgtggatttatcttgcatttctgtgattgctaagtaacattttgctgataacctcctttcatgtgtttattgtccattcaaatatacttttatgaagtgtttgttcatatcttttgcctatttttaattgggttgtttgtctcattaaatgaattctaaagattctttttatattattgttgtaagtctttttgtcagaaatatgcattctgagtatttttcctccagtatgtgactttattttctttatatcttgggaagagcagaagtttttaattttgattttaaaaattcaccttactgagctttagcagcatctggctaatcctgttccacttaactcctctcactcttgtaatattttaaagcaaattgtaaaatcctatcatgattactgtaagaaactttatatggatatatcccatactctttaaaaaaccacaataccattatcacactttaaaaaaataacaaaacgtttcaaaagataacaaagtgtgttcacattttcataaatttattaatactttgttgaaaccaggatacaagtccaagtaataaatctgatagatatgtcagttgagttttgtttttttttttgagatggagttccactcttgttgcccaggctggagtgcaatggcgcgatcttggctcattgcagcctccgcctcctgggttcaagtgattctcctgcttcagcctcccgagtaactgggattacatgtgctcaccaccatgcctggctaattttgtatttttagttaagacgggatttcaccatgttggtcaggctggtctcacactcctgacctaaggtgatccacccaccttggcctcccaaagcgctgggattacaggcatgaaccaccattcctggccaagtattttttcattaaaagttatttctctttgcatactaaaaaaaatattttttaaacattttttgtttttcttgaggaagtcaggtgggtaatttgtcttgtagactttgttacattcttggtttggcttatttcatccacagtgcatcatttaactctgcctggtatgctgatggttagatttagaggcatgatcatgctaggtttaactttctgtttctttaatttaacaagaactttctgttgcatcttatcaacaagcacataatctttggttttatttccttgtgattttcagatcggttccatggtttagatgttatcagcctgatccatccattgtaaaattcccttttatttattgtcttttttttttcttttttctttttttgagccagaatcttcctctgttgcccaggctggagtgcagtggcatgatctcggctcactgcaaccttcgcttcctgggttcaagtgattctcctacctcggcctcccgagtagctgggattataggtgcctgccatgatgccctgctaatttttgtatttttagtagagacagagtttcactatgatggccaggctggtcttgaattcctgatcaggtgatccacctaccttagcctcccaaagtgctgggattaaaggtgtgagccaccgcccctggccttatttattgttttaatgagctgagtggccagcatgatttttatcatcactttagacttagactgtggtaacaaaaaccccaaagtcacagctgcttacaacaacaaaggtttactactccttcctgctgcataattgttgaggctggacttcagctctgcttcctgtcatcttcagttctgctccgtgttgtttttattctgggacctaggctgatgccagctccttcccataaaggtgcaagtctcctggcagaggtcatagttcttcctctttcctctcattacagccactacttgctgaggaatttgcaaaatagtaagataaatatattaaaattctgtttacagtattggctgagtgaggctctgaatggctctccagtgaaccaagtgtattcatgttcagaaaatctattgaataaggcatatattatttcaagcatacagaaagtagaggatagcataacatctgtgtaccacttactcagctgagccacatattggtattttaccatatttgcttcagatttttttggaaaaagaaaatcatagataatgtcgaagttcccaggattgcctccttcctgattcatatcatgaatgaggtagctgtcatctttattacttagcattaataagcttaaaaaattttgctttgtaagtatgtacagtgaatacttttcaggtttttaacattaatttcacactgtaaatgtaattgtataattttctttctttttttttttttttgagacggagttttgctcttgtcgtccaggctagagtgcaatggcatgatctcggctcactgcaaccttcacctcctgggttcaagagattcacctgcctcagcctcctgagtagctgagactacaggcatgcatcactacgcccagctaatttttttgtatttttagtagagagggggtttcaccattttggccaggcaagtctcgaactcctgacctcaggtgatccgcctgcctcagcctcccaaagtgctgggattacaggcatgagccactgcacatggccataattgtataatttacccttagcattttattttttatatttacatatgctgatatgtgtatctgtagttcatttgatctgtttctaagaatgtaccagaattaactgctgatagacattttagtggcttctgcttttttcctgacagaaggaaaactgtaatgaaagtttctgtatgccttcttgctccaatgtgtgcctttctagacatacatgcgcacatacctgtgtgtgcctacacacacatactccctagaaatagaatttttgagtggtagagcatacccaccttcagctttactaaatactgccaaattgctctctaccttcttttaccaatttaatttttcaccagtaataccattactagttttgcagacactttattattgacataactgttgtcaatctaatgagtttgaattggttacgttattgttttaatttacaatttccgtgattgcttcatgttgatttttttaacagatttattacctatgttagttttctctcctatgaatttattgtttacaactttctcctgtttgattttttctttatacttctatgtatactggacactaatcctgtaaagattatatagtttacagatacttattctgtctgggctttctctttttatctttttaaaaggaatctgttgttttacataatgagtcagatatatcagtttattctttttagggttggtactcttggtatcttgtttaagaaatattttccttttggctttctacttaggaaaattttctctacattgagtttataaggatcttatacttcccttgtaaatgataaacctctgccttttacagttatgtcttgaatctacctgaaatttatttttaattatgatatcatatgagagaggcagctgatttgatttttccccatatgaataaccagttccttgtttacgtttagtgcgtaatccatttctccccctaatgatttgtaatgatatcttacatgttagccatgtctattatttgctgctttggttttttcagtaatgttaatatctgttgagtctttcagccttgctccttaaggaactgctttggctgctttttggcatgtctcttctatataaatttttaaatcaatggatccagttccagacacaaaaatcttgttggaatttttattagaattggactgaatttgtagattgattttgaaagaggtgccagggtgaactgttgcattctcccaaataacagcattatgtaattcttcatttttttcttaggtcttcttataaagttatatatttttcttatttttagtgtcttgcactttttaaaaatcagatttgttcctagacaacttatacttcttttttttattataaataatatcacttttaaaattacatattttaattgtttgttgtgtggtgtatagaaacacgattgatgttgctcatagcagccttgctaaattcttagtatttctgatagtttatcgttaacgtccctcgttattactatgtagttaattgtgtttactgtgaataatacttgttttttcctttataccttttatttgcttttcttgaattactgcattaagctaggtcttctagtacaatgctaaataaaacctgtgacagagatcattttgactttaaatggaatgcttctagagtttttcactattgtttgctatatatgttttggatacataaaggtttagcctttatctgataagaaaacttctatctggtcaaagaatttttctttaattcacattttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaagattaaaaaaattagtatccaagaattactgtacaatggtatgagatgatttttgtaaaaataaaaaggggattgtaggtgaatagctgatagatgatacagacattagagacattaaagagagtgacattcagaaaaaaagtgtggactgtattttttgaacttttttaagaatacagattatttttaaaatttcaatatcagaaattaatgaatttttcatataattccttagatttcatcaataaaatgttaatattgtaattattaatataagatagttaactcctgtaaaggcaatgtacttttccattccttttaaaatctaaatgaatgttaatgtaaaataattacaatctgtattgtgattcccagcagacagtaaacatttatattgttagtggttactattaagtatatttttgaaatgaagttagcattggcatgttgatcaggtagatgttctcagtgttttgtattgacgtgttttccttaagtgtttgtcaatttcgatacttggtttgaatttttgaaatttggtttagattgcagtggttgtcacacttctgctgtaaaggtccagatagtatatattttaggctttgcaagccatggtggtctctctcgcaaatatttaactggcattgtagcactgaagaagccataggcaatatacaaatgaataagcatgattgtgttccaataaaactttatttacaaaaacaaatggcatgccaggcttggcctgcaggttctattttgcccaatttgaatatgtaaagactgatggttactagtgagaattaatgggaagttttaacataatgacattttcatcataaatatattcttggctgggctcactatttttagaaattagaaaaaaaaagtattactgcaaacttgacctgtgtaatttttcatattaaagtggatcatagatagaaagagttgtatagatgccataaagtcattcaaatttgtacttcatattagttttaccactgccaagtaatggtcattgaaaagttacttaatataaagagccaaaaaatatcagtttgaaatatttttgtttagcttcatgatttaaatataaaaccttgaaagttatgtactattaattcatacactgttcatacttacaggctaacagattggtattagttcatgacaaaagagataaaaatatgaagaaggtgttagaatgacaatacaaaatttttttgagaagtgaatatttaagacttaaatcatttggagtaatttggtttttagtccatgatttttgttgaaacctaacagtaaaattttttaagtaggcaaaaagaaaacagtagtttccatacagttatcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtactaacaatatgatttacattgctgctagtgtatctcttagaactaaccaaaaatgggcccaaaatagaacatggatttttaaaacatttggtccgtatagaattttctcagaacaaatttatggctctaattttatcagaaaggaaaaaagattctaatgtaccatcaattgtaaaatcataaaatggaaattgtaattgtgtaaaatgggtcttggtaatttaaagtacactttagagtctttcggactataaagccccttttaagctagatatctgccttgtataacatagtccacaattttgctgatgaaaaactttatagtctgaaacatgcaaagtttaatctaaattaccttttatacatattaaacaattgctgttgccatcttagaatataaaatcctaattttatcttgtcattttatttcccagcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcagtaagtatttgcacttctaattagtagcagagaaaaacctcagagattcaaaacagcttgtataatagtcccattctttgggtgcttaccgtaactaaaaagcaaacaaagtaatgttgatttctaattgtttctacactgtccataaattttaagaagtcttggcactgttattgttacttctcaaaatcatatgctatgactttatagacttgtaagttttcctccttggggcaggtgcttggtagagacaacagaagatttaaataatgagcagcaataggtcatacaaaagagacagaaggctctcgagtttaacatgcccttcccatcttgaatgttcgaatctaattttacaactttccctttaagtttcctaaccactttgcacattgtgcaaagctgcatcttttgaaaagtcaaaatggcttctggaatatgtctcagtattctttcttgtgattaagacaatgacagccagaagacagaaatattttaagaagtgtagcatttccgtctcagatccgtagtatgtgtcaactctcaatatgtaagcatacaaaaccccaaggagaaaataaaaacttaaaacttggcttatgtgttagcttggaaaaatcattaaaatgtcagttgtttttaatcatgaataagtattctttattctgtcatgtaaatagtttccatgtgtttatgtagttaattcagtcatactttgaaatcattaggctcctttattgttttctaggtaaaatcttcctctctcatagatcattttttaagtataaaagacaataatattgaacgctattatgtgatcaaaatttatttttggtattgagccttttttgaacacatatgaatagtattcttcaaagagttcagtagtaaaagatgagctgtacatgtgaaagctgtctttcttctagttgatgtaatgcaggaatactaatgttcctcatatctttttattttcagtataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcggtaagcaccagttgagttcattgaccttagatctctgaaaattattttagtaggtgtgaggtgacatatgatactgatattaatgtttgaccttgtaacttgatagaattgatacggcaatattgaaagacaatttgtagtaaattaaaagactgtccaattattaagtaatattatgaactaattcattttatatattaagatacagtcgaatttttctgtgtttttattaagacataattttaatagaagaatgctgaggatacagtaatataaagatcctattttaaaaattcttattttgtttacatagtcattctgaccagtgatcctttctttgtattcatagcaattgattcatcatcatgaggtcttaatatcagaaacagaacttagttagttaatgcttcaccctatattcatctgcccttggataattttaagaatgttccagatatgacaggaactgggtaattagagctaggattttgtcattaaagcaaaattttaaaattccattatagaaaaaaatagaaataatatatttgcaaacaacacttttaaagacttgtgaagcaaatcatctacaagtggaatatttagatttcataacagataattcacaaattatgaagttttcttatttgatatttaatttcactaaaaaatgttatagtaatgttcttccttgatgaaacctagcacacttggcattatactctgtgaacatgataatcttcagatttgtcagggtttttagcttgtttccagttacgaaaaaaatattttcaggaagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaattcagtggggattccatgttatatgaaaaatgaaccactaagtaaaatctgtcttaataagtttatgcatcatttactctaatactgtgtgagttctgtgctttgatatccttttctagcatttatccattcctagtggaggtattatatttctgctacactgttttgcaacaaacataacatctgaacagtttttgggggttctgttaggttccatagggttaagcacttcagctcagacagatctgaaaggcaaattttgaaaattatatgtaggactttaaaatgatgagacaatttgcaatattgagtttcaagtctgtcttagggaagtcagaagtcttaaggattcagtggtggagtggtgtttattgtcttccccatacaagcacgattttgtatgcttttatcaaatataaaaccagcagtttgaagtaaataaattattttcctttgttaagtcaaagccaactcagaattattagaggtcttgcacatgataaatgaatcttcaaaggcaaatgtaaagatagttttgtctgttaggtttttaaaatcctattttccttgtgatgttgaggttccatagaaactactaatgcatattcttctcttttcataatagttgctggcttcatgttgataactactttatatggagcttcattggacctgttaccttcattattctggtaagcaggttctgttttcccttgctttttagcttgctgctttagcagtgctattcaaacaaggataatttgttttattgtttgtttatctatctatacaaagatttataaatatgcctgtctcacaggataatagtatattttaaatattttttataaacttgctaattaatatttctgaaaatctttactctaaaaagtactttttctcatttctaatttaataagctgacatatcacatcataatctaaaaaacatgcttacatataggccatgttataaattaaatgaatatgtcagaaaagtgaaagaatattaccttaatttttattatcttagtttccacatagtaatttaatgaattactatgtaattctaatgaattaattttaagtgaattttaaatgaatatccacatcctcaatgctttttagtatataaaaagttgtttaagcttgcattaacgaatgactattaaatcaacttaaaatttattagaaataaaattacttctataagactgaagataccaaatgaatatactagtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattagttcggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtcttaaaaaaaaaaaaaaaacttgctcagttgtagcactatggtgagaaatggtgttattaactctgaaaaggaaacataaatacttcctattttaagaagtttttcttacttttttttcaaaaacgtaacacaaatgagctcgtttggatcttttcatggttaagcagtgtttcatgaaattgagaaaaacttctagtacttgaaggaaacttaaaaccacttcaagtgtatatttgtttgtcattaaaattaattattttacacaattacttatacaaagtgaaatgaaaatttgagatgaatgcctgtatgaattaaaccagtaaaacattctcaagtattcctgggaaaactgatttctcatcagaattattaaatctgatgattgcccaagtttttgttcttggtgttcatatgttaacacagcctaagcctgtctagagttcaatggctgacatgaagaggcatgatccttgaagacataaccttccattttcctctaagaccttcgtcaaacacataagttgcaaaaatgtaaagactgctttagggatatttggccaatgaggctatcatgtgtttactccttttatactgtagttttatttatttgatatctgtgaagataagtactgactttagatcattaaaaaacatttcaattagcaaaagaagttaattttcaacatactcagcttttagtaagaaaaaagggtaaaggacattttattatgttgttcatttatagtagagcacactattactttataagtcttgtcattattgtcctctaccaaatccttcaggttgagatgtgaatggctttttcaacagcattctcaaacacaaaccccagtaggtagcaatcccagtacagatcttgttggaattctcctgcgattgctttgctttctaattttcccaacagagagaaattaagagtggtataggagtacaaaacagcgtcttgcaaaagaatatctaacttaaattgagatatgatatgatgatacagtgtgtgtggggaaaaaatatatatatatatcttccctctggtgatgataagacatgtaaactcaattcaggcacaaatcttaataatatagattgtattgtatactatccttttaaggaatattcccataacaacaattacctattgctattcctaggaaagtatagctttgcattttcagtttttctgaattgaaactgtttcacttagttgtattaaataggtgtacattctaaataataatctatgaagaaaaataatatgctaaggaagataaaacttcctacttctgcatttctataggatgtcttgcctacaggcactagagttattatatctatgagaaaagtgctggtaagtaatgagcagtgggaaaccattagtatgcctgaaatggtttaatgaaagcttggatcatgacacgtcaggagctgttcttatcatttggacagctccatctgcatcgttaataattaattcagttcagtaagagttcagctcacacactcatttagaagtcttcttcagagaacacctctctggctgctagtcccagggagaaataggtttctgcttggctaacagcaaagatctggagatacaagtatagctttagagttgcatttgccaggtagcaaaagctccagggaggacaaaaagggtcagaacgtgcacagttcagctaggttacttcagagtgatgtttctgttcttctgtcttatcatatccatgtcagcactgcaagctgtggaatgaattttaagctgctaagctcagacggatgtgattcaattgagcaggttgatgaccataaaacaaactgtgcactcctataatctgtggtacctttttctttcttaaaatttctttgtatttttatgttcatcaatatgggtgatgtttagctgtgtcatatcattaagcagtttgaattttatcagcaaattatattggtgggttattataaataataatttatgaaattattgtttggggataggtaaaagaatgatctttgtcagtgggagagaaaaaaaaatgtcccagtttgatgacttactctttttggctgaataaggattttttttttcttgatttgttctcactcaacagacttatcttaaaagatagccatctatttacctgtacacacacacctgcacacagacacacacacgcccagagctaagctaaaatctgattcttgaatgagttgtttcatccccagaattaattattagcatggacatttagcctggtgggttgtcatatgtatgtaccacaatcctaatagcctatacttactagtagtggcttctgtgtggataattgagtaactgcatgtacttaccaagtttagacaaatgtttgtgtgcgcagctgtaactccacctttttcctttctcactgatgcatgcagcctttcaacctatgccaaaatattatgtttaaacttcgtagtatttacactgaaaagaaaaaacaaagagcaagagggtcaaagagtggctgcattggaattcaagggagaagagcagcaattggatggtagagacattgttctctccctgcctctttgcctgccttccattgagaaataggggaaataccatgttggatggttgtgatttattttgtaaatgcgtatcaaaggcagaaaaataaattgggcaaaagtaaaagtaaggaggagaaagaaatcacttattataattggtgggggcgggggagaaggggaaagcacagaagtatatggatggaaagagccatttatgtcatgagaaaaatgcaaagaagaaaggaactcagacttgcagccagtagtttatttgaaacctaccttttttgtcttaaaatgactacagatttttatcaaagatgtgtttatttgcccctctgcctcttgttctcatttccacggttgtattttaagaaaacaagaaagaagtaagaaaggggaaaaaatttttggaatattttcccctgcaaaattataattatcagaatgtattgcctcctgaaaaagattgcagcaacaatatttattctatcaaactaaaatttagcattacatttttttaacattggagaaaataagataactgtaaaaccacatttttaaaaatgtatctgtgcttcagtatatgttctatttaattccagaagatattttattgtcatatatgttggtggtaacataaattgttgagcatcaaagtgatataaaaatttttgtatttctctaataagactagtaaataatatgtattggtgaaatttttttctttagttgggaaaaagaaaaatcttattcagtattattttgccatcttacgatttatgtcatatgctttatttcataattaattagtcttgaaatgatgatattttgtcctcttccacataccattgcctcattatttgtatgctttcaagtcatgtttcagaggctaagttagtgttgggtttaactataaatttctttacatctagatattagtgcattagctaaaagttttattttcagtttcttcaagttggagaattcagacacttgtaatttgagcgcaaagatccctcaaagttatgattatttttccaatacttttagttgtctttaaaggaactcactttcaaatcttttaaaacattccattttaagtatgttagaaacagctttaaaaaattttgttcttacatttgcacttggatttatgagcttatgtgatatttagcaatgtaaaagtataaatgacataaacaggtttagaaaaaatacaactaactgttgttaagcatgtgacttgactagtgggagtagaagcgtggccaattgctgattgtgggatgctagtgttttacaaaggaaatggagaattagttaattctggcaaatccgtcaggcagaagtcatttgatgagcatacctattatgtaaataacataaataggatttctttgaggcagtattttatatgttaatttatttatcttcaattcattcatctctgagtgatttttaagttggattactttttatagaaatggaaacttttaaatatagacttagtatatctttgttaggagacttctaatcttttcacccagaataaattggttaattttatatgggaagtctgtgggctgtagagcccagaccacagtatattgaatcccagccctgaaatatagtatctaagtaatctttggaaggacacatctcaattatttgtaaaacgggtatacaagtgctgcctgctaccactgtatataggattgtagctgtatttttcctctgtaattttctttattttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaactagaatgttatggaaaataaagccagataatgtttctacaattgtatttactttttctctagatgtattttaagacattattaaattttttttaaacaaagcactgtttttgtccttaagtaattaacatcaaaggacagaatgttacctgccaacacttgtaaaattttgcccattgacctcatttatcccttaagagggaattctccatctaagagaaatcatagggcacagtggacaaaatgactggatagatacacagcctacattaaagctttccttagctctgctcctaaactcatcattaggaaggacttggaaatttttatttattgccctatatcacttttcctaattataaagtcagaagtagtgaaagatgaataaaatagtgttaccatttgatcatgtgatattgtgactcagtaaaaatgatcatgttactgtaacactgttatgctgattatctgcaacaaggaattaaattcatccttacctataataggtgaaatgggtctttttctgaatatactatttctggtattctcttaagtaacgtacagctcacaaaatgacttttttttccttttaaaaagtaatctaaaaataaaatggcaaaaaaaaattcaggaacaatgtagcttagttctatttttggagcataaaaatggaactgcctcctcttcttccaacattctgccaggtgtctgtagaaacaaatgcaaattaccaacctttgtctctcagtcaaaacacagctccttttcctctgagcaagctcatgttgacctcttggaatccactcactttccttcttgtcagattccatcttcctcattttgcttttgtttgcacctagattctttgcatagctgaatgtttagaaagactcaaaacagcattttgtcagaatgtatctacttccttacaatacagagacatagaaaaaaaagactgatgatggcttttaacagttaaatggcaaaacatacctatataaactttatcttactttatataacaaacgtttatcatgttacttcatttgatccccacaattgccttatgaatagattggacagatgttattatcctcatttaatcagtcaaaatcaagagctagactcacagccaagacttatggtttcaaacccagcaattttgtagattacatgatgtacattatgtaaatgctccttctaaggaattcactttagtgtttccatcagatggtttttaggccctgaagtacatctagctaaagaaactaatttaggttttctaatttatttaatcattaccacataatactgacttaatgaggttgcaatttgatgtcaaatgatctattaaagaattgatcatacatagccagagtattttttatgtagactcaacttgatcattgcatacataaaaaaaattatatcagtatcttccatataaacatggatcgatacatttgcaagaactattcatttttcagctctttgttcattgtggtctaattctttatttgttacaacagctaaatattatcttcttggtgatcacattgtgcaaaatggtgaagcattcaaacactttgaaaccagattctagcaggttggaaaacattaagtaagtattttgtattttaattttaatacttgacaaactaagtaaaagatactctccacagggaacacagggatttctaccttctatcaactgtagaaattattcagaatgaagttttactgccctcaagttgaatctcagtgttactatatcactgatactggtcaaaaattagataataattgctgtcttgatctagagccaataaattgtttcagtggctttgtggaaattccatatcactgtagcaatttcatttgaatttaaaatgcagttcaaaatgattttcgtatttgcatggctgatatgattatattaagtttgttttgttaaatgactttttgctttaaggattctgagcagtttccactcctaatcctgttttcctaagagaatttactctattactattgttaacttgaagattatctgttgttttcatgctaaacaaatatttactttttcttaatgttgaataaaagctgcaatattctgtcaatggagaaaatgctatctaattaacaacaaatgatagctgttgttcattaaatcatcttatggaaacattttcagagttacctttaaaatatgtgagccttgtaatttagaatttgagaaggtattattcaagttggttataatgtgattgtaaaaaatactatttttaatgtcaaaaatggcagatctatagtaagggtaaatttttttttaattagatgttttagataggttagtgccagcttcattgcatgttgcatggtaagagagagagctaatctttagcatctctctcttttcttccttttcctctttctgtcttctcatctacaccagtaattaccgtgtttgtgatggctactataatacggacttacctgggtaaggtagaaccctacattaacaaatttatggcatgatttgtattttttacaaattcgtcagtatcatgaattgcccttaatttttataattattttgaaatatctaatttgctatagtatttttaaactataatatgcctttattttttaattgcttgcctctgcattttgactttcttaattttgactaatttataaaatatataaatgctttcttattactttctattttaattctgtctaataattttgtttctcttttctgcttataatgctttctagctatgaagataataagccatttatcaagtaagatcattagttagacatggaatgcactgactttaaatccttctcattccgtcctattttctacagttcttttcttcttaagctgttcatgacgaaatctctccaaaattattttattttgaagttgttctcatgtttttgtctcatttcagctaggcttcttcatgctttagttataaaaccttaggttcacctaagactagtttattagaatctgaagtttaggtgttaagtgattatctgccatttaacctttctgtatgtgtcacattatttagtgtcatgtgagtacaccataggaataaaaatacaggagtaaattaattaagcactccttaatttcttttatcaaaatgcacataaaagacaaagtcataggggatatgttacacgttgtattttaatatagttttgatactttgtttattctggaataagaaaaggtcatacctgctgttgctgttttcactggaggctgcagtactaaatgctattgttctttcttaatcagagaaaggttaaaaccaaaatgctgttgaatatgaatgtgaacatagagaaagtcaactgctactactgatatgttaacatttaagcgtgatgtgtgttttttgctcattgaacctgttaaaaaagttcactttatttttccaggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtaagtaattgaaaacacctaggggctcaggttactcattctttgatttgaatataatagatataataaagaatattttaagtcacatctggcatattgttaaagagcattatatttttaattataagttaattttcatacctgtctgaaaatttaggtttcacctataaaataataccagtcatcttttgtatctcagtttgggaatgttataaactagatacttaggttaagatttcttccttgctcgtagggtctataaaatgctaggtacaaaggatatacaaggtaaaagaaaaggttaaataaaactcattctttgctcactaaaggcattacagtgattcacagtgaaatggagtataaggataaatgatgttaatttttaaagcaccagacatacaaaaaattaatgttaccttttgagtaattttgaaggatctaaaaatcaataattagtaccttacatcttacttactgttttttcctgattttatgttaagtggagtcagatgaaacttacagatgaaaagctttaatctgtagcaagaagatgtaaacctaagggaattgcttaggtgctatttaagtataaaatttccatacctttcactgggtatcatcctttctctgcctacatatctaatgtagtcgttttattctgttattactagttggtcactaaattgaacagagaaatagaattgtggaagtgaaagctattatgttttcagtcctgacaagacgatagtgttgttacttccatcagttttgaataagctataattttgagataatgacagtggaatgtgcaatactgacagataatgtatattcacagcaatataggcattaggcaaaaccaacactggaaggtattatttggataaaataccattttgattgccattgtcttggttatacagcatttcatagcagttaacacccattaaatgtgttgaaatcttttgtgaggtatgatgtgttatttaataacaatgaactttaacttctaaacattgtacaggggtaacattagtaattactttggcttttatatatttcctacataagtgagcattttattattgtatgttcataatttttgtgctgttgtgccaaacatctttgacacaaatcatagacatagcagaaaaggagtgaggtagtcattatttcctcatatagttatgtgtattaaatggaacaggagagtctcttatgctttttagatttaacaattacattttaaatgcatcatgttatacttcaaaagaagtataacttagtcttggatacatccagttgggtgcgccaggatgagttgttaagaatatgatataaaatggttaagttaaaatcatggttttaactgcttgaatgagcatacttaggccaagaaaatgctttgaagactcaaccacattgttatttgttctaataggtataactaaataaagctaaaaagatgaaaatgtaagtgcgcttagatttaaaaggccatctactgatttttaattttctaattttgcaaggaataagtgtcaaagtcatggtctttacaggcagttactgcacacagacttctgagttgagggaaagcctttgagtgtttttgtaacctattagaaaaaatattttcttatgcagtttcttcttgtctgtcttgtaatttcacagtctggctctaacccacaagaaaacatgtatatgccagtatagctgcaacagtccagcagcaccctctccctcttaattctgtaccactgctttagatggggccctattatttagcagttgttcggacttcactttttaaagtttagttgaaactttttttagacctaacaactttttttttgcattcatatattcaagcttcaggggaaaagggaaattacatgggtaactcattaatgtgaatgaaaattgcataaatagttcccttgtgtgctaatgaagtgaatagacatcttagactctctacactaaatgttaaagctagacacatcagaaaatgaagaaaacattccttcctaattagaggcaaatgtatcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacacatgtattcttgaataaaagcttaatacattccaatttagtatgaaaaattatatggtattgtatatatccttggaaaggtaatttattacactattttcagtttgatatgtactgatttgtaatacaagttagaatttattacaatgaaatataatgacattttaaactgttgacattgttctagtgagattctcatttaaaatggaaaaaggtgtatgtgtggtagcaatactaacctgaattttaagatatttttatccaaattacattagctatgcaaaacataatcagtaagtatttaaaagtttgtaatttgtcagttagaatgaaagacgtgcatttcttctgttgctttggtattttacttcattctgttggcgatcaaaaagtaaatgcattattcaatgattcatttttgaaacctggcaaataacattacataatgaaaattcttgttatatagaatttgtgaatgatctaataattcattttatagtcttttttttctcagcatgtgtgcttttgcatttactaagagaagctttttgcaatgtgtcatactttctacctgtctgtgaaagttgttttcctcctgctcagttggtattaacacagatgttttcatgagggataatcccacacctgtaaattctgaaagtttgagattccctcttctgggcctcagtggttacgtttttaatattaagcagtaacatcttgaaacataatgttgatctctatgcatttaattgccatttttgtttaacagtgcttttgtataaattagtaaatgtcatcctcagcaggtgtttacttgggggatttagaaagcacctgtgaattactgaaatttaacttccctctcccttctctcctgcaaattagtagttcaaatacagtcagaacatttcaacagattttccattgccaacttgtccactacccttgatgaatataaaaaaaatagttgactacaactgtaacactaaaataagaaactgatgtacttttctctgtttttttgttgttttttttttttactttaggaatgactggcaattacctactaacaaaccctcttcttcgaccccacggcactaacaacccctataacacattgctcgctgaaacagttgtatgtaatgccccttcagctcctgtatttaactcaccaggtgtgctttacttacaaataaaactacctttctttgctgctaaacagagctatgatctttgccctgtttctaaaatattcaagttgtcatatatttattgttacattcttaatttctcagttaaaaaaaattacggtattgtctatgccaggcttctaaaactgcactatattatagtaaaagctcagtcatgatagtatttacaataatgatccatgtttttaacacaggtggcataaatcttaatatattattacaggactgacatcacatggtctgagagcccatcttcaagatttatatcatttagaggtatcctatctatataatatactgttcagttaattctaaagcttgctgacaaaatttgcttctggaatgaattagctaatgaagataatttggatgcctagctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatgaagctagagaattgtgtctaccaagttaaaggaagccttacaaataactatcacaatttcattttgttgcacatggaacatgatacaaatttgtcagtttttcagatgtagaagttgggacagtctttaagacaatacaaatcactaacaaatataatctctcattttctcatttttttgctaatgataatttgcccaacaatgatcacatatttattggtcatgaagtttgtgtcaggtgatacagatattttttttttctgaaggaaactgcattttctaggatatctgcagctttaagagtggagtgagcactaaaacgggaaatttcgtatttttttccaagaattaaattttttcctaaactcctccaagccttgcatacaatgcagcagcctcacagtggtcagcttcatttcaataacatcatttcattctttttttttacagacctatctgtagactgtgatttttttttttctctaggattttgagaatgaataacctaactttccatggtgcagaccatttaattttctcttgactttttttttcatttgcttgagaagcactgtgatgtcttagtttacatgtttatgtgtctgtagaaaatacaactctgattcaaatagagcatgttaccatgttttatttccccctcctaaacctcttttcctatcttcagcagacttatccagtctttcattcctttagagataaaaatatattagccaaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaatatcaagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatatatattttttttttttttttttttttttttttttttgggacagagtgtccctctgtcacccaggctggagtgcagtagtgtgatctcggctcactgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaatttttttaaaggcaacactgattattcagttagtcctatttctttctcttgaggcagttctcaaaactctaaagacatgaacactgcatcgtacctaaatggctactgttctctaacgtctttatcctatggattcaatttggaagccatcattgatctttggcatcaaaagaaaagtcatttttaaagcatttcttttcaaaaatatataaatattgccttaaattccatctaggattcccttagtacaaggtagtttcttaggtttgtaattactaaactactgactgttttaatgcagatgcgttattgtatttattaacccagtttctttgggtctgcctagacttcacctgaatgtacagttttcacattcttgattgtttctctttgtgatagtcacaactgtgaacttataaagtcacatttttaaagttcttcctagagacattcactctgtctttattaaaaataataataataataataaacgttatcttgttggcca

SEQ ID NO: 2317 - DNA, 193557 bp, Homo sapiens
  source 1..193557: mol_type = genomic DNA
cgcagccggacggaggcagccgcggcgaacagacgttctttctcctccatgcagttacacaaaaggagggctacggaaactaaaagtttcggggcctctggctcggtgcgtggagaaaagagaaaacctggagacggggtgggtgaaagacgcatcccgggcgcctctccgaagtccaggccgggagcaagctcctgggcctagaggggagggggccccgagccgctggtcatccccctgcgctcagcctcggagcgccgcgcttcgcggcgctctcccaaatactcttcacccactccagaaataaaataaatgtttttaaagtgcatgtgtgtggacaggatggagagcgcgcgccggcggagcgcgcggaggacccagcgcgcagtgagtggagtttgggggtgggctaggggttagcggttgaatgggtgtgttaatggggggagctggaggcagagctcggggacctgggggtagggggagcgcgaaccgactgggaggggagagaaggggaggggcgcgagctggcgcaggccgcctccggggcgcgttccacggccgtgcgcgcgcgtccctcgccgccaccgccgcccggacagccctgcggccgccccgccggcggagccggggccggcctggtcctcgggcggctgcttggccaccgccaccgccgtccgaagggctcgagcccgtaagtatcccctttcgctcctcctccccgccgcttgggcgcacagccgcagcagctgctcaaatggagtggaaaacggccattgggcgacaatgagttatagattatctgctccacgttttgtacttagctgcctgtaatcttcttttgagtttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccggggccaccccagcgtcccgcccgctttgccctccggtcccgcactgtaagtggagcggggaggctgagcggctggagcgagttcgggggaagtggacggtgggggagggcttggacgagtttttgagggttgctgttccttctcgtcagtggttaggtggtgtggggaggcgaggatgacagtaaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgttttattagtaaaatgaaaaggccacttaattagtttttaattagtctctaaaacaatagaaattttgtgattaaaagactcatttgtacacgtaggtaactgttttttatgtgctaaataaatagggaaaaagtcagcggaggatgctgaaaattaaaacctcaaatgaacttgacacaacttctgttgcaaaaagaagcttggaaaagttttttttaagtgaagattcaaatttttgtgaattctatttaaatagataattctgtttaaatattgttttgtttcaaaatttttgtatcttgtcaaacagtaaactctagtattcagttggtttattttaaaaaatatagtttatttgttcttgcttttttatgtttacagagagaacatatctttgaatttcttttaacaattcaatatccatgaatgaaaaaaagaacaagtgcttgggtcatttgggttagttatcaagtgcagatgggtcaagggggaacttttatcttcaatttcttgggaagaattagttttatttatttgacttaagaatttacaaaacttaattctaagatggaaatgaatttcaggggagacttttttggagatgtaagctcatattttttatagttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggttaaaaaaaaaaaaaaaggccacattgatgtaattgctattattgcacttaagttgctgttaactagtctgctttgaatgcagagtgttataaagaaaacaacattatcctttacagctattagtgataatctaaaaattgtcttgaaaacattgctcttcactttatgtgagggtgatcttgaattcagtaaatctctaaaggtgcaaaatgtagtgaaaagaagatttttcaacatttagatgacaaaattggactacttagggaaaaattaatgtgttgtagaagaacttcagctgccattttcaatcactgggttactatgtgttggcaacagaaaacgaatttagaaatggagatagctctgggagcaggtagttggggaaatcagaatattgaatcatgtggggtagaacaaaccaattacttcaagttttgacttgagaatttccaataagtataattttttccaggcttttgactgtctgctttattaatggactaacatcaaagcaggcaacaaaacttccaaatgttataaaaactaatgtaaatatacagatctcacatgcagtaatacaagtctaaatttaagacaaacagttggggtttttactgctgcaattttcacaatcagcagaaacattaacaccaggcttctgggtgtttccttttttgaaatgagctagaagagagctttaaaactaaggtttacttagggttaatctttatttgatcattattgaagctttctgtgtttcattaaatttaaaatagcgttttagtatcttaatataagaatatgtgaattgagattgagatgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaaattcagacacagggattacaccttaatctttgaatttcagtgttgaaattagttatcttaaaagaagcctatttaaggctaaaaagtctttggaggactttttttgcggtagatttagtactttaataaaaacagaaatatattgttaaaaattgggtaggttaggcagatgttaacttcctgaaatatgtgaccaagtcttaattctgttttaaaatgcattaagtaacatttatatatatttttaaatctgataaaaaaagagatggagataaaaatgaactattagttcttggctatgagagatgggagaagttgaaaagatggttaactttagacttagcatcaattcaagcacatgttaatttgttagaacaaaaccagatacaatcctgtctttttttctgaatgaataagaaaaatcttcagccatcatactagcgaagaaggatgcaccatgaggttcctaataaaaatgggcttaattttgctattttcaattgttaggtagtacttgttaacccctttcttggtcacacatatgtacatacataaacacacattttatagtctgtttctctgtatatatcaatacttgttgtttattgttggctaaaaattaggaagttcaaaatgtaaaatatgtatgattaagatatctcttttaaaactgattttgaaaatggtatgacataaatatctgttttgctgtcaaatatatctatatctcctgcctgtggactgagaaatgcttgtactatccacactttgcctccttttataggtatttttacatcagtccacacctcaagctagttattactctggatttagatgacagcataatctaacctcaattactgtcaaaaatggcacttgactgctgggggtgggttaggtgaccttgttttgactaatgctttctcttgaagatgatagtaaatagtgtctatttatagagcgaacaaaagagaattctgttttcttcataaagtaagttctaattctaatcatttattcttaacattgtaagtactatgacagcagttctccatataatgggcaaaccattacaagattttagataaaatttttagttgatacaatatttctgttttatgcagactacgtttacttaatcagttttcagcttcaatttacataacaaataatcatgtttaaaatgagtttccctgtgtctttactttgaagcaaagtatttctatgtggaattattactcctttattaaactggttaccatccatacggaaattttctctgcattaaaagcctaccattttatagtgtttgctactgtggttattgattagaaattacagaacacatttcttatgtaccattttctccactcatctttgtgttcttaatgtcaggatgcttatggcgtattttagttcttacaattcctgactttcctatggttaaaatctaagacattttgggaaacattaattttgataatattctatgcttatgtatttttgtcctagtaattgtacatttttttttagtttgatgaaggcttaatgtattaaatgacagaagatatactgaagattcgtgtactgaaaataatacatctctccaatattaaagagatgagcataattctaaaacacgtcactttgcctcatatgcgtcgacaaataaaaattacactaaaattataatgtcctagacatgttcacttttactaaggacatataacttttttgcgcttttcagagttctctctgtcacaaagaagacaatgtttgaatattaggtgcttcctcttgatagctcaatagatgaataaataggaatgttctcccactttgctttttctactacaagtgctatgatacccatagcctgcacggaaatgacttttcatattgttacgggttttaaactagatctacagcctgaatatctaaaaatgtacatgaaacaaaatttgattactttttcttaagcagaaaaccccacaaaaaacactgctgatttgctgttgctgttcctcttacctcatttgtttcattgggaaaagatataactgatacctcagtatgatatttctgtatgttttagcatatcttataattttcctttgttcaataagaaccttagttttaaaaagtcacttcttataagcctgtcagttcatttctaggtaagtcaaactggctttgcctcagatttccagtcagtatttacatgttatcaaggtgatatgtttatgttggaaccgagacattttaagggagagaggggcatcagcgttctgcagcaacacgttttttataacacgttgcccccgagacttagaaactgttcttaactttctgttttttgctcccttggcagagatacatcacatcatatctctgtatacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgaccactaaacatatcaaagtgtattacattcctctacatttaattaatagaccagattagatgagttgcatatgtgcttttctaaacagaaaaacgatcgctttggcttaatgacttttacttgcaataatggacatgagttcaatgacattaaaacacgggaactactaataaggacctactattacatgatttagaaaactgctgactaacttgggaaaaaaatgaatgcaggcagaatagacagtacttgattgaaacctgaattctgtttatgactctgtgccagctgaatttctaaggaattgtaagccagatacttagggaagtacttgagagtttttcattcgggtgtttaggtaagcaggatgataagcttttagaggcatttggatattttttagtgagtagaatttttcatatttcctgcatacacttatttgtgccaggaaatttaatgataggatattatattacattttattaaaaaatcaattccagtcttttcatttttccattttggtatagtaacattattttagaatttgcttgttggttggtaaaaaatagaaaggttattatccattatgtatctttggaaagagatgtaatagttcatttctcttattttatcaagtaataatatgacaaaaatatttattttgcattttaaaaagcttcgtttcttaatgaaattccttgtttcagatttattattttagtagctaatctttactaatgtgaaaagtcacattgttactgtgacaaagaataatcctctaagtaaggaaacttgtttaataaagagatttgtggtactggtatgggcttttttataagtagtattctctcagcgtggccccgtattatcttaacaagtgtgtgccacatttatacagagcatttttataatggggtaagaatattagcaacagcaattatatttcaataggattaagatggtatgttttacaaaagtatacaaatgcttcttttccatacaattattggtagatactctttactgccaaatttatgtcattgtcttaaataatataaaaagatatttcttatcgtagctggtttttaatataataggcactgcaaaatgggatctgatgttatagttcattaccttttttccccctaatactaaaacctccttcacagtgaggtaagggttactggagatttcattccaggaaaatggttatgtgaggcacagtaactgtcatagagtgcataacttctgtgaggttactggaaaggcacagctagggtaagttctacctgttttgtcttaaatttgaaggtagactactgagcgatttttaaaatactgaaatctgaatccattgaaaagaaattgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaaactattttttttgagatacatgtttaagaagggaaaaaacccatttgttaaaattacttaatcactgagtttttatgtcatggtttagaaaatttattaatttttagtgctctttaaatcagattgttggtttaaaagatactgttattttgaccaaatataagtcaaagcggaaaggtagttgttaatactcgtgtcagaggccttaactaaaaagttagctatgttcaaggaaaagacttagtccaacattttactatttgacagagcatcatgctgtgttatctcttagtagtagttagtggcccacagtagctttggctaatgcaaaaatacctgtacttttgaaagtatttgaatttcacctcgagaaaatctttgtttcatctcgttgctctgtaggattcagataacagctacaacacagtaaggtattcaagaatacattccaaaagcacttttctatcattgtattctctgtaagaattagggttgattctcatcagagtctttattagtattattactgcttaaaatattttatagaattatggtgacagtttgtacaaatagggtgacatagaattataatgaacttgatagtcaaacataacctttacctactttaatactgtagttactccctcatacctcatgtgttttattttttactaattttcttatattgtgttactaataagaagtacctaagtcctctgacatttcagcttggaaacctgtcattggtttcttaaaattagaatagatttaaaacaatgattatttaggttaatattacatgattaaaacatccgataacgaagcataagtatcttagaattcacattttctggagttgcatttcttaaaaacatttgggattgatttttaataagtttaagagtatttctaaaaaaaaattagggagtaagaatgagctcttagaacaatactaaattgaatagcttgtagtgcaagcatcacttaagtatttttagaatattgaaaatcttgtagattacatacactaatggcctcattctccttattgcttgttaattctgtgaaaatcaagaggagcatatcaaggttgcagttaattcaccataatattagcttttaattgaaaataaacgaaaatatagctttgatttgttagcttattttattcaagtcagtttttcctatttataaagaataaatcaccataaactcttatgtatgtataaaattgatgttatcagatgtttatacaattgatgatattactagacatttttgcactattcttaagaatactttttattttgtatattgctttaatacttttaatatttcctcttatagaatgttttcttcagatgttttaatagtttgatattactcatttctgaatggatggttgagggcctttttcttttttaaaaaacatttttcactacttgccatgcaaactatttgatctcctaaagagaaccaggatataaatttagtaattagtatcaatgtataggtttttttatttaatgtggaattattatatggtgatgttctttggagtgttttcatgtgacttaatgtgtatttaagccctccatagttaaaaagatgtttacagtactttcatgtttggcattattcaactctttccaaagattcttttaatattttgtctgattatcatttattttaacctacaaatgctctttttatgcttgcctacttttattcaacctacaaaataaaactttattacatgtactttaccaagtccttaataagcttcagtattcagtattgccaagcacttattaaagcttcaacattttcttcctttattttgttaatggtatctcatgaatgttgaattcttagttttttggggctttttttttttcaagtatatttagggggtacaagcacagcctttttacatgcatgtactttatagtagtgtacccatcatccacataataaatgaacgttataccctctaagtaattttcacccctcacacttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataatacacatttttttaaaaaattgaagatcgttctcaattcttagtataaaaatcagaaatttgtctgggtctttaaaaatatagtacaaatatctaataatgtatttggttgtttagctgaaaggcagatgtttcagtctttggaattcaagactatattaatctaatactccttaaaccaacattttatttatagggtgtaataaaaatcataaagttaaatttgaatgagtaaaatcttgattttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagtccttggtgagaggcaatggcagtagacagatatgagaagttttgtaatggtgggttagaatttggcatttgattgaatgcgaggtaaaggaggagcaaagaatcaaagcccagaaccaaggttccagccaagtcttttatgtattccattagcctgctttagtggaagggagaaggaatgagcccattttctgatgatactttgagatgcatgtgttaaaagtccaaagtaccagctgctgagaaggttgatgctttgttggtatgtatatttttaaatgtggtatttgtaaaaaaaatatattttttcttccttttaaatgtttttaaatgttttcgagtgtatacctgcatatgtttttacactgcatatgtttaagtgatactaattttttttaaatactcacataaagtgaaaatttttattatgcgatattcaggctacatgatctaggtttttatttgtattttagatgagatttctagtaggtaatcaagactgtataaaagctatcgtaatctggttagaaatctttattttgctaaagaatacttttgtcattattagacctgttgagatactcttcattgttcagggccattttagtaacattcttaacagctctttaaacaagtaatttgatattctttggtttccttagataccagcctgccccttttcagaaagcttagggatatctgtgccctcgaagatttaaaaaatttcattgcaatttatcttcactgcagctttctcttttgttaccatgaacttctaatattatatatttattttattggtacgtggggaaatttccctgcttcacctgttctttaaaagagtaacaatcatttcctcaatagcttttcagctcttcatacccagcaatagttcttaggttttatagctgatactttgtatcatgttaattatgggtgacaaccctgaacaacaacccaaagcatctatcagcacctatccatcagtgattaactcagagtaggctctcaatgtattttttgaataaatgcttatcatcgattataatgaagatcacaaattgtgctggaacctaaccagttatagattccttgcatggatataagaatgataagagttacaattaaagtgttataacactgagttgtgtgtcctaatccgaaagtattcttgcttccatatagtagagaaaattttttgtgatgcagttacagtgcttaataaagcttcatacatggaaactctcagtaaatgcttattgttgtcattattggtgtaaattaaatctgaatattagttcacatatttaagtggcccttttggtatccgttttcactcttcagattttttttctctcattttttggggggaagactcttctttttttcaatgctgctcaagattttctattttttaaattagagaattttctattattgttgctaccttccttagatgataaatcagtagcaagctgactggtttttatcaaaattgatgttctgatattgagaacaggaagtgttgatgttgacctgtctgtctgaaaaaaaaaaacaaaaaaccccacaatattctgcttacactttcactgggcaattatgtaaaaaagatcagtagtttttccttgttttacttttataatctgatgcctggtgaaataaccacacagaaaacatgcaagtaggaatcttttgtagttctccatggcctataatccctgcccccaaatcatgccaagcattaggatccgcccatgtattaacagctttaagaggaagtcagtagaggatccttgtcagaattgtcctggtgtgtgatggcttgctgcttttttatgaaaggatcagtcatgccgaagacatagctatgcataaggtaatcagcatgaaataaagggaagttaattaaatatggttgtcaatactgtagttgtgaattttatttaactagttaaggaaactaaaaatatgacatccttaaaaagacatttttaatgtttataagataaaatacgtaaagaaagttttgacaatcttaacaagtccattgtcaaactattaccaggctgtgtaaccatctagttacttagcaacctaagtgaagcaatagcatttaatattttgtataaattttcagcaaaggcggcccaaatttttagcattagagacattttctgatatgcagggagctcttcctccacagttcctttctttagtgggtcattacataccacaggtggattatgtttatcttttaatggtgaaatgatagtttttctttggtggaggagctggttatctgtcttccaaaatgtcttctggtgacttgtattaagatcttattaaaatatcattgtgttcttgcattcacagcagaagactactgtaaattgcattatatgaaactgaataatatctatggtttaatttaaagtagaaataaaatctaaattcatacattcgagctgtagggtttcaagattttaatttggtgaaatgccggaacaatttcttatatttaatttgaggagtattacatgagaagtgcatcttatcaaattaggaaagaaacatatactatttacacagtctaattattaaagcatgttaaatttcacagttaatattcagatatctttctgtaaatgagttgctgagatttattgtcaatgttgtttgatttgtaaagtccattaagttgcaaatgctgatttgaggaatggtggcaagttaggatttcaaagtagccatgtttttttcagtaggctctgtaaatcattaatactaaaaagaaataacctgcaatgctgtgtgcattataggtaatatcagaaactttttttttttttttgcaaagcatagctgaagtttaattcccagtgtggaatgtattagtttttcgtatagaggtgagatagcccacaattggctgttgaactggagtgccgttgtctgtcttataattttggaggagaaaaaaaaatatgattttaatttttacattctttgttttgaaagatgataaaagtgttttctacacatgtttcccgctatcagaaaaaaatcactgttaagaggatattgctgatggaaacaatgttttctcaagttcagaatattgctagggaaatatgtagatgtggaaggctaccttgttaagaagttgtgcaagaaaaaaatctttaatttttatattttgatttataatttaatttttatattttaatattaaaattctaatatttttagtgtactttgaaaatgtccaatttgtacatttatataatccctgggttttatttttatttttaaaattttatttatttttacttctttttaatatgaggtcttgctcggtcatctaggctatagtgcagtggtacagtcatagctcactgcagcctcagacttctaggctctagctatcctcccgcctctgcctcttgagtatctagggctataggcctgcgccaccacactttgtaacacagtttttatttaatagcaaaattagcaagtatatttaatatagtttcatataatttcacattttgagataagtttgaaattattataaattgtttttgtagatactattaaattcctaaacttcatggaggaattattctactggatttgggcctgagttgcagattttgtttctgcagtaattatgggcctttctatttcttcatttttataatgaggagactctggttttaaaaactctttcttgaggggtttaatgatgaaaatgataaggtattgtatgtcaaacaatgataaattaaaacttccagaagaagtagtcatttttgttttctgccttatagattgacactctttaatatttaagtgtttaattaaaaaatagtctggcatagaaaaaaatcttgaaaatctctatttaggaggtctccgagttagttcccagttttttttttttaatttaactttcttacaccaacaagcaaagatgaaagtttccagttttaaaaaattctgtttcacacgagtttctgaattccatccactttgctttattctttccactattcatgttagtttccgtaattcagttcatttattcatgcctgcctcccttcctctctccttcccgttttttctctccttccttccttccttcttccctccctccttccctccttccttccctcccccctccctctttccttccctccccctcttcctgtctccctccttccccctacctctgtccctctctccctcctatgtttcttattgtcaaaaacatttattatgtgctagctctttgtcaggcactatgcatgggttatactcactggtaaggtagcactgaagtgatagacatgaaagccatctttcatcataactgtgttcagttagctcaccatcttttgaaaatgttacattgtgatagggatgagcactctgtactatggacaaaaatgacactgtacccctgatgtgtggtggaggtttagggaaccagtcagttagacagtcaagtgatggacccaactgagtcttggaaaaggaacagtagttagccaagggacaagtggcagaggagattccaggcagaaggaacagtataactataccaagaaaggtatagaagtgagagtaagcttctatgacccaagaacataagagcaaattaaataatatttaaaaaagaaaaccacgaagttaaaaaaggatggtcttcctcaagtgtagatatatttgctaaaaaataaatatttcaaaaatttaaatattttccagaaagtttgttaatatatttgatgtgtttttttaattaccaggatattatactagtcatcagaatcacaaagtgataagcgaaagtcatggtccataaggagcacttactctcttaattacattacataaattcgtgacattacttgtgcatttgtgtcatttctgtatcttctgaatcattgtattacttgcagtttaagcctcagtgccttgaacaaagtatgtacccaaaaaattttttaggcttggtttgaaaagatttatcttgaagaaagataaacatagaaaatttcaataaaagacattttatttattcatttatttatagacaaggtctttctctttgttgtccaggctggagtacagtggcctgatcatagctcactgtagcgtggaactcctgggctcaagcgatccttccatctcagcctcccaagaagctggaactacaggcacatgccaccatgcccagctattttttttaattttttgtagagatggagtctcttaatttgcctagactgaacttgaactcctgggctcaagccatcctcctgccttggctccccaaattgctgggatttacaggcatgagccactgcacctggctgcaaaagacattttaaaactagtttaaaagcttaattgaagaggactcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctctctctctctctctgtctttcagattttcaattaccattcccctttcattccagccccagttgcaactttcttgttgttaaaatacatacaatagggctgggcgcagtggctcaagcctgtaacaccagcagtttgggaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatgagtcaccgcacctggccagaccctgtctccaaaaaaaaaaaaaaaaaaaagacatactagatttgttgtgctaagttagagtgaaataataatacatgtacttttggagacattttagaaacatttctgagatcaacctttgtcaagtcagaaccccaactgtgttcttccatgtaaaattatttttagagtttgttccagttttatacacatttatggtttagggtgaaattaggaagattactagaggctggcaagatggatggaaggtgataaatcagctttgagatttttgcagatgttcagaaagaaagatgttaggacagagggattgaaagcaatgggaagaggattaaggtatttcagggtaagaatcaatagaacagtgaatgtgtacctctttaaaatgaagtaccttttgtattgacagagctatattttacccaaacttaagatgaataatgctccagaggatttttggtttcaaaactattggagactaggctaatttcatttgtttgtgtgtgtatccatgcatacatgcacatatatatttagtaagcttggtttaaagaaaatctgttacttcatagtagatgtgattttcttttaccatttcacactaatgcatttctttgttattataagttagcaattgaaggttatatgtataattcatgctaaattagtatattggtctagaaggtttttcaggagactaataatggagtagaggcttctttaatacatatgactatataaaacattattaatattaacagatgttgcactttaatcccctagaatgactggtaccagcaggagatttattaagcctgaattgtgtgaaattgtgtgtgcataagctgcaacttagactgtaaaaatgctactgaaaactgttaaaaagatttagctataatttggcagagaagtattaactgtgctaaaagaagtatgtgtgtatggttggcccttcgccttaacctttttatcatttatcttcttgtattaatgtcactgaattattaattcatgagccaggatgggaagggtgaaggcaccatttaaatgtgtggcaaatttatccttatcgccagagacatgaaaaaagtcattttgtgttatctgtaaaatggaaaggacattttaaaatttcatttacagtaatccacttcacttccagtcaaacacctagattattactaccataatataatgttattaaaaatttgtaaccttctccactcttttgtcttatatatataatgttgatagaaaaatttagccttgatttatttcagtgtgatacttgttaattgtaggttaaaaatgttacttttacgaatgatatgttatagtttgacttaaattttaaggaacagtagacttatgaaaaataaaaaatatttactgtaataataacaatcaggatattttcattgaggggagtccgcatatagggaattggaaagctctaaatatatgtttcaaagaaatgtttgcatttattgtgacttcataattatttggaataagattggtgatgttggccttgtggaacttttagcattatacaagaaacttagcaaattagaatttagcatttacttgttgaatgtaatgtggatctgggatatatccagtatttcatatggataagtagctatggtgacaggaatttcaagagtttgaagccacttttaccagcagctcttcgaaaccatcatgctaatggaagaatacctcaggggtcttgtccaaacctcatcacttttcattctcccgttatttactattttgattggttttatatactctcatgccaaacaaagtagtaagataagttactgtggtaatgtcctttgttttcttttctagaatttctccccgaacactctaaggtatacatatggctctgttatacacacactgaaaacacgaattgttttttttgagatagaatctctcttcgtcacctgggctggattgcagtggtgcgatcttggcgcactacaccctcagcctccccacttcaagcatttctcttgcctcagcctccagggtagctgggattacaggtggtgccaccacgcctggctaatttttgcatttttagtagagatgggatttcaccaagttgtccaggctggtctcgaactcctgacctcagccaatccaccggcctcggactcccaaagtgctaggattacaggtgtgagccactgcacctggcctgaaactctaatttgttttgatcagtaaataatgctactttgtttttcttattctagtatggttaatttacctttacattaacatttaaattaatttcttaaaataatagactaaagttgatttgattattttggcagacatgaatagttattagttcattatgtgactgaactgcatccagttatcttggtcttaggattgttcatctataaacaggggttgggcaaactatggctagccatcagttttgtaagtaaagttgtattggcacacagccaatgtcatttcggtatgcattgcctgtggcacctttcacactacagtggcagacatacatagttatggcacagaccatatcactcttaaagcctaaaatattttctgtctggtcctccatagaaagagttacctaacttctgatctgactgtctcaatctgcataaaatgttggttctaatccttacaaatgtagtggaatataattgataattttaagctcaagagattggaaaattcagtagtttttatcatcattggaaatgtttttttttaagcagatttttgcttttctttatatgtggagtagcaataataagtgatatttttcctgaaagttttctgaattgaaacattttaaaaaccattaaaatgttgcaaaaatacattagtctgttaccacatgaaggactcttggcaagtaattcaagcttctagtcatttttctctgctttttataacctatgtttcttttttattaaatgtcactgctttattactactttaatgttatttgaaattttaataggttataaaattatattttaaagttgaaaaagctcttttctaaaaaccacatacctctcctactccatgtttgagtagttaagaagcactaaaacataaattttaatttaatggaagaccttttggtttttaattttttcatacctaacagccactcaaaatgacacagtctgttactgtttcttaataggtgtgtccatgaatatttttcttaccgtctcatctaaatctcctcatatttttttttttcattttttttgggacgaagtcttgctcttgttgcctgggctagagtgcagtggcgctatcttggctcactgcaacctcctcctcctgggtttaagcaattctcctgcctcagcctcccgagtagctgggattacaggcgcctgccaccatgcctggctaatttttgtgtttttagtagagacggggtttcaccgcattggccaagctggtctcgaactcctgacctcaggcaatccacctgccttggcctcccaaagtgctgagattacaggtgtgatacatctcctaatattcttagaggaatcagctacaccaaacacagagtttcaggctgacatgggaagccaaagaatctattctgttcattcacttagactctagctttatctttagtactattaattaagttaattatttagaaataattggtatattccttttctgtacaactcaagaaaatccttttgttttgagttttacttgtagacacagatataaatggtatggaacatttggcataatcgggactaaccccagctaaggcatagaaacttgttctttcttaaagaagtccctgatgttgttttgaattttcgttatctgtagttttcccaggaaggcagagtgtgaaatatgtgagctaaatgcttcaggttattataatattcctgtcaatataataatctataagtagatttcaaaaacaaagattttctgaaacagttgcttctttttaagatatgaattagaataattgccgagacatattttgatagaagagacaagtccttagttaaacatattgcagaagcccccagatggcttccttaacattacttaaggtagaatcaggaccataaatttatcattgggaaaattggaaaatgattgaatcatagatttataatctcttcctacccttatatagttgctgaacttgagacctagatgcttgctactgcagtccttgtaggggcaggttgagccacgattctatagtgtgcacttgatctggatcttgacctcttcattaagatgactgattgatctaggtacacgtctcaaggaaacacagatccagaaactgctgttagttacttctcttagcttctcatcacatttactaccattaagttttgggaggtttagtaattattatttaatgcttattttggatcttggtcattttcttgcatatttaattctcataagattattaatttcttgaaggtggcagctatatcttaatctgttttataatgcctttagaacctaacacaggaccagttaatacagaaggtaaaaaaaattaatgaataacactcgttttagcactggatatccattaaaaatgtgtaggaagtactcactggatattcattgacttgactggacatacatgaaagtatagtgctaatgtgatctactttatgttaaaggcaagaaatgtaagtttagataacactatattgacatagtttgcaaatgaattgtatcatttaattacaaaggcaatgtgctatagcacttcacaaaacttcagcttcttactgtgtattctttatagttaatttttcacatatatctatattttattttatttttttgagatggagtctcgctctgtctcctgggctggagtgcagtggcctcatctctgctcactgcaacctccaccttccgggttcaagcgattctcctgcctcagcctcctgagtagctgggattacaagtgcccgccaccacgcctggcaaatttttgtattttagtagagacggggtttcgccacattggccaggctggtctcgaactcctgacctcaggtgatccacccgcctctgcctcccaaagtgctgggattacaggcgtgagccaccgcgcctggccaatttttcatatttatttttaagatcatttgatgtattttactcagattacctcattacctctaagaaacctctgatggtgatattgatgatctaatatatgacagatcctgggtcattattatttcatttagtggttgtatatatagaccaagagggaatttgaatattgattcggggaatggccagtaacggtgatttatgaacaaaggatccagtgcagtgagccaaacataagattgcatcttatgagtgagccacgttgagttttttctgttatacttacccgaatgatgattagtccataatcttgtagatgttaatattaaaacctttgttccatgactattaaagatacattgctagttatattggaggaaatatttatgtatttattctttggacttactatgaacaacttctctagtagtttggttgataaaatttatcagtgtaattagttatataatttaggcactttagtaatataaatgagtaaattaggatagctcaactggaaatagtaaaaattaagttaatatttagctgttattacctaagggatgtttagctcatgtaaacattttaaaaatcaactcgctattcttttggtgtttcctcacttttgtatctcaagatgattttgttctgtattcatttttttattctaaaggaaaagatagtaaaataaggttatctggtctacataattagtaacagtagtgattttagaacatgggcttatttctcagcccttctgcttgcttactttccttgagtaggttaagttttctgcttttaagataaaatggatatatttcttaaggttgttgggaaaattgcatggaagagtaagcacactgttatctacctagtttagctgtaatttttttgggagcctaactgtgtgcaaggcagttacaggtttttactaggacgagttatttttaaagtacagtgtaatctccctgtggatgagaaattttgtttctttttttcctcagtacacaacatatgtaataggtgctcagtaaatatttgttgaaggaataatttggtgaatagtggaaagaatggctttgtagatagccttgattgggatctaagctctgctgcttattagctgagtaatttcagttgagttattttacctctcggagcctcagatttctgacctttataatactgatcttgcttttttggtaaggattagtgatatgtatcttacagtatttcagacaacacagaagttagctttttcccaatttgaggtaaataaaaagttatttttaaatggcagtcctctccaattttaagacattgtatttcctccgaactttcttttcttctttttgatatggagtctcactgtgtcacccaggctggagtgcagcggcacgatctcggctcactgcaacctccacctctcgggttcaagcaattctccttccttagcctcctgtgtagctgggattacaggcatgcaccaccatgtccagctaattttttgtgtatttttagtagagacggggtttcaccatgttggtcaggctggtctcgaactcctgacctcgtgatccacctgccttggcctcccaaagttctgggattacaggagtgagccaccttgcccggcctgaactttctaatagtctagagtcctcaggcagtttttttgaattgaattacaagtaccatgactagaaatatttcctgagtgtctactatgtctgcgaaacgaagaaattttagtaaagggtaagaccagtgatgaatattaaggggacttctgtataaatagtttaattaatgtcctctagacttgatagcagtgcctgcagaaagaaaatgaagaaagagggtggtgactagtggctggccacgtggttttaaaatctctgtgagcattgccagccccagccctatccatgtgaagaaaagaaaataaactcaaacctcaaagaatgctgaatgtctgaagcttctaagaaagcctttctgattagggatagcaagggtttgcttagctgacttactgaaggaaaactcccaggggtaatgatgtgttctctgatgttaagaaggggaaatctagtctgtaaagattacacataaaatatttctgaaaagtgaataacctgattgaggttcagctaaagtgaaataaaactataatttattttttcattttctgagcctttgcacagaaaatgaaaaggcagaattgggttagtgtcatccttttttgtgtttgtttgttttggtaaaatacagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatatttgattatttattcgttctattcttagctgattgtggtttgttaggtatttcaactttcattaacatttgtttaatggaaggttgtttaaaacttgggtcacagcagtaaaatcttttgatttagtttccaaattgcacttaaagcttgaggttttggaaataattttatttgatgtaaaagcgattgggcacaggttgtagaatgataaaaataaatttgacttttttttttacttattcattacacaggcagattgacttaagctttatttttgtaaaagaagccatgattttatacattctagaacctgtttccatttgtcagaaacaaccacttacatggtctcataattgaatgatatgtatttttaaaattgtgtttcacattctcaaaccttcagaatacactgaatttttagtatataaaaattttcataagatattctttcctggccaaagaccacaatagaggtcttgattgtgtggtttcctcctcctttttcccttcacgaacagaggttttcctatcttggcagctgtttcctacaaagcagtcatcagtccctgatttcttccttcctcctccttcccacaaacaagggctctttgaatagtggatgactgaagacagactgatcttggatcactttaagaaagtggaaacgtgtgcaagagttgagcatgtgggcaagctgcctgtaggcactagctcattcaaatcaaacaatgaaaacttggacagtaaaaattctttgcttggaatctagagtggtccaaaggctgacttaattttacttgcagcacttcatccacgcgtttacattattctgattgcttgatcagatcatcgaacagactgtaagaatataagaaattgttcattgatggccttttaaatgtgacaagccatgagattatctgactttttaaaatgctttatgtagaataactttcaggtttaaggcaggcacattgctacagcagttgtaaactgcaggttcacttttggttttggttacctttgaatagtctatgggagctcagagtgaaaaatgtacagagccagccagctagttttgcagggatgcgtgccatgtgtctccatcagattaattttggatacatcattctttttgaggaagtttgcattttcctttgtttctttggacagataagcatctgaggtgttcttaaatggcataatactgatgttggtgatgcctccctctcccctgtgtcttcagtgctttcagagagagagctaaaacttgggccaattctgggtcatagagggatccttagggaagcatttacatctctgaaactgtgggcctgaatgatttcagattaatttcttacattatttttgttgtgttcttaataaagcaagatagtacctttataggtaataagtgtttcaaaccatttaacatctgcctgcttttccaatcaggttacattataatgaactgatagtagaatgtagtgtactgctaatagcatcccgtgtgataagctacatgaagcatgtagtaaatgcacagtaggtcagataatgtgcaagaactcaaaagttatcaggaaaattttgttttctaaattttctttatggtttagtgacagcatcgaaatgatgtaatgagtttgttttactgagttatgtatgcaacctcagaaagggagggaagagttccctccctgctgcactttgtaaaactctttagttgcagcaggttaaggataactggagaaaacttggtgtaagagtattatgtagaataaaataataggaaacgaacatgaagaaactgtaagatgttcctttaacagaaaagtttgtgatttcctttccctcagaggctaaatgaggaggctggatatatttgggaaatgccttcattttatgtgcattataaggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataattctaaaactcctaagttaaaatatgtagtcttttatgaaaacttacattttaataatagttcatctttttatgttgtttatatctttagctgtatatgtgtgtgtatatgtatattctttgtaatgttaaatttgcagaaatataactatttctttgtacttaaaaatagatgtggaatttttcttaagcactattgcattaaacatttttaaaatctaggaatagtaatgagtgtatttttcaagacagacctgatttttaaagaaataaatatacttttgaagcctaatgaaataattggaaccatcatttattaactatatagatttctggaatccattgttttcttagtcttaaatattatttccacatgaaaacaacacacatgcaggtgttttttagagcaggctagaagttaatatggagctaagatgtataaattttatagctagttgatagtggcagttattggcacgaaaatgtattaatcttgtaaagtttgtgaagggtataaaatctctgagaaatgcatataaattataatggattttaaaaaattccaattcttgaaaaaatgtttaagaattaaaaaattgattttatatgtacttttaagtgatctcacttataccgattattaaaatgataggtggagaaggggcatactgtcaactaatagaagtgtattattccgttgtctgtgtaataagcttcaaaatgttaacgttttaattttgctgaaagaattttacttgaattgcttgttccaaagttatattttatcatgttctccttgtccctccagtcccctacgttcagtatattgatatgatgtaatataatttaaataaataacaaatttagaaatacttaaaataagagtttctgtattcagaaagtaaatagtgttcacttggatttaagtcacacttggcagttacaatctttgggttaatattttattttcagatgacattgctctttgctttagaattgaagatgcatcatatctaacatcatatgtaatctgtgtgaatgaataatactatcataaacagtgaacaggaattgtgtttaataatataaatttctggcttggattgttgtgaaaatcttgtgtgtagtctgatgattttacatctcgtttttggggaagaaaacctaactgaattcctgctgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatccaggtcactgcaaatgctgttaattcattcctttttatggctgagtagtattccatcatatatatatatgtatttttttcatcatatatatatattttccatcatatatatatatattttccatcatatatatatgttttccatcatatatatatgttttccatcatatatatatatattttccatcatatatatatattttccatcatatatatatatattttccatcatatatatatgatggaatatatatatataatatatatataaatacacacaacacacacatcacagttcctttatccactcgttgattgatgggcatttgggttggttccacgattttgcagttgtgctgctgtaaccatgcatgaaggcatgattcttactcttgagaagctcatggtcttgtgcagggattgaaaccttaaatacttgttggtgccttgagaacattcgacttgaggtcagacaagaaagtgcttgtcagaggacctgtgattaccattccagtatttagcttggtttttccagtcttctgactttcagtagaaatcaaacattaggatttttaagtaatggcaactaattaagattttgtttaaaaaacaagcgtgtataccatagaatagccatgggttatgcctttccttttagatctttttttttcctcctgttacagttgtattttaccttggtacatgattttaaaggcttcacataattttggatttgctttacatcggtacataatgagacatacatttccaaattcataaggacttactctgtgttcaggcaaacattataaatgtcatattttgtgtacacatacaggggcaaatcactaagcatttttaaagtttgaacatggcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcattcctccttttttctttcattctttgatttacacacgcatataacaaaatctgtacatatatacacatatttgtgtatatatgtgcacgcgcatacacgtgcacacacacacaacatgcagtatgctagtttcataagggcagggatgttttgttgttgttcactgatgtcttcaagtgcctgaacaatgcctggcttatactaagcactcaatccatagctgtcacataaatagaataaatctttgaagaggttcatagtctgtataatgagggaaaagacaatgagcagttgtaataagagtgtgataagtgccataataatgatattcacagaggcattgggatgagcgatagttggatggttgcatgtgtgttaggaaattcttgtagttggaagtgatgatacggcagaatcacctggaagatctgcggtggggcccaagcattagttaacattgctgacaaattgcagggtgatgctgatggtgttgctcagcatcacactataagagccactgcgtattctatgtgcttaggggtggttgtggtgagggtaggggtgcatgggtgtagacatggtacaactttttcaaaagtatttttggaaaaaatgatgagatgattgatcatgattcagaagttagtatccagttgtttcttgggagttagtatctgtttctttgcagattgttctttattcccctgattaggcttcttgggaataattttagtcttcagaaaaggattttttttttcttttagcgcttttttttttttttttttttttaagatggagtctcactctgtctcccaggccggaatacaatgggatgatctccgctcactgaaacctccacctcccgggttcaagggattctcctgcctcagcctcccaagtagctgggattacaggcacctgccaccatgcctgtctaacttttttatttttagtagagacggggtttcaccatattggccaggctggtctctgactcttgaccttgtgatccacccaccttggcctcccaaaggactgggattatatgcatgagacaccacacccagccttttttgctcttttcaagagtatactcagaaaaaaattttgaaaaatttacaccaaattggaaaaaaacgtatttttcctcttagggataaatgctctgtttagtagagctcttaaaactcttgtttcaatttgtctctttcactctaataccctggttcttttcttgttgagaataactacatggccaatgctgtgataacactgaattgacttactgtggggatttcagatttcccaatctaacaaaattaactacttttgttcatttcagtatatttgattagttgaagtctaggaggtaaatttttagcaaggtacttggggatttggctgtaaacctaatgggagtcacaactcccattaaattaataggaattgtgtatttgtgcctgctgcatagcaaatgtaactttattttctaaattcacaaattatgtaaattaacacccagctaaagcaatgaattttttaaaaattactattattattttttgagatggtgtcttgctgtgttgctcaggctggagtgcagtggtgtggtctcagctcactgcaacctcggcctcctgggttcaaacaattctcctgcctcagcctcccaagtaactgggactacaggcacccaccaccacgcctggctaatttttgtatttttagtagacacggggtttcaccatattggtcaggctggtctcaaactcctgaccttgtgatctacttgccttggcctcccaaagtgctgggattacaggcatgaaccactgtgcccggccaaaaaaatgattttatttaagaaaatacttaactgtattgctcttaggacactttagatattctttattttgtttcatgagaatattgtaatttgattgcagcagctttcttctccataggtagcgataattcggttttaaaaatataaatcttaatgcctttacaaattgtatgatgttgttatcttctcttgcaaaaatcaaattattataatattactatcagcattcaagatgaaggtaaatatgttacaaatgtgactcaaagttgccgaaaataaaattaagcttaatcggatacactggcatcttttcaaaagtaaatttgaattatactttggtcatcttatataccaatatttagtgtcagaatatgccatgtttcataaatgaagataaagttcaagtgcttgattgtcgatttttttttcttcccacttttcctcatgctttcttcttgattccatcctcttttgcctctttttcatttgtggaaaaactttgtttatccacagtcttcgttgattcaccagtaggtctgttgttggcggaaaaagtattgcaaacgtgtatgtcattcacaacagtcacccagcagacctcaaaaacattatattgcgtggctgtttaatttcggtaaacctccattttctgacagaaaagaccatatcaaatatttagtaaataaatttgtttttaaataataatttgctaaaagtaaaaaggttattagctcatgcatactagagtaaattttagaaataccgattttacatgcatattaggcatttacacagttatttttatagtttgaaagaaccaatagtgtattacagggagtttaattaaaagcacaggaggcatttaaagcaccttaattttgtggaactgtgattctgttaatttctcattactcattaatttcagcattgaagctcttcattttttgaattaatacactttaattttttaatatacgatagcttgtgatattagagaataagataagtgattgaacacatctgaagaccacatcagaagactattgtagaacatgctgtgtctcaaaaaactgatttatctgccatattactaagggagtgtcttactaaaacttgataccccatggtactctattttcttttcccctcctctgcaagacaaagaatgacatatgacagccatgcaagctacacatattagacatcaatttggattagtgagtatctcatggcatctttcaaccctattcctgaactccttttgtcaacttgacagaagtgattccaggagaatacctagtcccagcctcgggatctcctggctaaaatgtaaagctgagaagggaatacgtatcagcacttcaggaagcagaaacaacatttataatctcttcttatcagcatgggactctcctgagtttgacttttatgtctgccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttcttcttctttcctttttgttatatagctattttcttttgtgagaccttccattattttatgcttaaaaatgtatatcttgatctcagttaaatatttattcattacatttccctgtagctcttaaatatttttatttaaattttgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttctccagttggaaggaagggaaatggaacccattgcactggtaggaaggctcattcagggaagtaaagaatgtgtattaggatccagagagaggaaagattcaggaagagatgtgtacagccgcagaagaaagatgatggaggtcatgctgggctttaaacatcttatttatctagaatagtgcccctcaaaagttaatgtgcatataaatcactcagggatcttgttaaaatgtagattcttgcttcagtaatctgggatggaccttctgagtctgcatttctaataagctcccaggtgatgctaaggttgctggtctgtaagataatgtctgtattagggagttttggttattaaaatgtttggtctagaaaatgagagtttacatgacagtgacttccgctgttaaaaatcgaggtttgttttaaacccaaacaaccatagttgaaatatagaaataacatcactttcagttgtataactcattttattaaaaaaggaactaagctaccttgaaactttactgaacatttttatattttgtggcacttctaatcctattttatatgccttctattgaccttttatgtggtgagttgctttgaaaaatccctgagtaacaatgcagcctgaccctttctccctaatatttccctctattccctattgatctgtcatactttcattctatcatacacagaaacagtgtttttaacagcattttaatacaaatgttttattatttaaagtaacactataaagtcatgtaatgcaaagtgtatgtttgtcttatttagaaaaagtttatttttattatactaatttttcaaagtcaacatatttaatcaactaataattgttgtttttgcctaagtattaattccttggcttatcagcaccataagagtataggatggaagtacttgattgttaactggtcattaaaaatggctaaatatgttttatctgccttaggttatctagtgatttttccactttttagtattgtatagaatcaaagattttcttcttcttagtggacacaatctccttttcccttttctttcagaggcaaagatatagggtactgatatgatttgttttaattttacgataataccaattataaagtaaatttatttcttaatgaattttattagactcttcaggctcttaaaccactcaaaagtaagttagtagcaaattttaaaaatagagactcctatataggtacctgagaggtcgaagtatttttattttgatttttttggtggaattaaagaattttggactttgaatcacagcttggatattagtagtgtagaatttttcattttacagatgaagaaactaaggcctgcagattgttcctttgtcaagctctacttaactgccagtccagttttcttgctgtagaactttatatttagcttcagatcattagtatattttcctatctcagcaggctgttactcaagaatatttaaagtatactttatattgcttaacattgcattacttaatggtaattatcaaacgagctaattatgtcagttttcttaatgtttattaccattttagatgaaaaactatgttaagatttgttttttagtgaaaattatgtagagtacaggaggaccaatcatgctaacacttcaactttcaaataatcttccaaagtttacagccataagcatatattttttaaaaagcacaatttatctttgaagttaccagctattgctgagaaccattaactgtcagaacaccgaaaacctgtaacaattataacaagaattgtaactcttactatgtttagttatcagtccacacagattatcagtcatcattaaaacagttaaaaggcatgctcctcctgagcccctccttcaggtatgtgttttggacattatcttttcccttttgtttgcttacaacaggaagctcgtttaatcctttgctttgttttagaggtaagcaaatagcaaccatccctgttagctttcaaaagctcttacttttgttgcattaatggcactcactgtagattgtgtgatcttgctttatttaccagaaagcttgcctttgagagctgtcactccattctttcaacaatgttgttaattgactgatagcactgattgagtggaaaaccttcagtgacaaaagactggatataggtgtgagtccatttgaaaggctggtgaatctttgcttcttaatcccatttctatttgcactgaaatactaaatacagcctagaagaacaaagcatatttaaaagcattcagaaatgttaagcaacaataaaaccccgtaaccatttaaatgacagcagctgactatttgaattaactttgtgtttggcttaatttggggccctaattattcctaacttacgtgagtagatttcaattatagtatcctgcagggatttgtagctaaggcaactaaaagaatcattttacataaagtacttttgttcaactgattagacaagttaaaacgtaatgatgtaaaattgaaacccttctggcaaggtccaaacaaatggttctagtaattttgtccaaaaaagattaatctaagtttgattttaaatactattttggtcttttaggacgattgactttcctgtaatactgataagtatataaaaatgccttaagattgcatgttttggtaaaggagtaagactttaaaggtgaggacaaatttgtcacagtggatggacaccttcctaagtaatgtttatttgctttataatcttcgatacacagtttgacagctttaaatgcatagatttagaagataaatacatacaaataacgtgaatgactagtacctatttaattctgtattttggaatacatttcagttgaacacagatcagaggctcatttatggatttgaaatgctatataccaagaagggacacaacatggttgacattgtgctatagtcagtggacagactgtttgactcgtcctgccgaaatactcctccccactacaaacagccacattaattttaaacacctttaccagaatgaaagctactttaaacttaattactggtgctggagcacaatattaaaaaaagcattagccagcatccatagatcattttgaggcttaaccatagcatttcactggagtcttacagctgtctaatatcagtctattgtagtgagtgaagttaagaggcagcaactctgttctatgtcttgtcttagcactgctttaagttctcttcgttgtcttctttctccccctcctcctcttttaccccttctttcagtttttgaatatctacaacatgtgagtcattgtcttttcacacttgatattttcattatttcctttaagctagtcaattctatgacctgtttttcactaagtgaaacaaaatctaaaaggcatggtgtgaagttcacagacctcacctttttgacttcaaagtgaggttttcctcccatagcacaaatgaagctatataactgcttcttgaaaacaatgtcaataaattcattctttgacctattcagttcctttttgttctttagtatactttttgaaagctagtaacctttaggaggctttttctaatctaaacaggaatcctctgaatttatatagcaacacagtacaatacagtaagccacaagtagttattgaacactggaaatgtgactaatgtgactgagaaaatacatttttattggtcagagcaattttataggtacttctttcctgtaaggctttgttgttgttgctgttgttacctctttacacctcctttatatgtttcagctaattcattgaagttaagcacaatgttttatttatttctgtatttttcatagtgcttaggcattcaaaactattttaaatgattgagaagcacattcaaagagacttagtaccaaagctacattttaaatatatacttaatttatagggcagggatttcactaatgatcacccaaaaaccaatatggttagtttatgaatatcgaaaacaaaggagtgtccatgcatgcatagtgtatatcttgcaggaattcagcccttaggattaacagctaagtatactttaagcatattttaataattatagcaagccctagttatttactgcagcctcaattcttattaggagattttgatagttgtttaaattatttggatggtaataacctacactgaagtcagctaacgttggcttctcttccctaaatatggaacttccttcttaaaatccattgatgaacccagctaatattgccatttgctttttatggtttgagaatatgttttagagtataagtaattatgaaggtatcagttaaaaatgatgagtaatgaatatctctagtcatttcgaaaattcttgtgatcttgtcttgtgaattctttagtaactagaaaatcctctgtgattttagcttaaatataaggaggacattttatcttcataatgggtaatgatgtattttattataatgatattttatatagatttatacatcacacctgaaaatatattacttttttggttcttaatgacttttggctctttttcttaattactttactgttaatattaaaatgtttatagcttgtaatttataaaaattcgtagcttttttggggaaattgtcataaaatgccacttaaatttgtgtgtgtgtgtgtgtgtgtgtgtgtgtatgtgtatgtattctggctgtcagaatttcttattttccacgtacgtttgcaaatgaatttctgatttaccattctgtctctgggtctaatttagaaaaagaagtagtaaattctatgtttagtagaaattgaggtaaatgcagagtacaactataggattttttttatatattaattttgaagaggaaagcatctgacttagaatggcgaattaaaaaattattatattctgtacaatgatgaactattctagcttcaagtacttggtaactaaaatgtttgctcagtaaacgtaagaatttttcattgacatattcagcatggatttgaggtttcagaagtgctagtttctaatcctaacatctaatggttcattaccacctcgttttaaaacaatagtgatatctctcaaatgaaagcattattttgtcagactttattcctgcatggtttacatttgttttagaaagtcagtccactttaaaaatgaaagtttggtaccagtgaaagtagctgaaaagaatgtattgctgtttgataagtcaaatagaagaggagtgttagaacagatgaaaaaccttccaggtaaccgcctggtaagagaaagatggaaagatatagcttcttttcggaagagatacttatgaatctaatctgagatgtatgtgggaaaaaaatttttaaaaagctgtattctgtaagcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacggcaaaaaagtggaggttggtgtttttaagaaaactggaacattttattaggttttatctttgaatctctttaaaaactttatgatttgcaacctatgtgaataagcagtgaaattttcaaagactgtaaaaaatgaaagcaaataaagtattaataaagaaatattaaagatgatttttttgtttcttcgagctttgtggtcttactggaaagatttactataacatgatataaggttaaggtttttatttttctgtcatttttttctaagaaattgtttcataatatactatgatgtttgagaacaaaattgagaattttatgctttataaatttgtatcacaagatgttactaaatactgctcaaattaaagcagtatttgagcagtatgctcaaattgaagcatttataactgttacctttcttgaaatttaataagttggatcacagaattatcctttaattctgttaatcatgttttctttttttgtcataaatatatttttaaaagagtttatggcctgccttttgcctattctatgggcagtgaattttcttaataaattttccaatgtaggttgcattttctgtttctgttttctaatcatctttgcattatggcaagataaatgccaagtgctcaaaatgaagattttatgaaaatgttttatagttttccttggactctgaaagttgtcatggcatttctacagccattcacattacagggatactgccgaaccactggatttatcctgtcagctttgatttaggattaggcagtgtagtcatttgtattgacttggtctctgttttctttcactgacataccctgtagtgaaattacatttgtacgagtatttcatgggaaagacagaaagtataatatactcaaaggcagcaacttttggtgtaacgtccagtggttcaaattctgactctcatcagctatgtgaacctgtacaagttatttaacttgggttttcttgcttattataaaattgggaaaatgcctctattttagaactgttgatgcttagaaatgaaatgtttaaacatttattaatcagtgattgttgaacatttgccatgtgctcagactatgcagtgtgctaggtatgggtattatcttaaaggaacttaacaataatggtggtaccttatgacacctaaaggggaatccagagagagctgcataggtggcatactcagctgaaactcaaacagcagagatatctgaatgagcaagaggtgaccagctgagaaaagttcttctgagctccaggagagtgtgcaaaaatattgccactaagaaatggggtgaattgcaaataggtcaatgtgtgccgaaggtgaggggtgacaaaagatagctctggatgaagttggagccagatgactcatgtggaagagttagaatttgatcatgtaggtgagagataatcattgaaaaatttcaaaggtgattatatatttttattctggaagtatttctttaggctggatggggttgactattgaaagcgttgagaatattgaacaagttcctgtgggaccagggaattaacataaacaagtgaagtagacaggatataaagaaatgatacaaaactggaaagtgcatgcttgtctaaagtaggcagaagccaggcacagtggctcgtgcctgtaatcccagcactttgggagactgaggtgggaggatcacttgaggccaggagttaaagatcagcctgggtaacatagataagaccttgtgtctacagaaaatttaaaaaattagccaggcatagtgacatgcacccatggtcccagctacttaggaggctaaggtgggaggatcacttgagcctagtagttcaaggttgcagtgagccatgatagtgccattgcacttcagcctgggccacagagcgaggccctgtctcaaaaaaaccaaaaaaacaaaactaaacaaaatcaagtcggcaggtgctattcagcttcaggtgattattttatcagtattttgatactttttcttcctcttctttttctttttcttttttttactttttaatattttttccttgcaagcaggaagttatgatacattttcaatgcgaatatgttgtcaattgagctgatatttttccccaagaaaagtcggacattggatttgaatgttacatccccatattttgaaatgttggcagctaattcaaacagacactgagggggcaaatgaaatatacctgtgagctgaattcatcctgtggtctgcccatttgtgccctttttcttaaaaaataagattgttggagtaatccaagcaagaaagaatgagagactagaaaaaatattgaatgagagtagataaaaggaatgaattgatgaaatttccgaagtcatattcacagtagaagtgaggcaatttggcagatcgctgatgagggaaagggtgatttatatagtttgttcgtggtaagggacagaagctgatgtttgggaataaagtaaactggactttcttgcaggcatccaggggaggtcatattgcccagctggtccttgtggagtttggaaggtggtgtggaaactggtcatatatagcacagatgcataatctgaagcagcaggtgcttctgggactctggttacttgcttagttgtttggctcatggattccctttgtatctacctgcttctgcctaatagcaactagctgttctttccctcaactctttttattttttcccccttgcagttttgttttaggatatctggggtacttcacccagtcttgtgccaccctgtcagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagcttctgaatagaaaggattttgttcttgatctatagagatgcaattgaaagattatattgtgatttgaatataacacttcttattttaaatttctcggttcttgatacaagacaatattaaataaattattggatacatgaagacatttttaaaaatccattttttggcatttttggagagaatatcattgccttaatgatattattaatataatcatcttggaatttttatcttatttatacagcaattaatcttctttatccttactactatcaaccaaatctttcctttttgttaaattgatatttttagaatggcccttgaaaatgtatgggaatgtattttatctcaaacgtgaaattaagatttatggttagttgcgattagggaaataggaaaagttaaaaatgactacatttggaccagtggagataagactaggaatcatagaggataagagttaaatattatataatctctaacactctgaggtataagcagttagttctggccactaaaactcagtattattcttttggggataatagcagtgttggtttagattaaggcttcatacataaaatttgaaattctgtaaaaggtacatcaaaataaggaaagccagatccaataacacataggacacagaattaataactgagcctatagtactactattccttgatttgatttattcatgaagtcatttgttatttcattcagcaaatgctatgtttttgcagtttttactaaatgcaacttttttggtagttggtggtgcaaagaactgaaactaaggacaatgaatatcattttaccgttcctgtaaaattcctcttagggcaagaacaaaggtggtataaaaatgtttagaaccaagacttaagagaatgtatttctttcctatttttgctgtcttcctaaacatgacacatccttacctctttagatgttcagcttccaccgactgcacagggtcagtatttgacttggtgttatttcttaaagtatcagaattggggttgagtacttccgtcagggactgtgaaaatttagcacactctaaaaaatgatagcaagtataaaggtcctgaaaaaaaatcatttgcaaaatgtaaacataaaagacaccaaaatgtagacatatttaccattttttcccggatgtaatataaagtgcgccatttgtaacttagagtgcttatttcctattggctgtggtttattttcagtctactatggagtttttatgttatggcatgttaacatgccattttatagtcgtatggcagctattattatttatttttactacatattggacagtgttgactgagtaaatgtaattttgatatatacctctatgaaattaattgtttagaatttatttaagtaattatgtttgaacattcaaattatttgataactagagagattaagaagatgctactattaaagattgaaaataatggacagtttaagatggtaaaggaaaattttgtcactgagtttttaccttttaataatttgagcatcagattattttaaaacatttgccaattcagttctaacatgattttgtatacatgtatttatttgtatgaaaagaaatagtgttgtttaaatcgtgtcaattcagtgctattttctctcttattgtgtagtattctttgagtgttgaatatttgaatattgtagtttgttttgttcttctatattagaaattctcatgtaagtaaaatgaccatagaataaaaccttttttttttttttttttgagacagggtcttgctctgtggcccaggctggtgtgcagtggcatgatttctgcctactgcaacctccaccttctgggctcaagcagtcctcccacctcagcctcctgaatagctgggactacatgtgtgcaccaccacgctcggctaatttttgtatttttttgtagacacagggtcttgccatgtttcccaggctaggctcaaaatcctgagctcaagcaatccacccaccttggcctcccaaagtgctgggattacaggcatgtgtcaccgtgcttggccctgaaataaaatttttaatgttatttaattaataatcatttcatgtcatttagactttaattttttgtgaggctttttaaaataaaagtatttttaaggactttattaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttctaacttcaaaattttccttgcctttagttttctttttattctttattgttttcattttatcttatgaaactactttcagcatgtgataggtgattgttcttaagtatgcagttgtccaattgcataactttggcctattttgataatttttgttacatgtccttattaatttaggatatgtacatatttcactgactttttttttttttttttttgaggtggagttttgctcttgtcgcccaggctggagtgcaatggcacaatctcggctcactgcaacctccacctaccgggtgggttcaagcgattctcctgcctcagcctcccaagtagctgggaatacaggtgccagccaccacgcttggctaatttctgtatttttagtaaagacggggtttcaccacattggccaggctggtttcgaactcctgacctcagatgatccacccaccttggcttcccaaagtgctgggattacaggcatgagccactgcacccagcctcactgatattttaattggatgataaagtagcaaagtatttttatcatagctagttttgcaaaggttttaatgatttcataatattaagttaatttaagaaattcatctagcactttataagagatgtcagaatatcatggcaggttccatatgttccatatgtttgactaaaggtgttaccgtgcagtgttatactaagagaaatttatattttattgattatgtcggtatcaattataaactatcttttaacatttaatgctgttctttatcaataaacacatgggccatgcacagtggctcatgcctgttttcccagcccttcaggaggctgaggcaggtggatcacttgaggtcaagagtttgagaccagcctggccaacatggtgaaaccctgtttttactaaaaatacaaaaactagccagttgtggtggcgcttgcctgttatcccagactcgggaggctgaggcaggagaattgaacctgggaggtggtggctgcagtgaactgagattgcaccaccacactccagccagggcaacagagcaagactccatctcaaaagaagaaaaaaaaaaagaaacacatgaatttgcttggtttagtccttaaacatttttcattatgtgttattttgttgtagaaaaatttataattgttttttgttaattacatccgtcttttttgtcatcgtagaatgcggccgaagatactttataataaaagaaatattacgtttacgctggaattttgttttgcttgctgaagttaaaacaagcaaaatttgtaacttaaggtaatagaaaattaatatggtaaaatgtcagattataatgtggacacttaatatgttagttattaaggaatttaaaaaagagactaagatggatgagacagaaaaaacttcctaaatttcaaaaatagataattttaaagaatagattagacatattgtttttacgttatgggtaaatttcccagaaaaagaaattaaaaaaagcacaactgattcataatgagccaaccccttttagggcatagctcttgctacccttttaatttgtggcctataaattttagcccctatcaactctgacagttactaggtaagtactcttttcatttagccaatagctctgtattgatatctaatattaagataacaaatagatcttgattcaaagctagtcttacatagccttgttatatcttaataagagcaggtaccatgactttgtcactatatatgaatgaatgaatgaatgacagaaaaaatgaatttcccagcagatgactatgttaatagaacatgagtaagccatttttttgttgctggatttgtattttataaactttagggaaagaagaataatatttagtttttttgtagtacttttactcttttaccaagcaagtttacttaccactttcgcctctaccagtgtctcccatgcactgaaacacatctgatacagaggagataataactgttggaggagtgaataagtgaatgattcctaccccattcacactattgtaaacaagaaaagctttttcaaaaccaaaatgtgttttgaaaaaacaaattccccataaaaccaaatacataagcataatactggtttctaagtactaagtcaagaaaaacgaacaaacactgaaggctgagaatctgatttttggcatcatgtttatactttttcaagggaatattctgtatagactttttaaagacaagggtttttaaaaattttatgggggagtctaacagtacagtgaagttagatgatttgtttgtgattaatagccggtgctagctggtgtcagacatgaattagaaacctggttgtttggttcccatgctgctgatctttgcaggattggttgccttctcactttgggccctgtcatatatgaattgagggtgggcaacagacagctcaggttcttcttcattactgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaatacgtatatatttagtgaggacctatttctgatttagaaaaaaattgattgtaatttctacaacattgaaacagtgtctagaagaatcctttccccacccccaaatagctgttactgacatgtccagaatattgcacctaagaatgaattgacctatgacatattaaggataaattttttaaaaaattaagtgaatattgcattgtttctatttaatttgatagcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaaaaccttacggcttccagtataccactttgtaggtagcagattgtctgtgtattttgatgtctctgccctttttctctatttactatttaaacaaacaggctttactcttacagagacaaagttagcaaaagtaccccattgtttttcaggtttcttctacattcccaaagctgtaaccttattttgtttttctaaaatttaatgtagttctaactgttgacaaagctagttgtgacactggccaacattttctttattgagagttgatgaatgacagccatgtctgaaatctccagtcagactcctcctgatataaagataaatgtgaaatattagaactggaagtattttagcagctttcactacatcgaagctattttttgtcacttttatttggggatatggaatgttcacataaattctattttaaagatgtttaagttttttaaaaatatcctcttcacttaccaccatagatgaggagcctacctattctagaaagaaaaattgtctctaattcttaatttattatgttttctcatgtgagattagtagtttcattactagttttgagccgatggtacatttctcctgagagatacccagggagtgaagtggactttgttagtaacctttgctacttgccctgcagacaaggagaacttagggagacaattcatcaccctaaagggaagcagaggagagggctgacatcacaattgtctatgaaatcttgatcattttaagcagcattgaaaattttgttggaaatggttttattaaaaatgttctgcataattgtgacatttaaagagaaaacagtttgtatcttctaagttaagaaaggtaaaagtgacagcagttttgaagaagaaggaattgagcattttctgtgtgatgaaaactttttgtgccaacagtcataaaatagggatcttattttctccattaaatagattagaaaaagggagctaaaaatgttttggtaacttactgccaagatcacataactgttaagttagagctgagattaaaatcgaaccttcctttctcaagtccatggtttacactgttaagccttgatgctcgtagcagaataggaaagaaataacatttcatgctcttttcttctttctaaaacatgttacattttttcttgcctctggcactcattcctaggcttgtcatatcactgactttttcgcatcctttaggccttggttctaattaatgtcaaccccagagaggcttttcatagccattatatggaaagcacctcccaattacatcatcctatttattttctccttaacagtcttagtacctgtaaatactttatttttatgtctctcccactataaactctatgtataaaggacagggacctgtcattttcctttttgttcaaagttttgtttcatagaatagtacttggcatatattagtatagtaggcagctattggttcaatggatgaatacaactttttatatattctggcatccttttaagtaatagagacaagtactatttcctcaaagaatgtttaaaataaataattaaaaatttaccttcagttttaaatttgaattgttactgtggcaggcaaaagttattttaaagaaataagttatatataaatttctctgaaaattattgaaaattcttattgaaatggtgttttactgagatgacatttgtaattttgtatcttgcaaaatgcaagataatctttcattattcatataggattcatttctgcaagcatagcttaatgattcagttattaacttcattgtatatcttaccccaaagaaactaatctctgatatttgggatgtatggggtttttttggggtgtgtgcataaaatagatactctctggatcttgtccataacatgcataggaatcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagtcatcttacttgcttttgggtaataaattacttttatgattagtgtttgattactaaaatcttaatgttttgaaatgtctactttcctaaaactacagccaaaaaagcctgtatataaagtgctttgctatactgttgaacaaggtagcattgttattgaaccccatgggaaaaaaggagtgctgttttgggtgtctataaaaacgaaccaaacttcttccctggagtattctgactgctgttgctatgtgctcatgggcctatgccatgtggctcttttcagatttgtatcagcaagtcagaagttaggaggcagctctactgatccatgagagaaaaaacaatattgaagctgatgaatgagttttatatttctgtacttgaaaatatttagttaaattactgtgcaaaataatgtctgattatctgtaggttaattcttatctacaaacatcagatttttaaaaagaagattgtgaactacttttgtttacatggaattgctaatactaattacctaaatgaaataaatttataaaggaaaaccaaatacttcattgcaaagtcaagaataagtaatattcaaaaaaattttaattcataagatattctgtagttgagtgaataatcaggagttaacttatccatttgtgaagaacttagattttatttcgttttctgttctattttagattattatctctttatatcgtatggtaactctaccttacagtgttagttgttcttaaaaatttggagcttatagactctttggagaatctgacaaaagctgggcaaccctcccagataaatatgtaggccaatatgggcacaaataattatgccattgtaatccacttaataaaaaagctccactttgggcaaggctgtgtgtgtgtggtgtgtgtgtgtgtgtgtgtgtgtgtgtgtgtgtgataaaaattattttccttttacattgaagaggttttattgttaaaatccgtgccactgctatgtgctaggcattgcagtaggcagtgctaatactgttgaaacaaaactactcaaagttcttgcctccatggaacttacacttggttaagatgttgcggagacatgcattgactaaattacaaatagggtatgttctacaaaggtggttgctttgtgtggtggctactttcatttttgtcctcctgtttttccatttattccccatagcttagcaaagtgaactttgtgaaatataaattggatcacttttcctatcaaaaactctcagtggcctcagtaggcacacaactctaagcagtttggccctggatcctctctccagcttgccatggagctacccttcggtaagctctcctgggttcagccatactgatcttattttagttcctttaaacgtttcagtgtctttatacatctatagtttctttgcctaggatcgttgtctcctcctcttcttatgataacttcttttttagaacgacatgtaatttttcctatctcagagaagctacctgcccaattaaaacacccttctcccctacaacattcatacctacaaaactctgttaactttgcttcttctttagcacttattacaaacatgaacctgtttatctattttacatcttttttggggggaaaggtccctgttatttgcactagaatgttggctctatctgggcaggaatactgtttttgttttactcagccactcacaggtaggatactgtccgtatttagtaaccaaagatgcattggaatgtgtaatgtggatattcatactgcatataaagtatatgcaggggatttgaaaggatgttgtgagagcagtagaataaatgatcaatatgtggattatcttgctacagtagagatggtgtaaagaaaatagtttagagatgaaacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctccccccacccccaacaggccctgttgtgtgatgttccccatcctgtgtccaagtgttctcactgttcagttcccatctatgagtgagaacatgcggtgtttggttttctgtccttgtgacagtttgctgagaatgatggtttccagcttcgtccatgtccctacaaaggacatgaactcatccttttttatggctgcatagtattccatggtgtatatgtgccacattttcttaatccagtctatcattgatggacatttgggttggctccaagtctttgctgtagtgaatagtgctgcaataaacatatgtatgcatgtgtctttatagcagcatgatttataatcctttgggtgtatacccagtaatgggatagcggggtcaaatggtatttctagttctagatccttgaggaatcgccacactgtcttccacaatggttgaactagtttacagtcccaccagcagtgtaaaagtgatcctatttctccacatcctctccagcacctgttgtttcctgactttataatgatcgccattctaagtggtatgagatgatatctcattgtggttttgatttgcatttctctgatgaccgatgatgatgagcattttttcatgtgtctgttggctgcataaatgtcttcttttgagaagtgtctgttcatatcctttgcccactttttgatggggttgtttgattttttcttgtaaatttaagttctttgtagattctggatattagtcctttgtcagatgggtagattgcaaaaattttctcccattctgtaggttgcctgttcactctgatggtagtttcttttgcagtgcagaagctctttagtttaattagatcccatttgtcaattttggctttttttgctattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaaagggatccagtttcagctttctacatatggctagccagttttcccagcaccatttattaaatagggaatcttttctccatttcttgtttttgtcaggtttgtcaaagatcagatggttgtagatgtgtggtattatttctgagggctctgttctgttccattggtctatatctgttttggtaccagtaccatgctgttttggtaactgtagccttgtagtgtggtttgaagtcaggtagcgtgatgcctccagctttgttcttttggcttaggattgaagacactgtttttattgtctagtcaaatggtaaacataagtgactacattattgctggaagatgaaaaataaaactatactttacagttcacatatttcaacaggtgatacctcatttctcattgattttaggtattgtcactagacaaattagtctctctgataaccagagagagattaatcaagtgttggtgcttactggacttttgtgtttcagtttggctgttgtaatactcacatgtcagactaagtagaaggaggcatatgcccttggaaattattttaattattttagatcattttttctaaaaagtcattgccaagagaggacacttagctatacatatctacatggatatttttctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctatgaatattatcataatctttgaatagagaatgaggtcaattaaggtgtaatcacttgattcttagtcccaccctgcatatggaaatatctaattcttaccaacaaacacatccaaagtgccaaagttgctgaaaataatttgatttattttagttaagcattaataaagtattgaaatttactattgactcatattccttctgatggttgaaagatgaaaaatgtacaaaggtctctaattatatatgtaggtaaaaaagatggagtgtgataaatatttgtcagtaagtatttaactccagatttctatgtaatgtttagggagttttatcctaaaaatgtgtaaagagtttcttagatcttttcccactcataaactttcaaaatcacaaaatcatgatttgttttggttgggtagctactccaacattctttcttcacattcttccgtggcattgaaaacttgccatttcagtcttcatggctccctttggaaacaacttaattatgtgaaattgtcatgtagctttaagcccttctgaagatcataggtcaagctgaaaattaaaggggacccttgctttatagtgtcagttgtaccttttggaaccttggcagaatattgattaaacattttaccaataagtttcagattgatttacatattgtgtaaaatttatcaaaagtaacagtcaacatctgatggaattatgaagttgatgggattatgaaggtaactagaggtacctgcctcttttcctcttaatgaaattagtcataaattaaattgttactgaaacttaaaaccaagataaagctgaaagtgtatccttgagtttttctgaaatgtttctccacttgctttcttcctgatctgagttttctttctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacacttgccttttatttgtagcttgatatgtagtctgtccttttgttattgtttttggagggggcttagggtttatgtgtgacttaggtgctgctgtgaaatggagagcatcacctatatctggcatttgcatttttgtaatattgttttcaaaatgttccagagaggtacattttcttccaccccgtctctctaatgcacagttaacagtatgtccttcacttgaactttctcccttgtaaatcaattatgcatttgctatagtagttcagctttttaaagtgcataaggagaatactgtataaaaagtgcttgtaaaacaagtctttttctaagagtctagaccttgagaattatgtttttgtttttcaataaatggttaaggtattgtaaaaagttggacattttaccagagttaccatatttgagctaatttttagaatattttttaaagagttaagttatagtgctttccacgcaagactttatatgaaataaatacattaagaatgtagagtttttgatgccttgtcaaaagtggaattaaggttggttttattatatgctttgaatgtgtttctgaaatattttttgaagcggatacttgtaagttaaataccttttatcatttatttttatcataattttatatatactctgtcagggaataatatttaagaatcccaacatttgtttttatggtatatctttacattgtaatctgtagtattttaatttcctataaacctcttaataatactagacaatatgtgaccttttacactcattcatatgtgctataaaattactttttcctttgattctattaaatcctttcagaccactagagaaatccctgatttgtacttaacagaggttttcatgtattaacaagtagagttacctggctatcaataagtacttgtttaactagagtgactaagttaaagacttgtagaagttaggactttctgaagctaataatccaacaccctaatttgtgactcgagggatcagatgcacagtagttcaagacttgatgtttttgttcagggtaaggtagtaatttagtgacagaatccagataactcaaatcctcagactagagaaaaattattaagatttcttgacatttattgttattccctacctttagcttttacacagctaaatctacttgtggaagttcagcttcaaaaagttttagccatagtttcaaagctgttgactgtggttgaggtttattaacaaccttggttttctaatgtagtggaattcaaagtagatcaaattccttccctgagccaggattctctgagtgctcttcttaaccactcctgcccaaccgctcattctacaatattgagccttaactcctgttcctgtctcctggccatcctttttaatagttttgtattaaattgtccatgatcaacaacattttgttttaatagatattctcacttcaaggtggcataaaatagtatatatttctcaggattgactttcccaattaagagtatttgccttcatctctgtgcattaaaatttattgctgcaattgacatgactaaggtggcataacagtgctgtgagcataatctagagctagtctgaataagtctgaatcatagctcttctgttcatgaccttgggccacttaccctttctgtgctttgttttacatatctttaaaatgaggattaaaatattactattaggattaaagtaattataatattattcataaagtactgagaatcttgcctgatatatatagtaagatgctacatcagtgttaaatcatagaaggagccagtaaattgtttcagtattttaatgtgtgtacttgaggttctggagatattccaagaacaacacacattcctagtttgacctgaatgaaccaggaatatttaaatacatagcatttatttttagagccacattttactgaaactaaacctaggaacaatacgtggctttttttggggaggggggaggttgttgtttgctttaagaaccttgctttgttaaaaaaaaagcctaacttgcctttttgggaaggcaagttagacgtagaccttaaaagaaatctagctactgccatttataggtggttatatggataccttacctttagaagttattgagtgtgacttatctgcttaatagcgattaaatccgtttaaaatgtttaccaggtgttaatcataagtcaaggttgacatagccagttaaatcttatttgaaagaaagaaaaatctctgtaaatcatgtttacagattttttaaaaactggctggcaatgtttattataaaaatccataattttccatttgtttgctatattagaatactatgcagttgtaatgaataaacatttatagtttctgctcctaaaaattggactacagtttcgtgagtttagtctcatctggtaagctttccaagagattcagggaagccatagctttccaagtatgcaaatctcttacattcaaagcacttccctcaggcacaagaagactatttcagtggcatgctttgctcttttcccttaacatatctaacatgaggaacatagataggggacagcctatctatgtttgaatagatgttgaagaaattatatgagaagaattgatagaaagttttatttttaattgtttgctttgtaatatatttatttggtgactgtaaaaagtagatttcagaagatttatttatactatcaatgcatgttttaaaattattcgtttgagttgtaaataattaatgaaaaaggcattttatgtggcactgaatcaacctgttagtttcagttgttcaccctggatttctttcatttaatcgtcttcttcttactgcaaaggaggacatttattcattactttgcccaaataatactaacacactagcagatggtcactttccaactggtttgtcttcagaaaagaaattaaaatattatagtgccagagagagatgttgtaatgtgtccctttcaaattaacaggtcattcttttcaactattttgtaactgtaaaatagctcaatgtcacataaaaggctaaaagctagagtaaatggtgtcatgggaaacatgaaataaacacagtgtaatggtttatagtcttgtcttgaacacactaagaatatttcttttctaaaaagacacaaattatatgctacggtagtattttggttttactggattctagtttaattagttcatatcaaaagttagcacttgttttaaaacgtgtatacattctgaaagaagatacttcccccaaaacatttaaaaataccttgaatatattcttaaacaaatatgttagcctagcaaacaatgaaatgaaaaccaaatatgaaaataatgtatcttcttcctttaccccttcaatgaatgatctgtaactctgataaaaagattagtttagagattattgaattattttaatactaggaccagactgaaagtaacattgtgcatttagaaatgcaacatataaatgagtagaattggagccccacatgattgggaaataagctggagaaactgaagtatgcttaaaacacagagtaattagcgagcaagctcaggaaaaaaaaaatctcagaatacttagaagtagtgtttgaggaactagaatcatcacagtttaaattatttgttttgacctttctctgccactgaattgctgtgtatctttgggcagtcacttagatcatttccttgactagaacagtagcaagttggcttagacaactcttaagccctttttttaaagtgttatagctatttggttggtgatgaattacttaacccagaatttaaaaaaaaaaaaaacaacttaaaatgcatttgcctaagtgagccaggtagatttataatgagaaagaaagaagtttttataatattatttattcttcttctgaaaaaaatcaagtgataatagaaacccaaatacaaaataactgaattcgatttgcattcctcctaattactagcactgtgaacaaaaacaggtcgtttaaatatgttgtatgggcttggtgcagtggctcacacctgtaatcctagcactttgggaggccgaggcgggctgatcacttgaggccaggagtcctgaggccaggagtttgagaccagcctggccaatgtggtgaaaccctgtctctattaaaattacaaaaattagccgggcttgttggcacgcacctgtaatccctgctactcaggtggctgaggcatgagaatcacttgaatcctggaggtggaggttgcagtgagccaagatcttgtcactgtgctccaatctaggcgatagagtgagacattgtatctaaataaataaataaataagttgtattttggatcctcaataaataagttgtattttggatcctcatccgaacaatggaaattataatttttctggttatctcactgtgtctaaagcgatgtcctactgtgttgcctttttcaaagagtgatcatttgactattcctataagagcccttattggaatgctttctagcatattatttgcctcagatactccatctgtgtggggagttctttctcaaatagttggacactttctgtctttttaagggtaaaatatatgagacagccttttctaatttgtacagagatgaaaaattaagtcagccttaagttctttcttaactgagagtttttcttagaaagtaattttaagatattgatgcaggttattttcctccttagcttaacaaggttcaggttcttgtctcagtaccaggaagaagtaggcatgcggacacttgaagagtgagtggtgtagattttattaagcgaaaggaaagctctcagcaaagagaggggtcctgaaaccaggttgccgggttctccctttacagttgaattcgagggcttctatatctgcttgatggggctgggttttctatttgtataaggcatgaatttcttctccctcccaccgccccccgccccattccgtccagtgcacacgcgggcccttagtctgagccattccacattgatttatttcccttactgtgcatgtgttaagggacagaatttttcaccacgggcatgtttaggcaagccccctgtgcacaatgacattggtgggttggatgttgtcctgggacccttccctatctgcctaggcatttggctgtctcctgcctctatcaatatctttttgtccttccctctcaaatccctactttaaccagcgaagtggaatatttgtcttaaacattgtggtgttattactcatcccaccccatttcttcctatatttgtttgaaatgccagtatactcatattgcataatataggataaacaggtttatatgtggaagtgtgaaattatatattgttatgaatggtaggggaattggtagatctgggactcaaaatgattgctagaactttatatatatatatttttggtaaggcattaattcactgagtacttcaaatattttattttatttttgagacggagtcttgctctgtcacccaggctggagtgcagtggcgcgatcttggctcactgcaagctccacctcccgggctcacgccattctcctgcctcagcctcccgagtagctgagactacaggagcccgccgccacgcccggctaattttttgtagtttttagtagaaacggggtttcaccatgttagccaggatggtctcgatctcctgacctcgtgatccaccagcctcggcatcccaaagtgctgggattacaggcgtgagccaccaagcctggtcgtacttcaaatattagtcccatgttcatgtttgaaattgtttaatcaaaagttgttacaaatagtactgaaaaaggaaagaaacctgcccttgtgattgttcttgctcatggttatcctctctgttctgtctgttcatcctgccagggtaagctgagatctcccttcctccataatgtattttacagctccagttctcattagtctttactctgagttcctacaccgcttacagtatgcaccacataattgagtatttacttatatatccttccgtgtatggattggtgatgtttcatctgtttctttgcttcccctgtagacctcagactatacaaggtgaagacaatattttgtttaatctttccctaaatgttcctaagaatgtgttagagcacctaagtggtgctcagtgaatactagattgatttgtttttttccttttctccatttcctttcactgagtgtgaaaattgctagaaatcacacaccatcccccctttttttcctgagtctatctttttaatgggcctctcttctttcctggtatgccaagatagatgtactacaaaagtctgtatatagaatttgtacaatttgtttcttgattttaagtatatgaagaaaaacgtggacatagagaaatgatgattcataatatgttctaattagaaatgtgaaagttggttaaacattaaaaaatcagcttggtgttacagatgtgttttttttccctttcttaattgtttgaagtttgcagaatttactgttttctaccgtaactaagagatatgctttctggcagacctattgaagaatttggtttatgccaaatatactactaataatttaaatgtcccacatagttaggatcttttggtattcatcagagtaaaaattaattttatcttaaaaactagagtaaaaaacctttttttaaacagtaaaaaatctgctttctgcaaactgtgtccagataaccagagctgtttagctggataatgaaacagtaaatgtgaaagcaatttgaagaacatacacattaacattatggttagaagagtgagggatggaatgccttttgtatccatgacatatttcaaacagaaaaatatgcaatctgttttcatagttcataagatgctccacaatcccctctcaaccagttctggtagataattaagacctaacacatttattgtatgtaatgaataatttctctaatgcatctagaattcaacagaattgggaaatagccctcaaataattttatgtggggctttattttcttgtggaaccctagttgagaaaggctatgcaatctcttttaacctctatttgaacagaatcttattttgtcacgtatatgtttgaagaccttaacccttctagattatttttacttgacccaattacttagtggttaagaatgtattgcctatacaatacagtccaaatctggttggccctatttgttttctaaagttttaaatgtagctatgttttattgacagcatttttgctacttaattatgtcttttcttgacagctcaaactatctctgtttactcttatttagaatgcagctggcaacagcagttggtttgtgaaacccaggcatataattaacttccccagttaaggtatggtttgtttcattggaagagaaagaattttgggggtatgtttctttagtctgagaagtaatgcagtttattttcagtatggtatattttatgtgacagaacataagcagagaattttttaaaaaattataacattctaacattacttgagcactaaagtgctacaaaaaatactttgttattatttgaaccacgaaaatcagatattagcattcagcgtaaatgtcaaattaacacaggccagtaggaacatttgtgatcatgttcttctcacatctacttgcatggataatgaagctttgactattgctttgatgtagatttttggaggaaatcctcctcctatttccaagacactttgtagttactaattctaagagagtataagcgaatccatttatttaaaataaaataaaaatggggggaaagatatttaagcaataaatttcataccatgagattttttatatcctggttactttaaaacccagtaagctgccctgggttctctcctgatactgcacagaacttttgttttacatcctcgtcttcctattattagttcaactatattgtttttctctttccagcactctatctggatttttgtaattattactgtcttcctattactagttcaactatattgtttttctctttctagcactctatctggatttttgtaattattactgtcttcctttatcagttttaaaagttaagatatgtggtatttttgagatcagaattgtagccattatattgatgtgctgcagatattaagagaaaaagtccttagttgccagctttttgtatactcaagtgttatggattcttaagaataaatgtttctttgttttcatatgaaattgtcttttttttttttttaggatacatgtcttactttgtcacccagtctagagtgcagtggtttggttcccttcagccttgatctcctgggctcaagtgatcctcccccctcagcccccagaatagccgggactttaggcatgtgcgacaactcccaactaacttttgtactttttgtagagacggggttttgccacattacccaggctggtcttgaactcctgagctcaagctttgtaatcccaaagtactggaattacaggcacgagccaccgcgcccatcccaaactgccttcctttttgcccagcccatgagaacaacctgtgctagtgaatgatttttaaagaatcttgctacttttttctgcctgggattatgtgttgactgaatatagtttcctaagagatactgttgatttttttaaactaaacgtctaccagactttctgctctgttgttccaaaattggacaatttcctgcctggtattttatttttaagttgaaaatgggaaaattgctaatgatgttgaaagcaaaaatggtattgaatgctttctgactaaacatatattgaacaaagcaaaacactatgtatctgctctttcatataacattcggaaactcttgtgacataatcagggctattttctgtataagatggggaggtaggcttataaatatgctacgtaagtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaattatggcagaggcaaagtagttactttgacaaccagattgaggattcattgcgatttattatttactacttgaaaatctcactctgatttaattaagggttgagatttccatgaagtctgtcttttctaaatttgagcaccctgttactgttgtttatgtgtgcactgaaataatctcaaactgatgttactccaaaactgtgacgaattaggcttaacatgtagttttttgaaaatttagacaggtcagataacagttaactgaaattaactggatcttatattgggcgatggtaatcaatgcttactagtaacttagtaacattgactccctgggtatcttcaaagcagcctggttgtaataagtgaattttatcttttttgttgaaagcagctttaaataatttatacctgatttgtatttcagtgtatcattttagatatacacgttatttctttgcagttacttaatggtacacttttttgggtggggagacaaagtcttgcttttgtcaccaggctggagtgcagtggtgcgatctcagctcactgcaatctctgcctcccaggttcaagcgattcccctgcctcagcctcccaagtacctgggactacaggcatgcaccaccacacccggctaattttttgtgttttagtagagacagggtttcaccatgttggccaggaaagtttcgatctcctgacctcgtgatctgcccgtctcggcttcccaaagtgctgggattacaggcatgagccaccatgcccagctggtacaccttttatattgcccaaattatagtctataaaatgtgattgtaatcagataattcttggccagaaaacgaaagttcaccttcttagagtgagttaaccattaggtaattttgtattttatgtttttttcttcccaagtattcctgaaatgctttttacctttgcagatgtaactcagttgactacttattcagcattaattaataataaaatatgataggcttttcaacctatgatttttatttaaacaaaacctttcaaataaaaataattttaaacctgtatttgatttctatttaaaatggagtgttttcatatactcttttaaattaaaatagtgtctgcttagctcgtttacattctttctgtcagaatgtctgcctcaggattctatatataattaatgtaagaaaaacaagagggtaatcccttggtagaaaactggtaatggattaaaagaccatagctctgaaattccagtaatgtgacacattttctctgaaagatgcacttaggcccgatatctagagatattaaaaagtgccccctattttaattagctaaagatagacattcctaatatattttgttgtatgtttaatatggaatattataagtaaattcatacactgatactaaatacgatttgagaagaattactgctttggtgagaagagagctttgagtgtcacttgaagcttcaaatttcttactgaaccaattgataaaatgtacaaaatgtgtattgagaatgtgcagaacagccacccaggtagtttgatcagtgtctttctacatagtgcctaacatgaactagtttaagaaacttgaggaatccacataactatccttggttccaattttttaattaaaaagtttagactagagcagtgcttttcaaattgtgatttccaacccattatcagtttgtaagcacagtatttagtgggttacaatcatcacttatgaaagagagcaaatatcagagcacagtttatataatgagtattatttcatgaaatttgcattaattatatgttcatatcttaagggtacattgttttgatataacatgtcatacttaaggaatgcagtaaaaatatataaaaggaaacaccgggctgcatgatcctaaaaatctctcccagttccaacattcccgagtgaaattttaaacatgtagctcttccttaagtagcattatatcattatgttatttcaatagaatttgtcacatgcagatgcattttgggagaaaaagaggagaaaggtgcaagacttgatattctgagagactaatacctatataaattgtaattattcctaattgctatgtgtgataatttaggcctgcacaaaattgctgagagcatatcaaacaaatgattagttctcattgtcaggcccagaaaatacctcgtgactaatattagagtacatcctttaaagatgagtatgatttcattcatttgggatagagaattcagggaaagagtctggatactttggctgtggctagacagtcaagcggccttctatgccatacttaggcatttggaatttatcttaaaagaccagggaaagctgtcaaacccattcagcctgctaggattagctctccttttagaacgatgaaagtagtaatgtgattgttgaactcaagtagagaaaaattcaaggtatggagacaataagttacaagaatttcagaaggtcagctataaacgtagaaactcctcttttgataaagagtgaaatacaactctttatcaaaagcttgacagtgctcatacaacatacgaattgagtttcactttagtattttggaaatactggaacagctttcagtacctttgcaaaatgcccaagtaaatgtatgtgaaatgttgaaagacttaaatgagtccggcatataggaaaaccttgttttattgagctttgtagatattgcattgtttttttattttatttatttatttttttgagatggagtcttgctctgtaacccaggctggagcgcagtggtgcaatctcgctcactgcaagctctgcctcctgggttcacgccattctcccgcctcagcctcccgagtagctaggactacaggcgcccgccaccgcgcccggctaattttgtttttgtatttttagtagagacggggtttcaccttggcaccttagtagacccaggatgttctcgatctcctgacctcgtgatctgccccccttggcctcccaaagtgctgggattacaagtgtgaaccactgcgcccggcctgctttttttataaattgaaggtttatggaaaccttgtttcccacaagtcttatcagcaccatttttccagcagtatgtgctcacttcatgtgtctgtgtcacattttgttaattcccacaatatttcaagtttttctattatatctgttatggtgatctgtaatcagtgatctttgatattattataactatttgatgtgtattattgtaattggagtgccatgaatcatgcccattccagacgatgaacttaaggaatattaggttttctgactgctccaccaactggcccttccctgtctctccccctctcatcaggcctccctattccctgagacacaaaaattttgaaattaaccaattaataatcctacaacggcctatatatgttcaagtgaaatgaaaagttgcacatttcttcatattaaatcaaaagatagaaatgattaagcttagtgaggaaggcatatcaaaagcttagacagaacgaaatctcggcctcttgtgccagttagccaagtcgtgaatgcaaggaaaaagttcttgaagtaaattaaaagtgctacttcagtgaacacatagatgataagaaagtgaaacagcttttgttgcttatatggagaaagttttagtggtctggagagaagatcaaaccagtctcaagattctcttaagccaaagcataatccagagcaaggccccaactgtcttcaattctatgaacgctgagaggtgaggaagatgtggaggaaagtttacagttaccagaggttagctcatggggctgaaggaaagaagccattgttcccataacatagaagtgggaggtaaagcagcaagtgttgatatagaagctgcagcaagttatgcagaagatctagctaagatcattgatggaggtggctacactaaacaacagattttaaatatagacaaaacagccttctgttggaagaagatgccctctagactcttcatagctgaagagaagtcagtgtctggcttcagagtttcaaaggacagactgtcttgttaggggctaatgcagctggtgactttaagttgaagctaatattcatttaccatttcaaaaatccttgggccattaggaattatgttaagtctgaggaatacagatgtacccacccttctctttgcctttttatcaagactcagtgtacaaggattgtatgtgtgggtcacctcggtctcctctgctttaatgctcctcatctctggcaataaattacttctctttgaaaaacttaacatttattaatgtgaattttgggatcttatgcacataatttatacgagcactaacttgtcatcctgtctctgaattgaatcttttgatagtttcctgatatagtttatgctgtgtcttctgttagaggaggctttaaaaggagggagctcttgatccctataggagaagcagagcagatagaagggcattccaagtggggagaatactgtgaagaacgctacaaagacaggaattcacataccagattttatatagtgaatatttaagactcaattccatagtgtaaacagattaactttgttatttaaataaattatatggaaaaaattaattttggaattttctactatagcagcttggtgccacaggtaccatttgtttcttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaatttattgctattttgagatcagatttacccatattttcttgttagtattattgttattctaacactgaaattattaacgcatttatgtttggaggtcttttgtaactagaacttagtcctttgcagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagctctttaagggatagaacaaggattccaagccaagtcagttaactccttgtccggaattacttttcactgtaaaatagttacccattttagaattaaacacttcagatttaagtagtttgatctcaataatatctgtacagattaaattaatatcttagggggaagtaatacttaagaggagcatttaaaaaatgtagttattgacctaattatttccccacccaccacactccctgtaggattttcataagcagagaattatattctaagattgtgttcttatttcattagcactgtgataagccataagaattgtgttttactatctttaatctgttctactccatatcaaaacattcattgacaagaggagattgtagtctattcactgattttgtccaaaccagttggaatagtggtcagcaactgtcttccataaatggctagatggtaaattttttagactttgtaggccaaatttaagggtgttgtatagatatttatataatgagagaaatgaatatccaacacatttattgacaattttcagatcttattacttgacactgacaatttcatacatttttatgtgtcatgaaatattgttcttttgattttgtttgaacattaaaaaatgtaaatggaccatgggaacactagtagtccaacccttatttagaagggactgttgtgggtatctggtagatcagatttgaattccatttgtaaaacatttgagtatttactttataataatattaaatataaattaacatcacagttttctgaggaaactgaagttcatttgtaaagaaacttcttcaagttttgccaagtcagtaaatggcagaactagaattcaaaaccttatctatttttcagtgcctgggttctttcatgtgttcattgttacatcttctgtgccaggcatggagataggcacagtgcatactggcatgaattagatgagttcctgcttctacatagtccttagtcatgatgctgcacagatttgggaaatgtaattttctaaaacctgcctgtcattataaatcagattcatctacacttactctcattttctgataaaaagtatttgcttgtttttgtgacttatcaatcctgtcttgtatttttctttttttcttgaatagtacaggaacttttttatctggtaacattcagcttcttaaggatgaaattaaaactatttgaggttgtaaggggaataaacatttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgattagttgttcccacaagctctgtatatcttttggaaatctatctttatatctgtgagataaaaataatcttcagttattaaaaaagagtcatctgtgttagtagtgacaatgtatattttagaaatttcatgtatgtagcatcattgagaatcaaatatgaaacattgtttaaaggaaaaagagtagaaattaaaaaaaaactttgattgtataagttattttttgagatgagaaattatttcaatatgttttttttttctctagaaacctgttggaaaatgccttgttactccagcagaaaagcatgtctattattaccaatagaattagtgtgttcagaaaaagaaaaggcttaatttacagccttttgaagttttagggaaaattccttttttaaagcatgcaggaggaaagacatgacatcacagccttaagtgggtaaaaggttacatggctgatactttttaagtgattgaattattagcatgggtaataatttgtggaaggtgaagaggtgccactagtttcagtgtgttaatcttccccacttaaagtgagaaataaatacctcataagaatatatatggggatatagtgtctttcctttctaagacacttgcttgagtcagcagtggttgcgtgtggtcacctttggattagtcttcggattcagagaaatgagtgggtggtttcagtgcagtttcaatgttgttaacccaaataagttctagagttggtattaattggcccccttatagaaacctttgaggaggaagctgttgttacacaggtaactttatacctttagagtttattgttgcctagtaaaaattaatatggaaatataataaaaattggtagggaactctttcattcatctacattgtggtcactcatgtgattcaatttaaatgtatcttttttttttttttttttttttgagatggagtttcactcttgttgcccaggctggagtgcagtggtgcagtctcggctcactacaacctccgccacctgggttcaagcgtttctcctgcctcagcctcctgagtaactgggattataggtgcccacagctagctaatttttttgtatttttagtagagacggggtttcaccatgttggccaggctggtctcaaactcctgacctcaggtgatccacctgcctcggcctcccaaagtgctgggattacaggcgtgagccaccgccccagacctgaaagtacctttttaaaaaggaaattttggttaagagttttttttgtgttagtgctttaaaaaaattgcttatatttaaatacaacaacgtattaactaaaaagacttaaaatccaaatttttactctgtttgatctgggaaacctgcctgggaaatacttaaaatgaagtctccaccctaatgagttttagcatcagtgacaaaaaaggagtggaaacctttacctagcaatgttggagtgactcactggatatgggaacaaatagctcatttctgcatttttgcttcttatttaattatttttaagaataaatacatactcaggctggatggaggtgggagtgaattaatgaaatttctaataacaaaaggatagtaaaaattataagagattacattaaataacatagagttggaaataaattatacctgcggagatgatgaaattgtcgtttacttattctgtaattgtttgctagtttctttgttgacagtgaatacattatacagagttacttaagaattttaatttgctaggacaatgcgaatgacttcagatattaaatttttgttagaaacttattgatgttaaactggttttaactagttataaaaaaaaataataattgtaaagagtatttcctgtttccctgtgagggtgggagggggacggagactctggaatgattttgaactctagcaggtcgtcagtcatttaagagcatattttcatagttgagtcccactgattaggggactctgatgaaaatgtcatctttgtcctgtttgtattctttatctcttgatatctggatttttgaaaaaacattttctgatgatgttcatgtcttaaatttataaactcaaaactttaatatatatataaaagttaaaactgtggtctttttgtttcttttcctcttaaaacaacttttatgttcttgagtatgtttaacatcttctggtacataagaattatagtaataaataaagcataaagtaaaataaagtaaaaataaaatgcctactgtgtccctgaataactaatattcagtttttgttgaaaagctcagagtccagtaaggaggtaatataagtacaaagacccttagaatgtgttacctgctctgatagaggagctcataattgttcattcattcatatatccatttatttaacatctttattttgtcactccataaagaacaccgtaaattggtcctttcctacgttttggcattatagtagtgaaccagataaatgacacttgtcctgaaggaggtctcatcccccatgtttgttactcaggaacagggattattgtatttttgttcctagtatcccaagtgtctagaagagtgctaggcacatagtagttactcagtagatgttaattggaggaaacaaaacaaatgacccaaacctaagctcaggttctcctttccctgttttcaagacctggtgtcttgaactgggttttgaagagtaattgttgcctaacagaaaaatgagtggaacatcctgtgcggaggagatagtttaaacagaggcactgaataattgggtaatattgaagctcagtgtgaaagtcactttttttttttaagtaaatcggaattaaagtattctgcctttgtgaacttagaagttgtaactatatactgagactaatagcatctctttgtggcatatattatttttaatagatgtgcttatcaggaatttttttaagttaagtattaaacataatattttataactgaaatatgttttcatggtacttgtgaattattaattagtggtagataatttagaagtttttaggtaggagaaattaatttctttctagtaaggaatttaaccccacagtgtttttgactcataatgtgtactttctttttaaaatgtcaaaaggcttttcagaagtagtagtatttgaaactatcagctaatggttttctaaaagtatatttttaccttagagcatctagagtgtccagaattttgtgactcttagcaagtccccaagttgaaaatttttaccttgtagcttgcataattggatttaaatatgtattttcattatgcatgtatttgttagaaaatattggtgtatttcttagtgtaacactattttgtatttaagttgattttacttaagatttcaaataaactgttaacattcttcttagaaaaaatttttttgaagtacttcattatttaaaatatttccaaaataatcaacagcttatttagctgggcatggtggcatgagcctgcagtcctaactactctggggtgaggaagaggctgatttcgagcccatatgcttgagcctagaagcttggggctgcagtgaactatgattgtaccactgcactccagctggacaacagagtgagactctctccctaaagcagacaaacaaaaaaacagcttctaaaccaaaatgacacataaaactaaggcatatcacttatttggactgagttgatgattgtgtagttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcacaacaaaatgtactgtttgttgtcagagcagcatattttcttgcagaaatgcttataagtgatgccaaatttaatgatagaatttcaattctggtcttacaaattcccatccggtagcagtgcatctgtttattaggaattacccctgaatgtgaatgatttcagtcttaagttgctgcacctgttgccgggaggtatttattccgatcagtagcctaaagcagagagagttatatcttgacattttatagcttggggggaaaaactgtcttttcaaaatcatttgttcagagaggagaaaatggagcaaaacagttcattttactctaagcaccgctatttggtggtattcacatttgcacagcacaaagctgcaatattgattttttgctcacagagcctcccaccagttctctcttcaattgtcagggttgcaagatggattagattacattttgctggttgggatgcttatttttttgttgttgttgaaatagaaatagactgaaaatacggcttggaatgaatatcacagtaatagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaataaataaatgttttcaggaatgggtttttatgtcttttataagatttatttagtgaaaatgttgggttttaaaagttgatactaattgcaataattttattaaaggcttttcaaagttcctttaaagtagcattgttggtggaagaggttgagctatatcccttgaagttttcaggaaaatagtgtaaaatggtcaaagaaggcacaacaatttatatttttcttaaaaatgtgtgtaaactttttattttccatcagttgttttgccaagattaaggacatgcccgtgccacagcctcaggagctcctgacaacatgtgcccaaggcggttgggctacagcttggttttatacattttagggagacataagtcagaaatcagtacatgagtgatgttcattggttcagtttggaaaggtaagacaacccaaagggtagagttaggattccaggtaataggtagattcaaagatttcccgattggcaactggttgaaggggtttgtctattaataaagacccgaatcaatagaagaaagtgtctgggttaagataggggttgtgaggaccagggttcttattatgcagatgaagcctctaggtagcaggtattaagagagaatagattggaaatatttcttaccatatttaaagaggcagttctggccaaacgtggtggctcacacctgtaatcccagcattttaggaggccaaagtgggcagatcacctgaggtcaggagtttgagaccagcctggccaacatggcgaaacctcatctctactaaaaatacaaaaattagccggtcatggtggtgcgcacctgtggtcccatctactggggaggctgaagtggaagaatcacttgaacctggtgggtggaggttgcagtgagccaaaattgcaccactgcactcctgcactccagcctgggtgacagagcaagactccatctcagaaaacaaagggtggggggcagttctgtcagtcttaaggtctctgttttaatgttaaggatagtcagactgtgtcagaattccaatgaaaggaaagtacaatgaggcatgtctgaccacccattcccatcatggccacaactagagaacttttccataattgattcatgtttattttctcttttccactaagtcattgattaaaatagttaacctaggaagatgttttcctgtgatttgtgtgaactctgcttagtttgtcacatggacttttgaaaattattttgacagtacctcacaatctatatggatgtgcacagcacatccatgttaacaatgttgttatatttatattttaagaaaacagagcaagttgtttattaattatcgatcacttgaaatgttggaatagcatgtgtacttgattaaaaggagcttgcctgtttagacttacagattgaggaaattttataagactttgaaatggctttaattcttcagaaaaggttttaattaaaacccagagaagtaaaatgactttgcccaaagtcacaagactgacccatatactcatacttcagtgttcagtgctctttccatgtgtacctacagtatagcatttgctgtctttatatttatggtacacatgtttacatttctacaaatatgattttcactactattcatgtagttttgtgaacctttacaataattatttcttgtcagttttactaatatattctttggtgattttcagattgtatgaagacttataaaataaatcttgttattttatcagcaaaatggcttgagtagtcagagttgatcagagaagggttctggagtctaagctccctgcatgggttagaatctaacgtgtggtaagattgagaccctaaatttactactatttgatgccttagtttcatactctgtaaaattggtactataacagcaactattccattgtttattttttatgttgttgaacataaaacaaagtgatccatataaagcatttaagccagtgccagcacatagtaattgctttgcaagtaatacttatttctctcttcatatttgttttttaaagaatatatatatattcattatatatatatatacattatatatacacattatatatatacacattatatatacacattatatatatacacattatatatatatacacattttatatacacacacacacacacacacacacacacacacacatatttggttggaaatacagactttagataagagaaatgtataaatatgtaacccatctgtcttatgacaattccagtgatacatatataataataaattgacaatttaaatatttttttggtgggggagatggcatataattttcattgataagtagtttgccttgtttttaatgttcaccatttgttttcactaccaaaggaaatagacattacaaaggaaagcacattgcaatttatgttgtgttaatcactagtttaattcaacaatttggttccacatttataagaattatgtatcatgtgctattgtaggcattgagattataactaagagccttactacagtctagcagggtagatatatatatatactaaaagtgaatatgcactgtatcacatgttaataagcacattagtaaagattaatatatctgcatatataaagtttaatcaaaacaggtaagagaaagaatttagaaaagaacattaatgatttaaatcaaaatacattgtaggattaaataaagtggtatttgctattaagaactcttagtgcaatttctgttgctataggaaaatactcagactgggtaatttataaagaaaagagttttatttagcttatggttctggggttctggggtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactctaatcctgcaaactaacaacaacaacagttaaagggcttgggttttaaaaaccacagtgcttcataatcagttctatgttttgacaaaatagtaagaattgcgagtgtggctccaagccagtcttttaataatgtgttccaatattcctagcattttctaataatagatttattctgttttattatagaattgtaattgcaaattgcctctgtatttaaaataggttgcatttcaaaattttatttgatgtcgtttgtttgaattttcacatagcttttgccacagaaatgtgtcagcttctgaagccataaaaatattttctattaaaataaatatggtactactagtttaagctgaattatttgtatagatatttcagtacaaggtcaggagatggagaaaaaagcagagtgtgtgtgtgtgtgtgtgtgtgtgtgtgtgtgtgtgtgtacatataaaagtttatgaacttgttggggaagaaatatattttggaagtttggcctgtgtaccatttgtcctgacatttacccagctctgtttctgtatcccttctgcattagtagtgcacctctccacatgctacagtactctccatatactataaaccttgttagtgaaaacctaccaagtttggggtttgccacaatctcctgaagatttctgagttccaggttaggtattcttttcttccctcttcagtccagttacacctttagttttctctgaagaactgagagttcagccaggtttgaaaattgctgctttttaaaatcataccagtatgtcacccagtactgctttggaagaatatacttacatctcagaaaagatcatgttcaggtctttgaatttgttgagttggatgggagcagtgctagctcctttgaatgtccatctgctgattcctttcagtgtcagttttaaataaagggtatttaaatggaaataagttattgtgccataagcatcttattgtcataaatatcttagttattgtggggaaaaaactgctaagatgaaggtattttttaagataatgcaatagcaattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacagagtgtttctcaactgaagatactttgccccacagcagtacatttgttaacagtccatgaacccacattgacacataattatcacccaaagtccatagtttacaataggattggcttttggcgttgtacattttatgagttttgacaaatgtattcaccattgtagtatcatacagaataccttcatgtgccacataatgactactttttggttagtgatgaactgcgtgtaccatggtggttccatagatgctaatggatctgaactgttgcctagtgacctcttagccatcatcaagtcgtagtgtgacgcattatcttttctattttaaatgtgtttagatgtacagacacttaacattgtattataattgcctgtggaattcagtacaataatatgctattcaggttgtcgcctaggagcaatagactgtaccttatagtctaagtgtgtagtaggctatactatctcagtttgtttaaatactctcattgctgttcctgtaatgataaaataggctgacaatgcatatcccagaaagtatccctttgttaatgatgcataactagtttcactgccctaaaaatcctctgtccttggcctgttcatccctcttatcctcctaactactggtagccacagatattttccagattggcttatttcacttagtaatatgcttttacatttcctccatatcttttgttggcttgatagttcatttctttttagaatggaataatattcattgtctggatagacacagttgatccatgcacctacagaaggacatataggtagtttttaggttttgtcaattatggatagagctactgtaaacatcagtgtgcagtttcttgtgtgagtataagttttcagtttatttgggcaaataaagtacaattgctggattgtatagtatgagtatgtttagctcaaagtggctataccactttccatttctaccagcaatgaatagaagttcttatttctccacactcttgccagcattcagtgttgccagtgtttgaaatccattctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagttgccttttctttaaaatttagatgtaaggaaaattttgcccacgttcaaattcagtatcattcaaattcaagacagtataaaatttgacataattgtttgattgttggaggtactgtagtttgtattaaggtgttaaagatggttataaattggtgtttagccactttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaaaggtaaactcataatttctactttattgaatttgagcagttttttttcttcactgagccccagtttattatagaaagtagataatacatcattggttaattttgtgttttaaaaatggtgtgtttgagaatgtgttataaactttaaagctatataaatgatacctcttaactggactgttgccttcccacatataagtataatacagaaaactgctgagaatggatatcattttttctgtattagatacgagacacctaactcttggcacctttttttttttgttttaattgtggtactccgggcatctttattagaattttcctatatgtaagatagtataaataattattgcttatatagaataacttgtccttttttaaaaaaaaaacttaaaaatcccaaaaccctaatagtttagcagattttcccctttatatttctcaaaaaatgtgatattcagtcatgtagtgatgggagacatgtttatttctttaatgtagaaagtttgtctttgaaaagttcacattaaaacattagaatttttccattaaatttgaaagccccccttcctttttttttttacatgtgatgatagagatgggcatagaaatttcagtaccattaaaatatgttttcattgtattttgctcctcttgtgtttttcactccctttcttccatgttatctcttcagcagttgagaatcaagtaaataaatacacttgtaattcaggctgtggacatggtaaaaatattgtattcactctccattttctatttcctgttcatttaaaagtgtgaaactaaaggctctagtagtaactgattatagtatactgtcttaagtattctgagaggctcatcctaaaaagtgagaaatgaaatgctttcttaaaatgatatttgttttaatattttatagaacagtcaccatttagtactctttaaagataattgttggggggggcaacttaaaaatatataaaagttataacactttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagacggtgaaaatatgtgcttcagttagtccctattgtagtaaggtgtattttgtataaaataggccccctgcctcccattttttttttttttttttgcggggggatggattgaaattgcccagggaaagtaaggttatggcctagatttatggaactagcctggctccttcaaagcttttaaccaaaaaaattttacttaagcacagttaaaggtagcacctgactagaacctcatagcctacttacattatgatgtttcttttatttttttttattttttatttttttttgagatagggtctcactcccttgcccacgctggagtgcagtggcatgatctctgctcactggagcctctgcctcctgggttcaagcaattccccagcctcagcctcccaagtagctgggattataggcgcgcaccactgtgcccggctaatttttgtattttcagtagagatggtgtttcaccatattgtccaggatggtctcgaactcttggcctcaagtgatctgcccgcctcagcctcccaaagtgtttgtattacaggcgggagccactgcacccagcctatgtttcttattaagtaaaattcattatatttttggttgttatactatccattcaaattccttgaagtttatttcagaactgggtggcatgtaaataaatagtgcagcaagccattgtttatacaggtttggcacttaaagagtagtcaacaaagaatgtaaaggagaaacaaatgtaaacataaagttgaatagttgccagtgaataaatgatatcacccacagagattatgtaatttgagtacgcaaaacctgctagacaacatctgcatttgaggagcagaggtaaaattgccataaaaaaaaacggaacagacgtgggagaattaatgttttagaagccagtagcaaagtacaaaagagatacttgaattttcttgatgatgatgaagatttttattctattttgacagctcaaataaaagaacatgttaggattttcgagataggagagtttcaagatagaaatcaagaaatagcaattagccttgccttgcatagaccagcaggaattaggtagtactctggtcacatggagccagatgatgaataaatataagacctgaatttataaagtagggataaacttctaggatttttattctatgagaaagagaaaaaaatctagctttagaactttaggtatagtttaattaacttaagctctataagcaacaaagctgatttcaaagctcagtgttttctgaaaggttgggataatggaagtaagctctaaatgtaggcaccagaataatctattccctttctataccccattcggtaacttttctgttcttgaatttcccttttctaaacttatcaatatcctaacctattatctctaagtataataattacactttattttactttttaaacttgagagcatatggagtggtgagaacttcttgtgtgccagaggctttgaaggaatgtgttgttgtatatgtatgtgcattactttgttctgtggttctttacattacagtggatgcagagtgagactggaaaattgagtgcatacttccacattcagttagaagtaagactacatggaaaggaccatgtatgccttagtctggaataagcagaatgatcttaccctctaccatgacacctcccattcttgccacgaggcaagccatataaatagggactctgtaggggatgggagagtttataggccatggcttctattttaagggagttattgagattgttagagctacggaggagcttgaggctcatcatattctaattccctttaattacacttggggaattgatgtcattataattggtacacttagttcacatagctacatgtatattctcacttttaaaaaaatctccttgagaaggagtggcaatttgatattctttttacttcgcaagcctttagaacaaggttggattattttccacaggggctgaaacctcaaatcgcctgtacctagaacctcattcatttaatatcttactggcatgaaaatgtattcataaataactttgaagttcagttttgctatctagacttttaacatgtctattattttcaaatatactaatagatactaattttatataaaatatttaaacaagggagatacttaatgcacacatacacacacacacacacacacacccctttactatgggaagtggtgaatattggaagcctctcagaatttaatcaagaaaattcattacaatgcactcacagttctgccagtgtactctggcagacttcatgattatagatttcggcttgtgtatactctcgttgacgtacagtcctctcaactttttacattgatcatccattcttcataaagaagctttgtatccaagtcagagctatatgaaagatatttttatttaattaatatttgttttctgatttttcctataggttacaataaactgtaaactcatctttctaaaatcttcatatttcttcctcattaatggcatttttcaaagggaaaaattagtgcagtatgtcttatggtgtttcataatattttggggttggtatattttattcctgaattattatgaatgcttactagtcagggttactcttgcttagcatattcattcagtatacttactcattctcttaggatctaagcctgccatgtctcagaaactgcattcttacccttatgttatttatcccaggtgcttttatctacttgacatgtcaggtttatccaccacttgtccattagggtaaaatacatacgggggaaatgaaataacttggccgctcctaacccatcatgtctatgcaatctacttaggttattttctattagttgatggatttctactaattctctcactcgtggcctagttgtttcaagacaactaactggtattacaagcacatctctgtggccagtctactaatatagattcttgaattttagtacagtaataaataaccattaaagctcttattggtatacctaattggacacatactttgcatgtcacttactgatggacattaaagcaaagcactcataggaaggggagactgttggcagtaataaacatgaaacttattaaacattcacatttagtgtgcaagaaagactaataaattttgaaatggtttagaagataaattatctaaatatcttttatgaccctgcttatcaaatgtagaaaagagagaaataatgtcacatcaaaaattctgccctataggatccttggtttctccttttttttgacagggtcttacagctggagtgcagtctctgctcactgcagccccagcttcccaggctcaagtgatcctcccacctcagtctcccgagtagctggtactacaggtgcatgccaccacacccagctaatttttgaaaagtttttttacagacagggtttctgccgtgttgccctggctggtctcaaaactcctggacccaagagatccgcctgcctcagcctcccaaatgctaggattacaggtgtgagccaccaggcctggctctgtttttcattttaaaatgaaaatcagtaaaacagttctactagatgttgaagactgagaatacaggtgtgaattggctcattttcactggtacttctcattaatttagggggtttttaccttttgtattatgtccattgattggttgaggaaaccagagtattttccataaggacattacattagtggtcttaagtattccctaaggcttattcagtgaaattcagaagcttgaaagatactttaaaagtttgaattttattttatttttgaacagatataggctggataagggtaagggaaattagtttttgaaagcaaagccatatctcatttcaactttggtgattttgcttcagtttttatttttagttttgaaaccaaagcggagagatgaagaaataagatcaaaatcaatagacgtgaacgtgaacatttcatttgacctctgcatttcaatatgatcataatgatctttttatagtgcttttcatatccttagggattattatgtattccacctttctcatttgaaaggagagtattatggatgggatgacaatggtatttctgtggtgtctatatcatcacataccttgtagtttttcactcacctagaacattccttcctgtacactaaaacatcggtttctatttacaaagtatgacatttaaacaagttaattgacagaactgtgtttgactggtatctctaaaatgtactaaacaatcaagtgttaaatgtatttacttactgtctaaggaaaattattgtgggtaattaggttcatggtggcattttactaatacacatttatctaaacgaccacgagatcagctttcataagactattttcagatacccattcaaggactttgttgttcctaagtatgatttcttttcagtatggatctgcttgttgatgtcatactaataatataaaaattttgcttacaagcatcctttttaaaaagttatactttgaacagataagaatagatgttcagttacagttgtaaaaaatagaaatgaaattttattgtaaggtttcacatcaaggcaaagtcaactatttttgcttgtaatttggcattttcttctgttttttttctttttttgacaccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaaggagatatctaaataaataaaatgcctagctgtatttaatagagaaaacatcttactaaattggtttaccccaaatccatattttgtttttgtactaggttaggaacacgatagcatgatgagtcagtatactgtattgactaattttattgaatgaagagaaagagagaaaaaaaaaatacatatatatgtctttttttttctttttgtggggaacatggtctcactatgttgcccaggcagatcttgaactcctgagctcaagctatccttcttctacctccttcagtgctggaattacaagcatgagcaaccactcctggcgagataatttgatattaaattatttaaagatcttaaactgtcatttattatggccctattaattttccatatatcctatactgaaattgcataccaaaactatgatagtaacagcagcaacagcaacaacaaaaaacaccagtacctactttgtacattatctgaggagaataattgtgggtaattaggcttctgatggcattttactaatacatatttttgtgccttgcatattttaaagatccattcttttttctttgctatgtattttctttaagtatattatagcaatgtagttagattttttttagtgctgtttattactccactattagttttagaggtaatacatctcttgtggatgttagaaggaaaaatctcattatgaaaaaaatagaagtaaatgattttgtagtctttaacacatttaaatgttgtataaataaatcagatatattgtgaaactaacacgtcacggttctctcaaaatttgttaacatgtcatatgtgaagaccaagaaagacatagttttagaactcacctatctacattactcatggctttaagaaagtgtctgaaatgagagttgctctatttaatttggcttgagatgattccagtggtctttctgtttgttttttcagaccgcagatctgttattgttattgaactcacctgtaatttgtggaaatcttactctgtctctaaagatagattcatggtaaacccatgaaggtaatgaatcttaaaacatcacagcccttcacttgcgtgggtctcttctaaggcatttgaacaagttcatggggtcaaatacatacagtaaaaattggcagaaatacaatatttaaacacaatctctaaaggctctgatttcattctctgacttttctgatatacttcccctcatttatggtggcttaggaatagccaagcgcatttagagatgcagttagatggaagttcagttggtgttaaattcaatctaggtttagtggagttatttttacgtggtttgtagacacttgtatacagttttgttactgctaactattctggtgaagaaatggcctctagaaatacttctgttactcattatacttccttcctgatcgtgacataaatgtgcaaagccagatgtcatattgcaatttaaatatgtcctatgacacctgagatatgtgggtagtggaagagagataatgtttgtagtgtatggagccagaagctagtctatggaaaaatcctttcattcattacatatatatatataacattaagggacatttggttttcatagatagctaatccaaagagaagttttctcttacatattcttggtggagtatgtagagtacacagagcacatgacaagggtagtacttaaaattaccaatgtaccatactttccccctcttgatgagtaaaatatgaaatagaatttatcagaatgccagtgtttgtaaggcacaggctggagcagtgtagcaagcacgagctcttgtggcagtgtgggtgcatgttttatgcatcacaactatcagtagtaaaaaacaaatttggatcagctgttcacaggaaaagcaacattatagaaagtaaactgaaatttttacatgaagagacactcatagactatgtcgctaaaaatattgaagtattagaaaggaatatcaggcaattaattaaaatgctttagttttctggattttgttggttgtggttcttgttggcttttacaaatttatttcttgtgatttctttttctaaataaccattcactttggtatctaattttctatatgtaatttttctattttgttttttatagaaggacccttaaattttacaagttttagaccccacaaaacttgaattcacgcctaccttttttatttatcaggtgatagtttcaagaagttggcatagcattcccctggacattcacaggttgatatgtacattttaggatatttcattgtatctttagatatcttctttgtatttcagagatttaggatttgggagaagagagactgaaagattaaaaattaaacaaattcattttttaaaggacattatttaagtttataaactaaaacatttatttatttagtaaaagctttgagctagaataacccattttcgcagtttatgttaaataaatgcttggcttaaagccctcctattataatatggacaaaactaaatggaggaataaacagattttaaataaatttcactaatatactttgcttttatactctcctcccccttcttctcctcctaatttttggaagtttccctcaccctcaactcccattacagactttatatgaagaaaactattatttaagttacttttccttagtaatggtgtttctgttagatttataataaaaaacatcctttagtaaatgaaagctttttttttttaagttttactcttggtacttagaaaaatcacacaggaatagaatgtatgctgattttttaatgatattttataattctgtaatttttttcatacatttgattatcttatgacatcctaaagtgttcttatcattaattaatagaattctatgtaaacttgaaagaatgtttgtaagtaacttttgaaatcaaattgtgaaatatgtgaatgagactgtacctttgaaaatgtacaaaagcaggtatgttagatagataaatagtggtcataacaaatatattatctaataagttggttcaaggcacttttatatatcttgccatttatttcaacccttgatgagtagacctttattaagctgtgatgattactgaatatgaaatgtaaccaagattattttttattcaaatataatttaaatattcatcaaagagaagttatgcttgagactgacagagactattaacatcaaaaaatataattaactgcattgggtatcatgaagcagagttagccaaatagccgagaggtctaattgctctagagtttgagaagcaatggttttattttatgctgtagctgtggaattaatagtaatgcggtttcctatgtgggccaattaaaagctgcctgttaaggttcactgctctataggaaacccattgaatatcgcttagtaaacaggattgacatgtcaatgtgtacaagaagataaaatagaataaaaactgtgaaaatgagaagtagtattaaaagaactgtccttgaaaacaactcataaaactctttaccattagtgttatggttggtgttgtagtgtgcctcccacgttcgcctttcaggatcaggcactgtttctcccagctgtcaagagagttgcctgctgatgggctcacagctgagtcactccacaggaactgccacgggctgaagggatcttaaactcttctccccagaggcagcccccagtgaatcccaatgaatgccagagtacaaaggattggcttcttcatctttgcttcatttcagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaaccaaagaaaagtgctaatacattataggaatctagtaattaagtataaaaactaaaggttttaaaggaaaaaaaaaacaaaaaaaaagcccaattcaggtctaaaaatggctttttgcactcaaaacgtttatctttgtcttgtcatcctttttctttaataaaagtaatattttgacctttgtggctctattaagctttttaactgaatacaaaaagaaagtgcttctgattgaatccaaaaggttttgccttgccttggctatagaggtttagaagtgggcagacattctaatggcattttgacattaatgaggttgctgaaatggaaaagtttaagggtcaaagataagagcagcgacaagttattctagtgtttcttttacttaataatgtcatatcaaatatgcttaagaagttgaccatgattccttatgtagaatatgtaatgttttatgagtatactactttaagtattataatactttttgcaaataaaaaaattctaagacttactataaaacatgccacctcagtctattaatatgtttagttgcaacttctgcaaaacgtgtaaaaaattttaaaattgcttaatagattttattgtgtacaatatgataatgtgtatagtgtgtctttaaactgcagtgataaggctgttttcctagtcattcattatttaatgtgcttactctgtttatatctgtggcataagagtgcacgttagctttcagaagagcacaacatttgctgcttcacagcacacggccctccactcccaagcctgcacatggtgttagtgatagttaaagcacttgagtctaacattttatagattttgatgaaccgagcctttcagacaagttactgatatgaagctaattcaggctagaagtataatatgaggatagacactttctgctttcattgtcacttttaaaagcttctacaaactgcttgtgtaaactataaatcagatacattttagtttggtttatatcatatggttatggaaccatgcttggcttctgaaaatgatatcttgtctttcattgattgatttgctgccaaatgattagtgggttctgagatatagaagcaaatgtgccaaacactctaacagtatttattaacaactggtaagaatatattagtatatttgttagagtacagtctgatgtttatggagttaatatattttagaataaggtagagcgttatgcagtgcatatgattcagagactcttaaaacagtgactaacccctcaaaggctctgtagtctggtgaagaagaggagataatgtacagaaataactgtgataccaaatctcccttatagtgtaacaaactttcaaaagctggtggagaagggaaagtggtaagttatggcctgagaggggaaaaaatactgtatgctcgggatactgaggaggtctgttcagggaggtattcagcttctgtcccctttctttcacactctgtaacatggagcatgttcgccagtttctttttcctttcgggcattgtgagtgaattccctcctttcacttaagctaaggaggaaaggatctttcaaagattgtgtttatatatatctcaaaaattatgaaaatagtcgtacagaatatcatatttaaaaaactatttttaactctgtaatgtcagcatggaaaatagcactaggatttgagtccttaatattaactccgaaacagtaaggagttcaatctttttatagtagagaagagtaaggtacagtttgatattcacttgttaatttttatctgtatagatattattcagatgtggcatatttatggtattactatgtttccaaaattacaggtatttctacactttaggatataacagcacgtaatgtcttctaccacttttttttaaaaccagcatcacagatgaataaaaagttatctggctgggctcagtggctcatgcccatagtcccagaactttgggaggcggaggcgggaggaatgcttgaggccaggagtttgagaccagctggaccaaaatagtgagaccccatctctataataaataaaatataaaattacatttcccctccctgcctttcttcttttcctccttcttcctatttacctgtgatcaattgatctatctatgtatctgtctgtctatctttttaaagataatttcttgcttttgtgactgagatgcagcaaaaggacacttcccttgatctgtgctttttagaaagagctcattgggtaataggctgtagactgaatatttacgagttggtgttcagttatcaagagaatgccatcagcaatgccttgttgctttcttatcagctacttcctgctgtcagcttggcacttatttcaatagaaaaggatttgcatcaaatgtaatgccttattatatacagctaacgtggggtttttaattgtacaaacacatgagactcctgcagtggtagtcaatttgataaaaggattagattatgaatgttttgtcatgattaaagattagttcagatttatcagaagtaagccagtgaaatttgtcatatatttatcagtcaggtgagactccattaatctgagagtgtatgaaccacaagtagccatctctttataaaagtctgctgaatttggttatttatattcaggtgacaggtgctaaggattgtttttggccttccctacttgctctactgctcagagtatcccaagagtctatgtctctagcttttggtcactattttttttttaatctcatcttatagaatagtttggtaaacatctacacaaaatttctgtagtttttattaaagaaatgacaactagtgtatacctgaagacattttgaattgttcctttgattaaaaaaccttcagtaaaatacggaagattgagaattccaacttagaaggtatttaaattgagtacttcttgccataaacaagactaggcattgagatagattgaaaagaagcctgacatacaacagaaaggtgaaactacagtcccagacacaactaaaattactgtgtgaggcctgatacaacagtacccactgctcttggagtgtttgggaaataatataaacaaggacataagaagtttaccgtgtaattctagacatggaaaataattagtgagtttagcagcaactaaagtgcaaaatataggagatgccataaagcagaatgtgattaacttccaaattaataatatagagctgctgctctaggaaaagactacttccgattcaggtagtcagggaatataatcctgtttggccagcatcatttgtattggctttctgtataccacctgtgtggctgattcttcccgcatatgtgtgtgcctccctcaagtatataacagggagatcctgtttttaggattgcatggagggcaccactgggagttggaaaatagcagttcctcagactagaagcatagtatcctaagctctgataattttctacctcagggacttaacggtccttcaaatggatcttcttattaaggaagagatagttcaagaactgtacatagtcatttatgtgagaactcagttcagaggtatttgctagtgtgctagctgttttaaattacatagatatcaagattctcaaagtctacatagaaaaggttgcctctgttaggatgatttttgtagagacgagtactgagccatgcttatggagtagataatatcgtagagagatgtttaggagagagatctttcagatgcagtgattcctctagcctgtggtgttagtaagtcaatcagattctctgggccttagtatattgcacctatattaatgaagaattatattagatcggtgatttttaaactggatttcttggagaaaaccctcaggttgaggggtgattgaggtatatgggaggagagatcaagtggatttttcaggggtttggagccgaatttcgctactataattccagacctgtctcaacttctatttctaatccattctattaagcaggatttttttgttcattttttaagtaaaatttttcatgtcaaagagattgtgttgccagaatctgatactgatttggtactactgtatttgatgatgatacataatttatgctcatatttgttattaagcacatacttgctaacaacatttttaaattaagggagaaggatcctctgttagaacagaatacttgtatgaaaattcctgaggggagttgggatataatttgaccatgagggtatactctctataagtagatgataaagtgaattccttctatgtgggaaagaaggacataaggaaacacagatcaaatttgaaattcaatagttaatagaaaaagattcatggctttctgaataattatgtagcactttgtttttagaataacagttttcactttgttgaacctttggagaaacatgaactatgtatttcccttgccctccaacattaacttattaattcagttcatatattcagatattgcttgctcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactgcaaggaatttcaaaggtttctaaaacatagaaagttgtttttagaaaatcagcattgccatttcaaaatgcttattttagtaattaatgtggtatttttaaggaaatttttggagtttctaagttgtaaatgaactaaatattaaagtatgcatactttgtgtttataaattctggcataatattttactcaaatgcaaaggttatgggaagatgttattctgttttcattgactgaaaaaaagcacgacaacctcctagaattgattttccataggattttactgtcaagcttttgttgacttgccaccagttacttgatttttacttggggagtgaggactttctgtttctcttatacactatactccttttcagtcaaatggatttatgtttacacattgaaagtacagaaaaacattttgcatttttgcttatgattatcattttaataataaatgcaattttaaaataatttttatgcaatttcaaggatttaatcacaggtgcaattttaaaaaatcaggattatatttaaaactttaaaaaagtagaaaattgaatgtaataaaaattatattgtttatttttcccaaattatgtatctctgtgtaccagtattcatgcatattatgctagagattctgaaactaactttattacagtaatgatttcaaaataaataacacagtgttctataatgcaaattgtataatatcctaacatacctataggattaaattctatatgatggttagaaatctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttttggagcatgactggagaaactaatgttatcttgccaaaacagaagcccctgcttaatcagcagaacaagactattgattaaaacacctctcacaatagattacacatggaatctcgtctccatactttgcacttggtaaagtgtaataatgagcataagataatcaaaagaagagtaaaagcaatttgttgggcattgtacaattcaagattagagttggaatggaaacaaatttgcatgaatagttgagcctgtttttaaagctgtacacagtaaagagtacgcacagtgcagggactactgtggaagagtaaaagatgttctgcttctttaagatttgcaaatctgttcatcttacataggggacattgttattattggtatttttggtggcggtggtggtaatttatatttcttgatgtttgttatccaggtattgtgcagagagttgcctgcactatcccatttaaccttaacaaacttctaaagaagatactacgttttacagatgataatgctaaggttgaaaggtttaatacattgcttatggactcacaattaagtaagcagctgacctggaacttacacaccaatttttttctgattctacagcttctgcttttaaacactaatcttcccaattatcaaatgattttgcttttgaacagagataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaataaacaaaattcagtgttttgtcccatttaaactagtttatgacctataaagcaagacttttggattttctttgttgtggttgatggattttattaatgttttacgaattttaatgtcagaaataatacttttattccggtatttgaacttaatattaaaaggttttattattgggtttattttagttatatttggaattctcaggttgagtgttgtactctatatactttagaatagtaagaaaggtctttaaaattgtagtcagaaagttgcaaccagaaattatatataggtgatacttcgtgcgtttttaacccagtgatgtgaaataatgattaaatctttgtctttgtatgccaaatttgaaaattttggaaatgtgactagaaaaatactaaaaatgattatatgtttagaatttgggactgagtgcttatgtagttttatgtttattttctacttagtatttaatcatgaattataccctggaaatggtttttgttccttgtttttgtttttgagacagggtttcattatgttccctggcctgtgcttcagtggtgccatcctcccacctcagtctcccccaagtagctggaactacaggcacataccaccacacctggctaatttttttaaactttttgtagagatggggttttgccatgttacccaagctggtcttgaactcctgggctcaagagatcctcctccctttgcttctgcctcccaaaatgctgggattataagcgtgagcaatagcgcctgaccccgaaattgtttagacattattcgcaaggcctacttatgcctctgagttctctctaaaaacagaaagaaagcaatttctgtatttattgccttcctagagttgagccactttattaacatttatttgaataagtaagtcaaagattgaatataggaaaattggcagtgattacaatgggtcatatttttctgttatttttaatgacatacttctgtagaacatagtatatttttacatattctcaaaagttttatttccaattttagtgtttcgttagcacatttttagcaaaacattatacttcttatctgttaaaaaattggttcatatgtgatgtatacatgtactcagataatatacttatttcaattctccatgttaagaattgatgaataactagacagcttgctcaaaattagagcaactaaaactcttgatttctacacttagaattagcaagaagacatattaacattgtaaactgtattatgtacctcttacataagttgtactcatcacttgttttctgtttcacttgttttactaagttttatagagcaaaatcatgttttgccattcatatttattctttagtaaagtatctaaacctatctcgttttaaccctgtggctctcacacaagttgcactgatcagagtcacctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgcaatctcagctcactgcaacctctgcctcgcaggttcaagcgattctcctgcctctgcctcccgagtagctgggattgcaggcatgcgccaccatgcatgcctgcgtggctaatttttgtatttttagtagagacggggtttctccatgttggtcaggctggtctccaaatcccgacctcaggtgatccacccacctcggcctcccaaagtgctgggattacaggtgtgagccaccgtgcctggccaataatttgtatttctaacaagttttcagctgatagtggtgctgttggtatgaggaccacattttggaaactactgctttcactatcttaagtcatctgttcatctttataaatataaaatgaaataagaccagttatttgaaagttgaagtgttcaaaatatattctagtatctgcttctttatgatgaaccgtaattgtagttccttcaaattgtagtaaaatgtctactcattaaaaccctattttttctcttttgccttgttctcattcataccgattttttatgcttaatgtgtaagaaaattgtaggttattaacgtaataaacccacatggtattaccaaaatatactgatagtttgattgttaaaacaatgatacctttattggtaaagaaatcttcttctgtagaggaagggagagaaagtcatgccaggaactgtgcccagtactgaaaatacaaacgactaaacactttttctttcttggcttaactctaccttttcgctttcattagtatgagaacttgaagctgagcccttggcgggaatttactttgcttctgtggataagtaattgctttctttctggatctttttaaatgatagcaatttacacttttataatcttatcaacagcatattgttaaggaattttcagatttttcttagtattaatagctcacgttgggtgtttcccaatgtctttcttgtctcctcactctctatttggaaacttaatgctgcttgcaccctttataaaggaatataaatgtctgtatttctatttctgtaatttgggcctctaaaagcttagattcatttccatgaatcaagatactggcatgcaaagttctaattttcttgtactttttacagttggatttctctcctttctgacccttaactgttttagctctaaatttgccatttttctcaagattaatttcttgcacttctgatatctctgtgtatataaacatatgaaattttcaaatttaaaatgaatattttttatattttgggaggccctgaattctagaattttttataattttattgcaggagcttcattaaatcagttttgcttaagattatagttgtagaattaatacgttttgctgtcttaaagtggatgctttgtgtaatgtgattatttaaatcaataaaaattatgtggttggtataagtaatcataattgctttgacattaatttgaacctgtaattggtcagaggactactgcaaagttgttcagaaagagtaaatatggacagttattttttattatggtgttggtcctctttcaaacaaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaattcaggttttgactcttacgtttctgtttagttataggaccatttttaaaaattgtaatcttaattcttaatatcctagtaagatatatccaaatatcttaatatcctagtaagatatttgttgttgatcttgttgtcgttcagttcatgttgaatatatcaaaaattaaaatgtataacaatgataggaaactgttggccattatttttttacttctagttaaaatttagtgtgacccatgataccactgtattacaacataaagaaaacaaaactcttataaaatatttaataatgtagagtaacttaacatcacttgaatttttgttttatgtttctggttgcttaaagaaaatgagaaaaacttctatgttatatttaagtgaaaataatcaaataaattatgttacacaagtttgatacattttgtttttcaggtgcaacaatcgaacacagtgtatagtagttactgggtcagatgtgtttcctgatccatgtcctggaacatacaaataccttgaagtccaatatgaatgtgtcccttacagtaagtatgcagtttatatttttttacactttgcccagcattacttgttgatgctgaaagactacacatgtgaaagaagcatatgtttatggcctacaaaaccattatgtatgcagagcactaacagacttgggcctccaattaacttcatgaagtgtggaaggaagccatagtgtgatgctggccaagtgtctgtctgtgttcttaagtgtttggcttttaaggctagtgtttttccagaaaacaaacttgaattagctattcaatacggctgatagaaatctgtacttttgcccaataccagttgctgacaaattggtttggctcacagttttctaaagaaggaattgacttcagttttaatcgtgagctacttgaatggctacctgctgttgtagtaagtttagtgctgggtaaaagctaccattgcagtaactgaggcaagtgctttactttttgttctattgtctttaagggagcatttctttatgggattcagtgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattcctatatactctacagtagtgacactctataaattgcacggtttcaactaatattaaaatacaatgcaaagagccttcttagattattctaatcctatgtaggacagtgtcttatctctttttcccattttcctcaccttttgtttctttctacctctgtccattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgattcattaatcatcaaaggtttataatattttaaatctttacttttgagtgttacttacttttcaacagaattataaaatatatacaatatataatttatacttattttccttcaatatgtgatatcaattaaatctcaagtaaataaagactttgatattctattccctaactacattgtaattttagtttatcaaataacaaaattcagccattttcaatgaatggaaagcaaaatacactttctacatcttctattgaacttgttttaagttcttttttaaataaacattttaaaatgtattatttccatcctttacatttaatttatttcagtaaaattatcctttccttaggggaaaaaagcatacagctgtatataaattgtagtttgagtagtcacaacgctaatgatttctcttatcctgattttctcactacgcccttccgttattgattctaagcaggtataatattgctcttcgctgaggagtaattttaggactagtggtttatacaaaagtattgttttcaagacagtaatgttgaatttcttgtttttcagatgtagtcagaataacacattatagagcaagtatgtttcctgaaagtggttacatagaccaagttgattggggaaagttgtagcttaatgtggaaagttgtatgccattcctatggcaaaaatgttcgtgtgatgttttttcccataagtgtttcagaaggccaacatttaatcttgatgaattattgtaacttttaaaaattaatcaaactaagatcttaataaaatgtgcactactctgtctgagtacattttggaaatgcagtattagcaaccctgatgcattttaacaacagaaaagggagaaacagacatcagtcttgtcattttatgaaatttaggcaacatacttcaagcctatatacaatgtaaagtagtattttatggtttgtaagtattagaatacggtttaccaacaaggatcttacatagcccccttcctaacttcataatctgtttcttgaaactgtaggagttgtttttttttttttcctcatgtaactctactaatcaggtttgttttatgaaagcatttactttttataaggtctgtggagtcaaggtatttgctctgaatgctcggtatgattgttgttgcatgctagcttgctttctatgtaaattgatgatggtagaattgtcataataatctaaccataattctttcttcctttttctccttgcctactgtgcttgcttttcccttgtatgtattttgcttactttttttatagacttagtattacaagtttgagatatataatatagaaaatttaataagaattttataataaaatgtatatgtaaacctaactaagtaaatatactaattcttagtgggggagaaaggtactaccttaccctactcttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaaagtgtcatcttgcctggcttccagaaccctctccatagcatgccatggttacagggtctcctgattgtttcatcactgcttttcttgcatttacttttctgtgctcctaattgcattttccaaatacttatgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattgtggcattattagtcagcttaaacttttttcattgctaaaaatataatactaaccagaaacctgttagcagtgtttttttgtttggttgttttcccctacttgactgctgaattgattacaatctatgttcagaccttttaacttcttggcgccagtggttaaaggaaacgtgtgttaggaagtcccaggagaatggctaggcttgatgtacaatgccagatatatgcgttctaaagttttggtgtctgttctctcagtaggagagggagccatccaatatttttctagattatcatgtaaaattacatgtttttattttctgataaattagtgacagtttgaagtcaatatttctgtgactttaacgatcacatgaaccaaactttaaatgatcccaagtgatgacttgtgatgacagatatgcaagcattgtgtgatttgtattctctttatggaggatcattactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtgaataaagttgagtataattcagttcaacaaataaaaacattacccatctacttgccacaaagtacttcagcaaatacaaagatggttagtaatgtcatcctccacatgtgtcatatattctagcaaataatttgatccatttcagatgaaaagtctttgatagtttagatgcttttggaaagagcagttaacagccttgaaaatgagaagcttcggcagatgtagcaactgtatgttcctacaactatggtttgtcatccaaaatagccattctttataaatagtcccagaacatgaaaattcatattgaccccttattcagcccttagtgatgaaaagtattatctgacctaaatttctctcactgctgtttgacccatattcattctctctctctctctctctctttgtaatttatattatgcatttagagactcccttctctctgatccaagatgtgtgctacctatatgcatgtaggtggggtcttgcagaactattctggcccacaaatttaggtcaaaccaataagccactgtcagctttccagaaacaagatccaagaaactgatagaacagagcaatcagagaaatgaggtcttttgcctgtcataaagtagtgattgatttattttgctgaaattcgtagttcaggtcatctgtgctggatttgctatcacatatatggccaaggcataaattgtgctataaaattatccattcgttttttttcattatctatgtcatttttcattgtggactgtttaataatatattagcctcaatactttttcccatttataaatccaagccttttcattcctaaaagcacacgcatattatttttgtgccttaatctttttttttttttttttggtgagttttgagctctgtgtgatccctgcatagttcatttgctccactcccctaaacgaggtctgtttttcctgtttcaccttctccctctctggaatggccttaggaaaaacactttccagtcctgttttaactcttttccatttcttaatctggattgctttatatttacttaatctgtctgcacatgtgatatcccaaatattataaagaaaatgatgtgtttttacttggcttttggcagttcctcaacatttgggttagactaattaatgatgtgatacacttctgtaataccaggaaaaaatttttataaagagagccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgtacctctaaaagatttagttttgtcacttaagctttatgatcatgtttattttcatgatatcccaatatttcactgatttatttttgaagaataagttgattccctttaatctattttggtgatcaaaaggtaaaaagtggctgggcacagtcgctcatgcctgtaatcccagcactttgggatgtcagggagggcggatcacgaggtcaggagatcgagaccatcctggccaatatggtgaaaccccgtctctgctaaaaatacaaaaattagcagggtgtggtggtgggtgcctgtagacccagctactcgggaagctgaagcaggagaatggcttgaacgcaggaggcggaggttgcagtgagccgagaccacaccactgcactccagcctggtgacagagcaagactccatctcaaaaaaaaaaacaaaaacaaaaaggtgaaaaggtataaaaataaattatcaaaaaaaaaaacaatggaaacatggctgtagaatgttgcatgaaattttgcacatttaattgaggtccttttaatgtctaccttgactcggttattatgaatctcaactaatgcttagctaacaaatcactaattgtagtattaatacatatttcagtgattaaatatgtgctagttagtacagtgtcaagggatatatcaggtagtgtagcgctcaagcattttgctctgcccccttcttttttctgttctgattcccgactcccctttaagacttgattcagcagcagtcatttgacacttctgcaaaagattgtgatgcttttgacaaatgttaattgagaaagcactgaaagcctggctgcattgtaatcaaaagaaaattacagaggtttaacaagatgtcaagcaagtgctttaaagaaaagatagacaggtttgaataggtttctgcagcagctggctaggcatgatgtttgactgatgtacataggcatctctcatatggtcaataaattatgccctggaaataaaacacatgctttagaagtttctcttgaggtagagggggggaaaggaataaaacgtgtatagtgtacttactggtaacaagaagtatgtaactactaaagaactagaaacatgtcacactactttttcgtagtttactgtcagtagtgtcagaattaataaagaaagattgatggaccagagagcttaaaatagtaaacatatcagtgataatatgaacttgttttctaataaattctaatattctagcttattatctcatgtgtagataaagtgtaaaataagttgattttattaagatgatttgaaaacatagctatttttcatttgctctactacaacaatttaaattgaaggcatcatatatgtaaggttttaagagccaataatctgtaaatgttgatacaactttcgtgtgatttcctccaacagtttttaagtggtagtattaaatttttactgacagatttttgttgttgtttaaattaattcagtggtaattaatggaagaaacattgagctccactatttcttaaacctagtggatttaacagtttagtaacattggaaggcaaaaataacctttgaaaataatgaaaacatttttgcttttaaatgtgtaacgatagttcttttaaattctctgttaagggtgactaagatatgaagggttggtttgaattaggcatgatttgatctgatgctttatcttggtaagagattccacctctgactggaactagctgcttcttcatacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgtttacagtagctaactttatttttgtactttggtaatataacatctatggacaaagttttttaaactgtaaaagtcatttaagatcaggcactataaattacctctccctttcagagacctaggtcaagcctgagatttttgccccaagactctagtgagtcttccttacagctgcctttctcattataagcatcactttggatgaatcccaagaaaattaagggtttttgtttgtttgctataaatatatgatatttctatgctgacttcatatttaccatttataatctgcattataccctactttttgtcacttattgtcaaatacttgcattagagtttattcaaaatttaacacgcagagcaggatcatcatagctgattcccgaatgcatgcagaaaaatggtttcaatttcactgttgttttctacatctgttgtaggaactgcctcatatctctgcatgatttccactggaacatggaaccctaagggccccgatcttagcaactgtacctcacactgggtgaatcagctggctcagaaggttggttggaaccttttaatatgacacattggtgatttagggcattaacttctaacataaataatttagctttgtgtgttaaaaccagctttattgctctttgttcagtataaaagtaaaaaaaaattacgcatagttttgtctgtaaactgtttattgaaagttacatatgtttgggggtatcctgttctctatgttaagctttttagtgagtaatgcttgttaatttcattcatatttagttctgtttcttttgatgttcataagacaaaatgcattcgccgattaaataaaatatcattaagtttacaactgaatccacagaatgcaagcagatgtttatatcacacatgattatggtagaatgagtaaactactttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagttgccgtctccaggaatatattgttatcagtgccattaatttttcctattatgacaaaagttggattgctacttttcatcacactataagtgtttatattaggttcataggaacccaaaatctgtgcctaatgtggttctacctggttaaaaaattgacttttttttttactgcagtatatattttgtctctttttgtcaacatattttagattagtatacttcataaaatagaataaaaaactgtaaataagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaaggcatgacttcactaattttggttggcaaggtctaggaaaaaatgacgtctcactagttagtattggacattgttgaacttgagaactttacaagaaaaggtagtaggaaagtctgtttttaggtaataatggtctgaaagtccccttttagcctgtttaataggggcagagaaataactgctgaaatctatagaatttttttaaacttcaatgttcagttcacctttaaggtattagttaatgtatgaaatgtaataattggtatgttgcccaggacatacatcgcagttggaaaagaatagctttttttttttcctttggcagaaagagactacttcaggaatatgactaggctaatgatcattttgatcccactagacgagtacaaatagtaataaataaggagtgtttcaaattaataaaagcatgccattagcaagttatgtgtatatggagtaaatttcagcatgaccttaatttctgaccagtgtcattttcagtatgtctcaaatgagcttctctgttcagataagactaataaaactctttaaattacaaatcagaagctgacttacactatgcaaatgaagcaagttcccactttgtgacagaggattcatttgtaacttagattagagagaggctccagtctgtatttcttggtgactaatgaatctggcctctgcagaccaatttctgttccactctagttaatggctgccgcagtatcagtgtgagcatttcgactattctgtctcccattagagggagaaaaaaagcctttaacgccacttggaagtatcttccacctgccaggaaggtcgtggtgtctcacacggcagacagaacgaggatattaagatggattaagctaattaatcttactctgacagtagcttcaaacaactttcccccctgttcatatagtacctcacgctagcaatttttattgttgttctttttgtacagtgtgtgttctttctcttcagtaattaccaatagatcagaactatgtgtttatgggcataatgacacattatgactgggtgaatggaatagagtaaataaacttagtgatttcacctttccaaagcatagtcagtgcgtagctacagagtgtaggagtataagatcctgccttcagttgattaactgagttatattttatttaatgttattttgtgtagcaataaattaagcctacatatgtgcatatttacaacttgggtgtttatgaagacttgattctactttcctgttttctctaacttatcagtagaggctttaatttttattcctttctttatccctttaaaagcagatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacagactactcttccaccagaagcagtgctaacttcattagggcagcagatactgaatgaagacttactatctggaatgccatatcttaatgcctaattatgccttattgtgcctgcgtaagtcatgagactttatataaaaaatgcagatcaaaggggtatatggaagaaatggacataaatcaaattagcacctatatttgaattcataatcttaaatttattttatataagtgaatttttaaaaagaaatgaaatattttaaaaataatttgtttttatttactttgaggtttgggaatgaaaaatcagtaattaccgaagtggcatattatgacctcaatttgttttctaaatattctgaaaattattaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcgcatgcctgtagtcccagctactggggaggctgaggcgggaggatcacctgagcccagggagggagaggttgcagtgagctgagatcatgccactgcactccaccctggatgatagagtgagaccccatctcaaaaaaataaataaaatttaattaaatgaaactaaaggattatttttaatgttgatcttttttcatttttaattaaaaaacactatggagagactggcatctctaaaataatgcttggtatttactagtctaaatgctgattacccaagaattatcaatatgaaagtcattttacggccgggcatggtggctcatgcctgcaatcacagcactttgggaggccgaggcaggcggatgaggtcaggagttcaggactatcctggccaacatggtgaaaactcgtctctactaaaaaatacaaaaaaaaatgggaggccgaggtggatggatcacctgaggtcaggagttcccagcctgcccaacatagccaaacccagtctctactaaatgtacaaaaaattagccaggcgtggtggggggtgcctgtaatcccagctactcaagaggctgaggcaggagaatccctcgaacctgggaggcagagcttgcagtgagccgtgatcacgccattgcactccagcctgggcgacaagagcaagactttgtctcaaaaaaaaaaggtcattttacatattgtaataatagttgtgtcttttttatttccaaggtataaacaattttgggggtggggggaagggccctgatttactgtgagggaaacgttcacctttttcctaggacttgtcttgttctcttttcagacatgaggactaaaatagcctattatttctctatgttcccactcccttgaggacatggctataatgtcttaggttattaaaacaatttgattttcctccttagtgatttcttcttaaattcttggtttaacttcatagcatgatttacccttaataatacatgactccataaaatgatataattttatctattataattatatctaattgtgacatttaaaaacttggaggtataatttaaaatatgcaataagagcacctgttttaagtgtatagtttgatggagtatggcagttgtacactcttatgatcatcagcatggtgatatttctgtgtcctcagatgggcccttcatgctcctttgcagtcattctcctctgaccctagccctaaaaacatcagaaaccactgatgtgcttttcgtccatgtagattagttttgctttttctagatcttcagttgaatggaatcatatagtatgtagtactccttttgatcttgctgcttttatgcagaggaatattttttgaaatttatccatatacatgggagtgtccataatttaatcctttttattgctgagtattatccattgtgaagacataccacaatttgtatatctactcacttagacatattgaatttttttccactttttggctgccatttttggctgccatttttccaagtggttgtaccatattaaacttgaactgtagcatatgagagttccagttgctccacatcctcaccaatatttaggattggcagtcattttatttttagtggttcttggaggcatctcattgtggatttatcttgcatttctgtgattgctaagtaacattttgctgataacctcctttcatgtgtttattgtccattcaaatatacttttatgaagtgtttgttcatatcttttgcctatttttaattgggttgtttgtctcattaaatgaattctaaagattctttttatattattgttgtaagtctttttgtcagaaatatgcattctgagtatttttcctccagtatgtgactttattttctttatatcttgggaagagcagaagtttttaattttgattttaaaaattcaccttactgagctttagcagcatctggctaatcctgttccacttaactcctctcactcttgtaatattttaaagcaaattgtaaaatcctatcatgattactgtaagaaactttatatggatatatcccatactctttaaaaaaccacaataccattatcacactttaaaaaaataacaaaacgtttcaaaagataacaaagtgtgttcacattttcataaatttattaatactttgttgaaaccaggatacaagtccaagtaataaatctgatagatatgtcagttgagttttgtttttttttttgagatggagttccactcttgttgcccaggctggagtgcaatggcgcgatcttggctcattgcagcctccgcctcctgggttcaagtgattctcctgcttcagcctcccgagtaactgggattacatgtgctcaccaccatgcctggctaattttgtatttttagttaagacgggatttcaccatgttggtcaggctggtctcacactcctgacctaaggtgatccacccaccttggcctcccaaagcgctgggattacaggcatgaaccaccattcctggccaagtattttttcattaaaagttatttctctttgcatactaaaaaaaatattttttaaacattttttgtttttcttgaggaagtcaggtgggtaatttgtcttgtagactttgttacattcttggtttggcttatttcatccacagtgcatcatttaactctgcctggtatgctgatggttagatttagaggcatgatcatgctaggtttaactttctgtttctttaatttaacaagaactttctgttgcatcttatcaacaagcacataatctttggttttatttccttgtgattttcagatcggttccatggtttagatgttatcagcctgatccatccattgtaaaattcccttttatttattgtcttttttttttcttttttctttttttgagccagaatcttcctctgttgcccaggctggagtgcagtggcatgatctcggctcactgcaaccttcgcttcctgggttcaagtgattctcctacctcggcctcccgagtagctgggattataggtgcctgccatgatgccctgctaatttttgtatttttagtagagacagagtttcactatgatggccaggctggtcttgaattcctgatcaggtgatccacctaccttagcctcccaaagtgctgggattaaaggtgtgagccaccgcccctggccttatttattgttttaatgagctgagtggccagcatgatttttatcatcactttagacttagactgtggtaacaaaaaccccaaagtcacagctgcttacaacaacaaaggtttactactccttcctgctgcataattgttgaggctggacttcagctctgcttcctgtcatcttcagttctgctccgtgttgtttttattctgggacctaggctgatgccagctccttcccataaaggtgcaagtctcctggcagaggtcatagttcttcctctttcctctcattacagccactacttgctgaggaatttgcaaaatagtaagataaatatattaaaattctgtttacagtattggctgagtgaggctctgaatggctctccagtgaaccaagtgtattcatgttcagaaaatctattgaataaggcatatattatttcaagcatacagaaagtagaggatagcataacatctgtgtaccacttactcagctgagccacatattggtattttaccatatttgcttcagatttttttggaaaaagaaaatcatagataatgtcgaagttcccaggattgcctccttcctgattcatatcatgaatgaggtagctgtcatctttattacttagcattaataagcttaaaaaattttgctttgtaagtatgtacagtgaatacttttcaggtttttaacattaatttcacactgtaaatgtaattgtataattttctttctttttttttttttttgagacggagttttgctcttgtcgtccaggctagagtgcaatggcatgatctcggctcactgcaaccttcacctcctgggttcaagagattcacctgcctcagcctcctgagtagctgagactacaggcatgcatcactacgcccagctaatttttttgtatttttagtagagagggggtttcaccattttggccaggcaagtctcgaactcctgacctcaggtgatccgcctgcctcagcctcccaaagtgctgggattacaggcatgagccactgcacatggccataattgtataatttacccttagcattttattttttatatttacatatgctgatatgtgtatctgtagttcatttgatctgtttctaagaatgtaccagaattaactgctgatagacattttagtggcttctgcttttttcctgacagaaggaaaactgtaatgaaagtttctgtatgccttcttgctccaatgtgtgcctttctagacatacatgcgcacatacctgtgtgtgcctacacacacatactccctagaaatagaatttttgagtggtagagcatacccaccttcagctttactaaatactgccaaattgctctctaccttcttttaccaatttaatttttcaccagtaataccattactagttttgcagacactttattattgacataactgttgtcaatctaatgagtttgaattggttacgttattgttttaatttacaatttccgtgattgcttcatgttgatttttttaacagatttattacctatgttagttttctctcctatgaatttattgtttacaactttctcctgtttgattttttctttatacttctatgtatactggacactaatcctgtaaagattatatagtttacagatacttattctgtctgggctttctctttttatctttttaaaaggaatctgttgttttacataatgagtcagatatatcagtttattctttttagggttggtactcttggtatcttgtttaagaaatattttccttttggctttctacttaggaaaattttctctacattgagtttataaggatcttatacttcccttgtaaatgataaacctctgccttttacagttatgtcttgaatctacctgaaatttatttttaattatgatatcatatgagagaggcagctgatttgatttttccccatatgaataaccagttccttgtttacgtttagtgcgtaatccatttctccccctaatgatttgtaatgatatcttacatgttagccatgtctattatttgctgctttggttttttcagtaatgttaatatctgttgagtctttcagccttgctccttaaggaactgctttggctgctttttggcatgtctcttctatataaatttttaaatcaatggatccagttccagacacaaaaatcttgttggaatttttattagaattggactgaatttgtagattgattttgaaagaggtgccagggtgaactgttgcattctcccaaataacagcattatgtaattcttcatttttttcttaggtcttcttataaagttatatatttttcttatttttagtgtcttgcactttttaaaaatcagatttgttcctagacaacttatacttcttttttttattataaataatatcacttttaaaattacatattttaattgtttgttgtgtggtgtatagaaacacgattgatgttgctcatagcagccttgctaaattcttagtatttctgatagtttatcgttaacgtccctcgttattactatgtagttaattgtgtttactgtgaataatacttgttttttcctttataccttttatttgcttttcttgaattactgcattaagctaggtcttctagtacaatgctaaataaaacctgtgacagagatcattttgactttaaatggaatgcttctagagtttttcactattgtttgctatatatgttttggatacataaaggtttagcctttatctgataagaaaacttctatctggtcaaagaatttttctttaattcacattttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaagattaaaaaaattagtatccaagaattactgtacaatggtatgagatgatttttgtaaaaataaaaaggggattgtaggtgaatagctgatagatgatacagacattagagacattaaagagagtgacattcagaaaaaaagtgtggactgtattttttgaacttttttaagaatacagattatttttaaaatttcaatatcagaaattaatgaatttttcatataattccttagatttcatcaataaaatgttaatattgtaattattaatataagatagttaactcctgtaaaggcaatgtacttttccattccttttaaaatctaaatgaatgttaatgtaaaataattacaatctgtattgtgattcccagcagacagtaaacatttatattgttagtggttactattaagtatatttttgaaatgaagttagcattggcatgttgatcaggtagatgttctcagtgttttgtattgacgtgttttccttaagtgtttgtcaatttcgatacttggtttgaatttttgaaatttggtttagattgcagtggttgtcacacttctgctgtaaaggtccagatagtatatattttaggctttgcaagccatggtggtctctctcgcaaatatttaactggcattgtagcactgaagaagccataggcaatatacaaatgaataagcatgattgtgttccaataaaactttatttacaaaaacaaatggcatgccaggcttggcctgcaggttctattttgcccaatttgaatatgtaaagactgatggttactagtgagaattaatgggaagttttaacataatgacattttcatcataaatatattcttggctgggctcactatttttagaaattagaaaaaaaaagtattactgcaaacttgacctgtgtaatttttcatattaaagtggatcatagatagaaagagttgtatagatgccataaagtcattcaaatttgtacttcatattagttttaccactgccaagtaatggtcattgaaaagttacttaatataaagagccaaaaaatatcagtttgaaatatttttgtttagcttcatgatttaaatataaaaccttgaaagttatgtactattaattcatacactgttcatacttacaggctaacagattggtattagttcatgacaaaagagataaaaatatgaagaaggtgttagaatgacaatacaaaatttttttgagaagtgaatatttaagacttaaatcatttggagtaatttggtttttagtccatgatttttgttgaaacctaacagtaaaattttttaagtaggcaaaaagaaaacagtagtttccatacagttatcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtactaacaatatgatttacattgctgctagtgtatctcttagaactaaccaaaaatgggcccaaaatagaacatggatttttaaaacatttggtccgtatagaattttctcagaacaaatttatggctctaattttatcagaaaggaaaaaagattctaatgtaccatcaattgtaaaatcataaaatggaaattgtaattgtgtaaaatgggtcttggtaatttaaagtacactttagagtctttcggactataaagccccttttaagctagatatctgccttgtataacatagtccacaattttgctgatgaaaaactttatagtctgaaacatgcaaagtttaatctaaattaccttttatacatattaaacaattgctgttgccatcttagaatataaaatcctaattttatcttgtcattttatttcccagcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcagtaagtatttgcacttctaattagtagcagagaaaaacctcagagattcaaaacagcttgtataatagtcccattctttgggtgcttaccgtaactaaaaagcaaacaaagtaatgttgatttctaattgtttctacactgtccataaattttaagaagtcttggcactgttattgttacttctcaaaatcatatgctatgactttatagacttgtaagttttcctccttggggcaggtgcttggtagagacaacagaagatttaaataatgagcagcaataggtcatacaaaagagacagaaggctctcgagtttaacatgcccttcccatcttgaatgttcgaatctaattttacaactttccctttaagtttcctaaccactttgcacattgtgcaaagctgcatcttttgaaaagtcaaaatggcttctggaatatgtctcagtattctttcttgtgattaagacaatgacagccagaagacagaaatattttaagaagtgtagcatttccgtctcagatccgtagtatgtgtcaactctcaatatgtaagcatacaaaaccccaaggagaaaataaaaacttaaaacttggcttatgtgttagcttggaaaaatcattaaaatgtcagttgtttttaatcatgaataagtattctttattctgtcatgtaaatagtttccatgtgtttatgtagttaattcagtcatactttgaaatcattaggctcctttattgttttctaggtaaaatcttcctctctcatagatcattttttaagtataaaagacaataatattgaacgctattatgtgatcaaaatttatttttggtattgagccttttttgaacacatatgaatagtattcttcaaagagttcagtagtaaaagatgagctgtacatgtgaaagctgtctttcttctagttgatgtaatgcaggaatactaatgttcctcatatctttttattttcagtataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcggtaagcaccagttgagttcattgaccttagatctctgaaaattattttagtaggtgtgaggtgacatatgatactgatattaatgtttgaccttgtaacttgatagaattgatacggcaatattgaaagacaatttgtagtaaattaaaagactgtccaattattaagtaatattatgaactaattcattttatatattaagatacagtcgaatttttctgtgtttttattaagacataattttaatagaagaatgctgaggatacagtaatataaagatcctattttaaaaattcttattttgtttacatagtcattctgaccagtgatcctttctttgtattcatagcaattgattcatcatcatgaggtcttaatatcagaaacagaacttagttagttaatgcttcaccctatattcatctgcccttggataattttaagaatgttccagatatgacaggaactgggtaattagagctaggattttgtcattaaagcaaaattttaaaattccattatagaaaaaaatagaaataatatatttgcaaacaacacttttaaagacttgtgaagcaaatcatctacaagtggaatatttagatttcataacagataattcacaaattatgaagttttcttatttgatatttaatttcactaaaaaatgttatagtaatgttcttccttgatgaaacctagcacacttggcattatactctgtgaacatgataatcttcagatttgtcagggtttttagcttgtttccagttacgaaaaaaatattttcaggaagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaattcagtggggattccatgttatatgaaaaatgaaccactaagtaaaatctgtcttaataagtttatgcatcatttactctaatactgtgtgagttctgtgctttgatatccttttctagcatttatccattcctagtggaggtattatatttctgctacactgttttgcaacaaacataacatctgaacagtttttgggggttctgttaggttccatagggttaagcacttcagctcagacagatctgaaaggcaaattttgaaaattatatgtaggactttaaaatgatgagacaatttgcaatattgagtttcaagtctgtcttagggaagtcagaagtcttaaggattcagtggtggagtggtgtttattgtcttccccatacaagcacgattttgtatgcttttatcaaatataaaaccagcagtttgaagtaaataaattattttcctttgttaagtcaaagccaactcagaattattagaggtcttgcacatgataaatgaatcttcaaaggcaaatgtaaagatagttttgtctgttaggtttttaaaatcctattttccttgtgatgttgaggttccatagaaactactaatgcatattcttctcttttcataatagttgctggcttcatgttgataactactttatatggagcttcattggacctgttaccttcattattctggtaagcaggttctgttttcccttgctttttagcttgctgctttagcagtgctattcaaacaaggataatttgttttattgtttgtttatctatctatacaaagatttataaatatgcctgtctcacaggataatagtatattttaaatattttttataaacttgctaattaatatttctgaaaatctttactctaaaaagtactttttctcatttctaatttaataagctgacatatcacatcataatctaaaaaacatgcttacatataggccatgttataaattaaatgaatatgtcagaaaagtgaaagaatattaccttaatttttattatcttagtttccacatagtaatttaatgaattactatgtaattctaatgaattaattttaagtgaattttaaatgaatatccacatcctcaatgctttttagtatataaaaagttgtttaagcttgcattaacgaatgactattaaatcaacttaaaatttattagaaataaaattacttctataagactgaagataccaaatgaatatactagtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattagttcggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtcttaaaaaaaaaaaaaaaacttgctcagttgtagcactatggtgagaaatggtgttattaactctgaaaaggaaacataaatacttcctattttaagaagtttttcttacttttttttcaaaaacgtaacacaaatgagctcgtttggatcttttcatggttaagcagtgtttcatgaaattgagaaaaacttctagtacttgaaggaaacttaaaaccacttcaagtgtatatttgtttgtcattaaaattaattattttacacaattacttatacaaagtgaaatgaaaatttgagatgaatgcctgtatgaattaaaccagtaaaacattctcaagtattcctgggaaaactgatttctcatcagaattattaaatctgatgattgcccaagtttttgttcttggtgttcatatgttaacacagcctaagcctgtctagagttcaatggctgacatgaagaggcatgatccttgaagacataaccttccattttcctctaagaccttcgtcaaacacataagttgcaaaaatgtaaagactgctttagggatatttggccaatgaggctatcatgtgtttactccttttatactgtagttttatttatttgatatctgtgaagataagtactgactttagatcattaaaaaacatttcaattagcaaaagaagttaattttcaacatactcagcttttagtaagaaaaaagggtaaaggacattttattatgttgttcatttatagtagagcacactattactttataagtcttgtcattattgtcctctaccaaatccttcaggttgagatgtgaatggctttttcaacagcattctcaaacacaaaccccagtaggtagcaatcccagtacagatcttgttggaattctcctgcgattgctttgctttctaattttcccaacagagagaaattaagagtggtataggagtacaaaacagcgtcttgcaaaagaatatctaacttaaattgagatatgatatgatgatacagtgtgtgtggggaaaaaatatatatatatatcttccctctggtgatgataagacatgtaaactcaattcaggcacaaatcttaataatatagattgtattgtatactatccttttaaggaatattcccataacaacaattacctattgctattcctaggaaagtatagctttgcattttcagtttttctgaattgaaactgtttcacttagttgtattaaataggtgtacattctaaataataatctatgaagaaaaataatatgctaaggaagataaaacttcctacttctgcatttctataggatgtcttgcctacaggcactagagttattatatctatgagaaaagtgctggtaagtaatgagcagtgggaaaccattagtatgcctgaaatggtttaatgaaagcttggatcatgacacgtcaggagctgttcttatcatttggacagctccatctgcatcgttaataattaattcagttcagtaagagttcagctcacacactcatttagaagtcttcttcagagaacacctctctggctgctagtcccagggagaaataggtttctgcttggctaacagcaaagatctggagatacaagtatagctttagagttgcatttgccaggtagcaaaagctccagggaggacaaaaagggtcagaacgtgcacagttcagctaggttacttcagagtgatgtttctgttcttctgtcttatcatatccatgtcagcactgcaagctgtggaatgaattttaagctgctaagctcagacggatgtgattcaattgagcaggttgatgaccataaaacaaactgtgcactcctataatctgtggtacctttttctttcttaaaatttctttgtatttttatgttcatcaatatgggtgatgtttagctgtgtcatatcattaagcagtttgaattttatcagcaaattatattggtgggttattataaataataatttatgaaattattgtttggggataggtaaaagaatgatctttgtcagtgggagagaaaaaaaaatgtcccagtttgatgacttactctttttggctgaataaggattttttttttcttgatttgttctcactcaacagacttatcttaaaagatagccatctatttacctgtacacacacacctgcacacagacacacacacgcccagagctaagctaaaatctgattcttgaatgagttgtttcatccccagaattaattattagcatggacatttagcctggtgggttgtcatatgtatgtaccacaatcctaatagcctatacttactagtagtggcttctgtgtggataattgagtaactgcatgtacttaccaagtttagacaaatgtttgtgtgcgcagctgtaactccacctttttcctttctcactgatgcatgcagcctttcaacctatgccaaaatattatgtttaaacttcgtagtatttacactgaaaagaaaaaacaaagagcaagagggtcaaagagtggctgcattggaattcaagggagaagagcagcaattggatggtagagacattgttctctccctgcctctttgcctgccttccattgagaaataggggaaataccatgttggatggttgtgatttattttgtaaatgcgtatcaaaggcagaaaaataaattgggcaaaagtaaaagtaaggaggagaaagaaatcacttattataattggtgggggcgggggagaaggggaaagcacagaagtatatggatggaaagagccatttatgtcatgagaaaaatgcaaagaagaaaggaactcagacttgcagccagtagtttatttgaaacctaccttttttgtcttaaaatgactacagatttttatcaaagatgtgtttatttgcccctctgcctcttgttctcatttccacggttgtattttaagaaaacaagaaagaagtaagaaaggggaaaaaatttttggaatattttcccctgcaaaattataattatcagaatgtattgcctcctgaaaaagattgcagcaacaatatttattctatcaaactaaaatttagcattacatttttttaacattggagaaaataagataactgtaaaaccacatttttaaaaatgtatctgtgcttcagtatatgttctatttaattccagaagatattttattgtcatatatgttggtggtaacataaattgttgagcatcaaagtgatataaaaatttttgtatttctctaataagactagtaaataatatgtattggtgaaatttttttctttagttgggaaaaagaaaaatcttattcagtattattttgccatcttacgatttatgtcatatgctttatttcataattaattagtcttgaaatgatgatattttgtcctcttccacataccattgcctcattatttgtatgctttcaagtcatgtttcagaggctaagttagtgttgggtttaactataaatttctttacatctagatattagtgcattagctaaaagttttattttcagtttcttcaagttggagaattcagacacttgtaatttgagcgcaaagatccctcaaagttatgattatttttccaatacttttagttgtctttaaaggaactcactttcaaatcttttaaaacattccattttaagtatgttagaaacagctttaaaaaattttgttcttacatttgcacttggatttatgagcttatgtgatatttagcaatgtaaaagtataaatgacataaacaggtttagaaaaaatacaactaactgttgttaagcatgtgacttgactagtgggagtagaagcgtggccaattgctgattgtgggatgctagtgttttacaaaggaaatggagaattagttaattctggcaaatccgtcaggcagaagtcatttgatgagcatacctattatgtaaataacataaataggatttctttgaggcagtattttatatgttaatttatttatcttcaattcattcatctctgagtgatttttaagttggattactttttatagaaatggaaacttttaaatatagacttagtatatctttgttaggagacttctaatcttttcacccagaataaattggttaattttatatgggaagtctgtgggctgtagagcccagaccacagtatattgaatcccagccctgaaatatagtatctaagtaatctttggaaggacacatctcaattatttgtaaaacgggtatacaagtgctgcctgctaccactgtatataggattgtagctgtatttttcctctgtaattttctttattttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaactagaatgttatggaaaataaagccagataatgtttctacaattgtatttactttttctctagatgtattttaagacattattaaattttttttaaacaaagcactgtttttgtccttaagtaattaacatcaaaggacagaatgttacctgccaacacttgtaaaattttgcccattgacctcatttatcccttaagagggaattctccatctaagagaaatcatagggcacagtggacaaaatgactggatagatacacagcctacattaaagctttccttagctctgctcctaaactcatcattaggaaggacttggaaatttttatttattgccctatatcacttttcctaattataaagtcagaagtagtgaaagatgaataaaatagtgttaccatttgatcatgtgatattgtgactcagtaaaaatgatcatgttactgtaacactgttatgctgattatctgcaacaaggaattaaattcatccttacctataataggtgaaatgggtctttttctgaatatactatttctggtattctcttaagtaacgtacagctcacaaaatgacttttttttccttttaaaaagtaatctaaaaataaaatggcaaaaaaaaattcaggaacaatgtagcttagttctatttttggagcataaaaatggaactgcctcctcttcttccaacattctgccaggtgtctgtagaaacaaatgcaaattaccaacctttgtctctcagtcaaaacacagctccttttcctctgagcaagctcatgttgacctcttggaatccactcactttccttcttgtcagattccatcttcctcattttgcttttgtttgcacctagattctttgcatagctgaatgtttagaaagactcaaaacagcattttgtcagaatgtatctacttccttacaatacagagacatagaaaaaaaagactgatgatggcttttaacagttaaatggcaaaacatacctatataaactttatcttactttatataacaaacgtttatcatgttacttcatttgatccccacaattgccttatgaatagattggacagatgttattatcctcatttaatcagtcaaaatcaagagctagactcacagccaagacttatggtttcaaacccagcaattttgtagattacatgatgtacattatgtaaatgctccttctaaggaattcactttagtgtttccatcagatggtttttaggccctgaagtacatctagctaaagaaactaatttaggttttctaatttatttaatcattaccacataatactgacttaatgaggttgcaatttgatgtcaaatgatctattaaagaattgatcatacatagccagagtattttttatgtagactcaacttgatcattgcatacataaaaaaaattatatcagtatcttccatataaacatggatcgatacatttgcaagaactattcatttttcagctctttgttcattgtggtctaattctttatttgttacaacagctaaatattatcttcttggtgatcacattgtgcaaaatggtgaagcattcaaacactttgaaaccagattctagcaggttggaaaacattaagtaagtattttgtattttaattttaatacttgacaaactaagtaaaagatactctccacagggaacacagggatttctaccttctatcaactgtagaaattattcagaatgaagttttactgccctcaagttgaatctcagtgttactatatcactgatactggtcaaaaattagataataattgctgtcttgatctagagccaataaattgtttcagtggctttgtggaaattccatatcactgtagcaatttcatttgaatttaaaatgcagttcaaaatgattttcgtatttgcatggctgatatgattatattaagtttgttttgttaaatgactttttgctttaaggattctgagcagtttccactcctaatcctgttttcctaagagaatttactctattactattgttaacttgaagattatctgttgttttcatgctaaacaaatatttactttttcttaatgttgaataaaagctgcaatattctgtcaatggagaaaatgctatctaattaacaacaaatgatagctgttgttcattaaatcatcttatggaaacattttcagagttacctttaaaatatgtgagccttgtaatttagaatttgagaaggtattattcaagttggttataatgtgattgtaaaaaatactatttttaatgtcaaaaatggcagatctatagtaagggtaaatttttttttaattagatgttttagataggttagtgccagcttcattgcatgttgcatggtaagagagagagctaatctttagcatctctctcttttcttccttttcctctttctgtcttctcatctacaccagtaattaccgtgtttgtgatggctactataatacggacttacctgggtaaggtagaaccctacattaacaaatttatggcatgatttgtattttttacaaattcgtcagtatcatgaattgcccttaatttttataattattttgaaatatctaatttgctatagtatttttaaactataatatgcctttattttttaattgcttgcctctgcattttgactttcttaattttgactaatttataaaatatataaatgctttcttattactttctattttaattctgtctaataattttgtttctcttttctgcttataatgctttctagctatgaagataataagccatttatcaagtaagatcattagttagacatggaatgcactgactttaaatccttctcattccgtcctattttctacagttcttttcttcttaagctgttcatgacgaaatctctccaaaattattttattttgaagttgttctcatgtttttgtctcatttcagctaggcttcttcatgctttagttataaaaccttaggttcacctaagactagtttattagaatctgaagtttaggtgttaagtgattatctgccatttaacctttctgtatgtgtcacattatttagtgtcatgtgagtacaccataggaataaaaatacaggagtaaattaattaagcactccttaatttcttttatcaaaatgcacataaaagacaaagtcataggggatatgttacacgttgtattttaatatagttttgatactttgtttattctggaataagaaaaggtcatacctgctgttgctgttttcactggaggctgcagtactaaatgctattgttctttcttaatcagagaaaggttaaaaccaaaatgctgttgaatatgaatgtgaacatagagaaagtcaactgctactactgatatgttaacatttaagcgtgatgtgtgttttttgctcattgaacctgttaaaaaagttcactttatttttccaggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtaagtaattgaaaacacctaggggctcaggttactcattctttgatttgaatataatagatataataaagaatattttaagtcacatctggcatattgttaaagagcattatatttttaattataagttaattttcatacctgtctgaaaatttaggtttcacctataaaataataccagtcatcttttgtatctcagtttgggaatgttataaactagatacttaggttaagatttcttccttgctcgtagggtctataaaatgctaggtacaaaggatatacaaggtaaaagaaaaggttaaataaaactcattctttgctcactaaaggcattacagtgattcacagtgaaatggagtataaggataaatgatgttaatttttaaagcaccagacatacaaaaaattaatgttaccttttgagtaattttgaaggatctaaaaatcaataattagtaccttacatcttacttactgttttttcctgattttatgttaagtggagtcagatgaaacttacagatgaaaagctttaatctgtagcaagaagatgtaaacctaagggaattgcttaggtgctatttaagtataaaatttccatacctttcactgggtatcatcctttctctgcctacatatctaatgtagtcgttttattctgttattactagttggtcactaaattgaacagagaaatagaattgtggaagtgaaagctattatgttttcagtcctgacaagacgatagtgttgttacttccatcagttttgaataagctataattttgagataatgacagtggaatgtgcaatactgacagataatgtatattcacagcaatataggcattaggcaaaaccaacactggaaggtattatttggataaaataccattttgattgccattgtcttggttatacagcatttcatagcagttaacacccattaaatgtgttgaaatcttttgtgaggtatgatgtgttatttaataacaatgaactttaacttctaaacattgtacaggggtaacattagtaattactttggcttttatatatttcctacataagtgagcattttattattgtatgttcataatttttgtgctgttgtgccaaacatctttgacacaaatcatagacatagcagaaaaggagtgaggtagtcattatttcctcatatagttatgtgtattaaatggaacaggagagtctcttatgctttttagatttaacaattacattttaaatgcatcatgttatacttcaaaagaagtataacttagtcttggatacatccagttgggtgcgccaggatgagttgttaagaatatgatataaaatggttaagttaaaatcatggttttaactgcttgaatgagcatacttaggccaagaaaatgctttgaagactcaaccacattgttatttgttctaataggtataactaaataaagctaaaaagatgaaaatgtaagtgcgcttagatttaaaaggccatctactgatttttaattttctaattttgcaaggaataagtgtcaaagtcatggtctttacaggcagttactgcacacagacttctgagttgagggaaagcctttgagtgtttttgtaacctattagaaaaaatattttcttatgcagtttcttcttgtctgtcttgtaatttcacagtctggctctaacccacaagaaaacatgtatatgccagtatagctgcaacagtccagcagcaccctctccctcttaattctgtaccactgctttagatggggccctattatttagcagttgttcggacttcactttttaaagtttagttgaaactttttttagacctaacaactttttttttgcattcatatattcaagcttcaggggaaaagggaaattacatgggtaactcattaatgtgaatgaaaattgcataaatagttcccttgtgtgctaatgaagtgaatagacatcttagactctctacactaaatgttaaagctagacacatcagaaaatgaagaaaacattccttcctaattagaggcaaatgtatcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacacatgtattcttgaataaaagcttaatacattccaatttagtatgaaaaattatatggtattgtatatatccttggaaaggtaatttattacactattttcagtttgatatgtactgatttgtaatacaagttagaatttattacaatgaaatataatgacattttaaactgttgacattgttctagtgagattctcatttaaaatggaaaaaggtgtatgtgtggtagcaatactaacctgaattttaagatatttttatccaaattacattagctatgcaaaacataatcagtaagtatttaaaagtttgtaatttgtcagttagaatgaaagacgtgcatttcttctgttgctttggtattttacttcattctgttggcgatcaaaaagtaaatgcattattcaatgattcatttttgaaacctggcaaataacattacataatgaaaattcttgttatatagaatttgtgaatgatctaataattcattttatagtcttttttttctcagcatgtgtgcttttgcatttactaagagaagctttttgcaatgtgtcatactttctacctgtctgtgaaagttgttttcctcctgctcagttggtattaacacagatgttttcatgagggataatcccacacctgtaaattctgaaagtttgagattccctcttctgggcctcagtggttacgtttttaatattaagcagtaacatcttgaaacataatgttgatctctatgcatttaattgccatttttgtttaacagtgcttttgtataaattagtaaatgtcatcctcagcaggtgtttacttgggggatttagaaagcacctgtgaattactgaaatttaacttccctctcccttctctcctgcaaattagtagttcaaatacagtcagaacatttcaacagattttccattgccaacttgtccactacccttgatgaatataaaaaaaatagttgactacaactgtaacactaaaataagaaactgatgtacttttctctgtttttttgttgttttttttttttactttaggaatgactggcaattacctactaacaaaccctcttcttcgaccccacggcactaacaacccctataacacattgctcgctgaaacagttgtatgtaatgccccttcagctcctgtatttaactcaccaggtgtgctttacttacaaataaaactacctttctttgctgctaaacagagctatgatctttgccctgtttctaaaatattcaagttgtcatatatttattgttacattcttaatttctcagttaaaaaaaattacggtattgtctatgccaggcttctaaaactgcactatattatagtaaaagctcagtcatgatagtatttacaataatgatccatgtttttaacacaggtggcataaatcttaatatattattacaggactgacatcacatggtctgagagcccatcttcaagatttatatcatttagaggtatcctatctatataatatactgttcagttaattctaaagcttgctgacaaaatttgcttctggaatgaattagctaatgaagataatttggatgcctagctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatgaagctagagaattgtgtctaccaagttaaaggaagccttacaaataactatcacaatttcattttgttgcacatggaacatgatacaaatttgtcagtttttcagatgtagaagttgggacagtctttaagacaatacaaatcactaacaaatataatctctcattttctcatttttttgctaatgataatttgcccaacaatgatcacatatttattggtcatgaagtttgtgtcaggtgatacagatattttttttttctgaaggaaactgcattttctaggatatctgcagctttaagagtggagtgagcactaaaacgggaaatttcgtatttttttccaagaattaaattttttcctaaactcctccaagccttgcatacaatgcagcagcctcacagtggtcagcttcatttcaataacatcatttcattctttttttttacagacctatctgtagactgtgatttttttttttctctaggattttgagaatgaataacctaactttccatggtgcagaccatttaattttctcttgactttttttttcatttgcttgagaagcactgtgatgtcttagtttacatgtttatgtgtctgtagaaaatacaactctgattcaaatagagcatgttaccatgttttatttccccctcctaaacctcttttcctatcttcagcagacttatccagtctttcattcctttagagataaaaatatattagccaaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaatatcaagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatatatattttttttttttttttttttttttttttttttgggacagagtgtccctctgtcacccaggctggagtgcagtagtgtgatctcggctcactgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaatttttttaaaggcaacactgattattcagttagtcctatttctttctcttgaggcagttctcaaaactctaaagacatgaacactgcatcgtacctaaatggctactgttctctaacgtctttatcctatggattcaatttggaagccatcattgatctttggcatcaaaagaaaagtcatttttaaagcatttcttttcaaaaatatataaatattgccttaaattccatctaggattcccttagtacaaggtagtttcttaggtttgtaattactaaactactgactgttttaatgcagatgcgttattgtatttattaacccagtttctttgggtctgcctagacttcacctgaatgtacagttttcacattcttgattgtttctctttgtgatagtcacaactgtgaacttataaagtcacatttttaaagttcttcctagagacattcactctgtctttattaaaaataataataataataataaacgttatcttgttggcca

SEQ ID NO: 2318 - DNA, 192026 bp, Homo sapiens
  source 1..192026: mol_type = genomic DNA
cggcgaacagacgttctttctcctccatgcagttacacaaaaggagggctacggaaactaaaagtttcggggcctctggctcggtgcgtggagaaaagagaaaacctggagacggggtgggtgaaagacgcatcccgggcgcctctccgaagtccaggccgggagcaagctcctgggcctagaggggagggggccccgagccgctggtcatccccctgcgctcagcctcggagcgccgcgcttcgcggcgctctcccaaatactcttcacccactccagaaataaaataaatgtttttaaagtgcatgtgtgtggacaggatggagagcgcgcgccggcggagcgcgcggaggacccagcgcgcagtgagtggagtttgggggtgggctaggggttagcggttgaatgggtgtgttaatggggggagctggaggcagagctcggggacctgggggtagggggagcgcgaaccgactgggaggggagagaaggggaggggcgcgagctggcgcaggccgcctccggggcgcgttccacggccgtgcgcgcgcgtccctcgccgccaccgccgcccggacagccctgcggccgccccgccggcggagccggggccggcctggtcctcgggcggctgcttggccaccgccaccgccgtccgaagggctcgagcccgtaagtatcccctttcgctcctcctccccgccgcttgggcgcacagccgcagcagctgctcaaatggagtggaaaacggccattgggcgacaatgagttatagattatctgctccacgttttgtacttagctgcctgtaatcttcttttgagtttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccggggccaccccagcgtcccgcccgctttgccctccggtcccgcactgtaagtggagcggggaggctgagcggctggagcgagttcgggggaagtggacggtgggggagggcttggacgagtttttgagggttgctgttccttctcgtcagtggttaggtggtgtggggaggcgaggatgacagtaaagcgcagccagatgtggtcgggccgccgccgggactggctacgattgggagcggcggggctgctgctgccagggcggcctcgtgggtcgggagggtgcaggggccggggacccggcgggccacggggagggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaaccatggaagcgccccagcagtgtggaggtgcgcctgcgagacttctgcgcttgggacccgtaaagtttgttcctttcgccagactgcggggtgggggtgaggggagaatactggaagctttacttaatgctaaagtgtcgctgagtggaggctttttttccccccctccaatcctctgttcactctgtgctctcaaagaatagttgggagggacaagtcctgcggtatctatcatagcctttctctttttagggactcctcctcctcatcttttctccctctccccgccctccattccgttcttcccgatacaaactgttgtctcagattccgaccgagggaatgttttcctcctgtttcttgaaaggtgtcaggctgcttagcagcttctcccaagcagcctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcagaaaaatagaatagttttggtactcatctgtggcaacattccaacttgtgatgggactgttttgacctaactaagggtactttgtaactttaaattttgtatcttcgtaatacttgagaaaccctttaaaagaaaatttacttctgtccaggtgtgttatggaacgttttgttgtctctccctccacccttccataaatttatgcataatagaaagaatactacagaacaaatgttctgttgtttagtttcttcagacattccgattctctccttttgttgtttgcctctaaaagaggtgccatttcacatcattctgcacaaattgtttgaattaatgcaagtgtgaattcttaccgtttgaaggggactattagcatatcaaaggtttcttagctttagctcaattgagaaaacttcagcctgtcttccttttgcttccaagcggaggcccaaagggcaatgagaattgtaaagggtaaaaatagggaggtggattcaggctgtgtttctgaacttttactgttttgtagttatgtgggccaaaaacattgtctattgctgtggagcccttgcaaatggcaagacaattattttctattgataaatggtttgttcctagaaaaagagtgaccttttgttttatgatagtcactgttgcctgtcttttggggtcccttcagtgtaagagagagtgagaaagcctttccttctaacttaatgcttttttaggaactacactttgttttattagtaaaatgaaaaggccacttaattagtttttaattagtctctaaaacaatagaaattttgtgattaaaagactcatttgtacacgtaggtaactgttttttatgtgctaaataaatagggaaaaagtcagcggaggatgctgaaaattaaaacctcaaatgaacttgacacaacttctgttgcaaaaagaagcttggaaaagttttttttaagtgaagattcaaatttttgtgaattctatttaaatagataattctgtttaaatattgttttgtttcaaaatttttgtatcttgtcaaacagtaaactctagtattcagttggtttattttaaaaaatatagtttatttgttcttgcttttttatgtttacagagagaacatatctttgaatttcttttaacaattcaatatccatgaatgaaaaaaagaacaagtgcttgggtcatttgggttagttatcaagtgcagatgggtcaagggggaacttttatcttcaatttcttgggaagaattagttttatttatttgacttaagaatttacaaaacttaattctaagatggaaatgaatttcaggggagacttttttggagatgtaagctcatattttttatagttttaccttagatgtttggttgcttttgaatatgaattgataacctttcatttactaatgttcaaactccttgcttttattttattaatgaaaatgaattccaatataacaatttcagaggggaaaaactatcattaattgcctaacatttttagcttaagtgtaatcggatgatcctttttttttggattacaattagggtttttttttctgtgccattgagattgtatatcattatatccttaccctgaaattattttatggtagtttatttatctgatcccttcacttgtctaggaagtactttagtggttaaaaaaaaaaaaaaaggccacattgatgtaattgctattattgcacttaagttgctgttaactagtctgctttgaatgcagagtgttataaagaaaacaacattatcctttacagctattagtgataatctaaaaattgtcttgaaaacattgctcttcactttatgtgagggtgatcttgaattcagtaaatctctaaaggtgcaaaatgtagtgaaaagaagatttttcaacatttagatgacaaaattggactacttagggaaaaattaatgtgttgtagaagaacttcagctgccattttcaatcactgggttactatgtgttggcaacagaaaacgaatttagaaatggagatagctctgggagcaggtagttggggaaatcagaatattgaatcatgtggggtagaacaaaccaattacttcaagttttgacttgagaatttccaataagtataattttttccaggcttttgactgtctgctttattaatggactaacatcaaagcaggcaacaaaacttccaaatgttataaaaactaatgtaaatatacagatctcacatgcagtaatacaagtctaaatttaagacaaacagttggggtttttactgctgcaattttcacaatcagcagaaacattaacaccaggcttctgggtgtttccttttttgaaatgagctagaagagagctttaaaactaaggtttacttagggttaatctttatttgatcattattgaagctttctgtgtttcattaaatttaaaatagcgttttagtatcttaatataagaatatgtgaattgagattgagatgtcatgaaggtcaagaggtaactagaaatctacaaaccatagtaataaaatgttattgctttattttctatcaaaatatttatttgacctcacttttgtgaatattcaaataacactcagtttattgacagttgtaggtggaattctaagatgtaggttaaacatacttgtacctacctaaaagaaatctgttttcattttaacaatccataccgcttgcccaatgctgatatttaagaacatagattaagggttacttagattaagaatgaaagatagctttggaaatggaggaatttagtttcacataaggtgctatttttacaaaagtttcttcaaagactgtagcacttttgcctcttactgtttcaccatatctgattttgagtcttgaagggagagatgcgcatttgatgtctgtctgcttttctgcagaaaagatttatgtaaaaaataagtgcaattatttttaaggtaatatattttgcaaataaaatgcatcgttacaaaaaaatggttcttcaagattatttgcaaaaatgcctagctaaaaacttttcaaattgatagatttcgataaagcattaaaaatagcaagtttagctactaagagctgaaaaggagttgaagttctgtgaatgttttggtcatatcagttcctatggattaaatatgagttaatgtaacctaaatggataacttttgttgctatttttaacaaagattagaatatttatatttccaagatagattaaaatcataggctagtttacttctgtcttacataagactaattattctatagccccacccaaatattcatctcttcaaataattcttgattgaaggttgaaaggttgaaaagtatttaatcactcagattattgtaattaggcttgatgctgtcacaaaaataaattgagactattctctaaaatctttttgctgcctaagatgctctcaaagattggccaggtagtgattatattttttaatgctttaagaaaaagcttaaggaaatagtttctttaacacagagatgaacagttaattattggaattagggaattataatccttgacttagtgtggtaatttctaaaggagtaacaagggtctgtcaaccctaaattttactcaggactttaatttggtattttgagtgtagtatataggttttgttaagcatgttaagtatagaaattttcttaatgttttgattgttttgatgtaagtatttttgtgtgtgtgtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacggaagtgcaggaacaagcacaaccgctactcaaagccaccggctgtttttaggtcatgaagtcaacttcctggaatttctagggaaaatagttgaaaggggaggacaaatgtcactttaaatagagatgtttaaatcagatttctgcctgagggtaaagtttaggtctgttttagcccagatgtaatgtctccctctacagagcacagcattaatcacgacctgacaagaaaacgtatgctgagcaaaacgtggcccctgttggttttgtcattgatttttccaatctgtgaggagtacattataatcattaaaattcagacacagggattacaccttaatctttgaatttcagtgttgaaattagttatcttaaaagaagcctatttaaggctaaaaagtctttggaggactttttttgcggtagatttagtactttaataaaaacagaaatatattgttaaaaattgggtaggttaggcagatgttaacttcctgaaatatgtgaccaagtcttaattctgttttaaaatgcattaagtaacatttatatatatttttaaatctgataaaaaaagagatggagataaaaatgaactattagttcttggctatgagagatgggagaagttgaaaagatggttaactttagacttagcatcaattcaagcacatgttaatttgttagaacaaaaccagatacaatcctgtctttttttctgaatgaataagaaaaatcttcagccatcatactagcgaagaaggatgcaccatgaggttcctaataaaaatgggcttaattttgctattttcaattgttaggtagtacttgttaacccctttcttggtcacacatatgtacatacataaacacacattttatagtctgtttctctgtatatatcaatacttgttgtttattgttggctaaaaattaggaagttcaaaatgtaaaatatgtatgattaagatatctcttttaaaactgattttgaaaatggtatgacataaatatctgttttgctgtcaaatatatctatatctcctgcctgtggactgagaaatgcttgtactatccacactttgcctccttttataggtatttttacatcagtccacacctcaagctagttattactctggatttagatgacagcataatctaacctcaattactgtcaaaaatggcacttgactgctgggggtgggttaggtgaccttgttttgactaatgctttctcttgaagatgatagtaaatagtgtctatttatagagcgaacaaaagagaattctgttttcttcataaagtaagttctaattctaatcatttattcttaacattgtaagtactatgacagcagttctccatataatgggcaaaccattacaagattttagataaaatttttagttgatacaatatttctgttttatgcagactacgtttacttaatcagttttcagcttcaatttacataacaaataatcatgtttaaaatgagtttccctgtgtctttactttgaagcaaagtatttctatgtggaattattactcctttattaaactggttaccatccatacggaaattttctctgcattaaaagcctaccattttatagtgtttgctactgtggttattgattagaaattacagaacacatttcttatgtaccattttctccactcatctttgtgttcttaatgtcaggatgcttatggcgtattttagttcttacaattcctgactttcctatggttaaaatctaagacattttgggaaacattaattttgataatattctatgcttatgtatttttgtcctagtaattgtacatttttttttagtttgatgaaggcttaatgtattaaatgacagaagatatactgaagattcgtgtactgaaaataatacatctctccaatattaaagagatgagcataattctaaaacacgtcactttgcctcatatgcgtcgacaaataaaaattacactaaaattataatgtcctagacatgttcacttttactaaggacatataacttttttgcgcttttcagagttctctctgtcacaaagaagacaatgtttgaatattaggtgcttcctcttgatagctcaatagatgaataaataggaatgttctcccactttgctttttctactacaagtgctatgatacccatagcctgcacggaaatgacttttcatattgttacgggttttaaactagatctacagcctgaatatctaaaaatgtacatgaaacaaaatttgattactttttcttaagcagaaaaccccacaaaaaacactgctgatttgctgttgctgttcctcttacctcatttgtttcattgggaaaagatataactgatacctcagtatgatatttctgtatgttttagcatatcttataattttcctttgttcaataagaaccttagttttaaaaagtcacttcttataagcctgtcagttcatttctaggtaagtcaaactggctttgcctcagatttccagtcagtatttacatgttatcaaggtgatatgtttatgttggaaccgagacattttaagggagagaggggcatcagcgttctgcagcaacacgttttttataacacgttgcccccgagacttagaaactgttcttaactttctgttttttgctcccttggcagagatacatcacatcatatctctgtatacttgtggaaaggaatatggcagaagagcacattgtgtaaacaaatctaaaacaaattctgaaaacatattacagaagggtaaagagcattttgcaacccagatcagtttttttttaattgaaatgaaaatagatttttcataaatactctccaggtgtaaattttagaattattcagaataagaagaaaatacagttagcactgcattcatttaaaattgatcttttatctttgattttaaattgatcctaagatgctacctttgtttactttgtgttcagaaaatgaatcagataaatgagccgggcagctttttttttttggagtggtctatcatttcaggctggtgctgtgtaagcaaggtaatgttttctttttccttgaaatacactgtctgagtatgtcttgggtgactttgtgaaaagtttgtgtatcctgtctgctcaagttgccatcttaaccaggatggagggcaagaataatcatgttgaaccacagattttcaagagcaattattttaatcaggtaattggtaaggaagagagaaaaatgctggatagtagagtagtatttctataaaatggtgacttgcatttttactaaggtaactgcccacgtttcaaatatttttgctaaaccttgttattacctgcagagggagcttttatatgcgatgaaataatcaaagcagtataaattgacatttccctttgaaagttatgttttattaaaatattttttatttttgtttgaaaaaattgttctaaagaaagtaaggcattttgagatgagccaaattatagtgcaacttaatgtactaaaggccttgtgtttatcatttcctttattcatagattacaaatgtgccttatcatttcctttattcacagattacaaatgtgccttattatatttttgattaaaaataacttaaaatataataaagataccagatccattttgagattataattttttatttatgattgtctaaagctcagggagaatgactgcagaactgtcttgtttaaatgcatagtagttgttacaagagagatcccagctttttaggtaattttccagatatgtaacatattattaaatgaccactaaacatatcaaagtgtattacattcctctacatttaattaatagaccagattagatgagttgcatatgtgcttttctaaacagaaaaacgatcgctttggcttaatgacttttacttgcaataatggacatgagttcaatgacattaaaacacgggaactactaataaggacctactattacatgatttagaaaactgctgactaacttgggaaaaaaatgaatgcaggcagaatagacagtacttgattgaaacctgaattctgtttatgactctgtgccagctgaatttctaaggaattgtaagccagatacttagggaagtacttgagagtttttcattcgggtgtttaggtaagcaggatgataagcttttagaggcatttggatattttttagtgagtagaatttttcatatttcctgcatacacttatttgtgccaggaaatttaatgataggatattatattacattttattaaaaaatcaattccagtcttttcatttttccattttggtatagtaacattattttagaatttgcttgttggttggtaaaaaatagaaaggttattatccattatgtatctttggaaagagatgtaatagttcatttctcttattttatcaagtaataatatgacaaaaatatttattttgcattttaaaaagcttcgtttcttaatgaaattccttgtttcagatttattattttagtagctaatctttactaatgtgaaaagtcacattgttactgtgacaaagaataatcctctaagtaaggaaacttgtttaataaagagatttgtggtactggtatgggcttttttataagtagtattctctcagcgtggccccgtattatcttaacaagtgtgtgccacatttatacagagcatttttataatggggtaagaatattagcaacagcaattatatttcaataggattaagatggtatgttttacaaaagtatacaaatgcttcttttccatacaattattggtagatactctttactgccaaatttatgtcattgtcttaaataatataaaaagatatttcttatcgtagctggtttttaatataataggcactgcaaaatgggatctgatgttatagttcattaccttttttccccctaatactaaaacctccttcacagtgaggtaagggttactggagatttcattccaggaaaatggttatgtgaggcacagtaactgtcatagagtgcataacttctgtgaggttactggaaaggcacagctagggtaagttctacctgttttgtcttaaatttgaaggtagactactgagcgatttttaaaatactgaaatctgaatccattgaaaagaaattgtactgaaaagttaatcaaattaattgttctcataaaagtattattggtattttattagggatgtttatgacaaggaaatagattggtaactggttttcggtttaaagtaaccatgatcttggtaaattatcaaagaaaattttatcacatattcttgaattaataataaaaaaatacgaatttatgataaaacattctctgctcctttgtatatacattatttaagcatagatgtgtatatattaattgttcttgcatctgtgtgagcagactggtttttaaaataataagctattatgaatagtatatattatgaagaatagtccttcaagtgagagtattatgtattaagagggtagatttgaaataatattttaaatataaattttataagaatgggagtcaaatatttgaacatgttaaacattttaagtggaagttaccaaagaatatgataaaccctaaataagattagaaaatttatatatgtgtatgaagagtctagaatgcaaaattataaacctgcatgttttaataactgtattggaaaaaaatattttaaattgctcttgttattcccaggatttagaaattaatatttttattttaggaacaaaaataaacaatattagtgtcattttgcctgttgtatgtttcaaagccatttcttttgcctatttaataaagattttctcaaattgaaatcttaacaaaggtataaaaaatactttttattatctacactgaatgtagtagattttgtggtgttcaggtaatgttgttaattcaaagctgtgctaaagagaaatgttaaaatcttagaatatcaagtttgttattttaaaatgagaataaatcataaaattttatacattttcttcaaaaatttaaacacagtagcattacctttatttaaaaataaacacaacatctaaggaaatccctaaaattcagaacaaaaacactcatgctttctactcatgggtaactttgtctctaatatttgtgtgttatacattttaataggaatatgattgctaaaactattttttttgagatacatgtttaagaagggaaaaaacccatttgttaaaattacttaatcactgagtttttatgtcatggtttagaaaatttattaatttttagtgctctttaaatcagattgttggtttaaaagatactgttattttgaccaaatataagtcaaagcggaaaggtagttgttaatactcgtgtcagaggccttaactaaaaagttagctatgttcaaggaaaagacttagtccaacattttactatttgacagagcatcatgctgtgttatctcttagtagtagttagtggcccacagtagctttggctaatgcaaaaatacctgtacttttgaaagtatttgaatttcacctcgagaaaatctttgtttcatctcgttgctctgtaggattcagataacagctacaacacagtaaggtattcaagaatacattccaaaagcacttttctatcattgtattctctgtaagaattagggttgattctcatcagagtctttattagtattattactgcttaaaatattttatagaattatggtgacagtttgtacaaatagggtgacatagaattataatgaacttgatagtcaaacataacctttacctactttaatactgtagttactccctcatacctcatgtgttttattttttactaattttcttatattgtgttactaataagaagtacctaagtcctctgacatttcagcttggaaacctgtcattggtttcttaaaattagaatagatttaaaacaatgattatttaggttaatattacatgattaaaacatccgataacgaagcataagtatcttagaattcacattttctggagttgcatttcttaaaaacatttgggattgatttttaataagtttaagagtatttctaaaaaaaaattagggagtaagaatgagctcttagaacaatactaaattgaatagcttgtagtgcaagcatcacttaagtatttttagaatattgaaaatcttgtagattacatacactaatggcctcattctccttattgcttgttaattctgtgaaaatcaagaggagcatatcaaggttgcagttaattcaccataatattagcttttaattgaaaataaacgaaaatatagctttgatttgttagcttattttattcaagtcagtttttcctatttataaagaataaatcaccataaactcttatgtatgtataaaattgatgttatcagatgtttatacaattgatgatattactagacatttttgcactattcttaagaatactttttattttgtatattgctttaatacttttaatatttcctcttatagaatgttttcttcagatgttttaatagtttgatattactcatttctgaatggatggttgagggcctttttcttttttaaaaaacatttttcactacttgccatgcaaactatttgatctcctaaagagaaccaggatataaatttagtaattagtatcaatgtataggtttttttatttaatgtggaattattatatggtgatgttctttggagtgttttcatgtgacttaatgtgtatttaagccctccatagttaaaaagatgtttacagtactttcatgtttggcattattcaactctttccaaagattcttttaatattttgtctgattatcatttattttaacctacaaatgctctttttatgcttgcctacttttattcaacctacaaaataaaactttattacatgtactttaccaagtccttaataagcttcagtattcagtattgccaagcacttattaaagcttcaacattttcttcctttattttgttaatggtatctcatgaatgttgaattcttagttttttggggctttttttttttcaagtatatttagggggtacaagcacagcctttttacatgcatgtactttatagtagtgtacccatcatccacataataaatgaacgttataccctctaagtaattttcacccctcacacttctcccacgctcctaccttttgtagtctccagtgtctgtttttctattctgtatgtctaagtatttttcatcattgtagcatacaatcaaaaattggtaaaatttaagtgtcaaattcctagttaaaattttttgaaatgatggcatacaaacagctttaaaggtaggccttccgtcccattttttttttttggtaagatttatgaatagattgaaaaatataaaaattcggtggaaatcagaagctaagtcttatctttagtagtcagcttcctttctatgaatttgagttttattgagtcttcttcatcacaagagatcatgaatttggtaataaatctagaaaagtgcagctttttgttagtatatgtaaataatacacatttttttaaaaaattgaagatcgttctcaattcttagtataaaaatcagaaatttgtctgggtctttaaaaatatagtacaaatatctaataatgtatttggttgtttagctgaaaggcagatgtttcagtctttggaattcaagactatattaatctaatactccttaaaccaacattttatttatagggtgtaataaaaatcataaagttaaatttgaatgagtaaaatcttgattttttggcggccttgtccccattctgtgttgtgcattcccaaggccacaagatactgccaagccagaatgattcaatttttaccgttatctacctctcactcctagtttattactttattgagacgcacagcactagagaattcttgctatgtgaatgatttcttttggccaagtgcggtgtctcatgcttataatcccagcgccatagaggatgaagtggtaggataacttgaggccaggagttcgagatcggcctgggtaacatagcaagacccgtttctaccagaaattaaaaaaataaataaataaatagccagcggggtggtgcgtgcctgtagccccagccactcaggagaagtgggaggattgcttgagcccatgagtacgaggctgcattgagctacaatcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagtccttggtgagaggcaatggcagtagacagatatgagaagttttgtaatggtgggttagaatttggcatttgattgaatgcgaggtaaaggaggagcaaagaatcaaagcccagaaccaaggttccagccaagtcttttatgtattccattagcctgctttagtggaagggagaaggaatgagcccattttctgatgatactttgagatgcatgtgttaaaagtccaaagtaccagctgctgagaaggttgatgctttgttggtatgtatatttttaaatgtggtatttgtaaaaaaaatatattttttcttccttttaaatgtttttaaatgttttcgagtgtatacctgcatatgtttttacactgcatatgtttaagtgatactaattttttttaaatactcacataaagtgaaaatttttattatgcgatattcaggctacatgatctaggtttttatttgtattttagatgagatttctagtaggtaatcaagactgtataaaagctatcgtaatctggttagaaatctttattttgctaaagaatacttttgtcattattagacctgttgagatactcttcattgttcagggccattttagtaacattcttaacagctctttaaacaagtaatttgatattctttggtttccttagataccagcctgccccttttcagaaagcttagggatatctgtgccctcgaagatttaaaaaatttcattgcaatttatcttcactgcagctttctcttttgttaccatgaacttctaatattatatatttattttattggtacgtggggaaatttccctgcttcacctgttctttaaaagagtaacaatcatttcctcaatagcttttcagctcttcatacccagcaatagttcttaggttttatagctgatactttgtatcatgttaattatgggtgacaaccctgaacaacaacccaaagcatctatcagcacctatccatcagtgattaactcagagtaggctctcaatgtattttttgaataaatgcttatcatcgattataatgaagatcacaaattgtgctggaacctaaccagttatagattccttgcatggatataagaatgataagagttacaattaaagtgttataacactgagttgtgtgtcctaatccgaaagtattcttgcttccatatagtagagaaaattttttgtgatgcagttacagtgcttaataaagcttcatacatggaaactctcagtaaatgcttattgttgtcattattggtgtaaattaaatctgaatattagttcacatatttaagtggcccttttggtatccgttttcactcttcagattttttttctctcattttttggggggaagactcttctttttttcaatgctgctcaagattttctattttttaaattagagaattttctattattgttgctaccttccttagatgataaatcagtagcaagctgactggtttttatcaaaattgatgttctgatattgagaacaggaagtgttgatgttgacctgtctgtctgaaaaaaaaaaacaaaaaaccccacaatattctgcttacactttcactgggcaattatgtaaaaaagatcagtagtttttccttgttttacttttataatctgatgcctggtgaaataaccacacagaaaacatgcaagtaggaatcttttgtagttctccatggcctataatccctgcccccaaatcatgccaagcattaggatccgcccatgtattaacagctttaagaggaagtcagtagaggatccttgtcagaattgtcctggtgtgtgatggcttgctgcttttttatgaaaggatcagtcatgccgaagacatagctatgcataaggtaatcagcatgaaataaagggaagttaattaaatatggttgtcaatactgtagttgtgaattttatttaactagttaaggaaactaaaaatatgacatccttaaaaagacatttttaatgtttataagataaaatacgtaaagaaagttttgacaatcttaacaagtccattgtcaaactattaccaggctgtgtaaccatctagttacttagcaacctaagtgaagcaatagcatttaatattttgtataaattttcagcaaaggcggcccaaatttttagcattagagacattttctgatatgcagggagctcttcctccacagttcctttctttagtgggtcattacataccacaggtggattatgtttatcttttaatggtgaaatgatagtttttctttggtggaggagctggttatctgtcttccaaaatgtcttctggtgacttgtattaagatcttattaaaatatcattgtgttcttgcattcacagcagaagactactgtaaattgcattatatgaaactgaataatatctatggtttaatttaaagtagaaataaaatctaaattcatacattcgagctgtagggtttcaagattttaatttggtgaaatgccggaacaatttcttatatttaatttgaggagtattacatgagaagtgcatcttatcaaattaggaaagaaacatatactatttacacagtctaattattaaagcatgttaaatttcacagttaatattcagatatctttctgtaaatgagttgctgagatttattgtcaatgttgtttgatttgtaaagtccattaagttgcaaatgctgatttgaggaatggtggcaagttaggatttcaaagtagccatgtttttttcagtaggctctgtaaatcattaatactaaaaagaaataacctgcaatgctgtgtgcattataggtaatatcagaaactttttttttttttttgcaaagcatagctgaagtttaattcccagtgtggaatgtattagtttttcgtatagaggtgagatagcccacaattggctgttgaactggagtgccgttgtctgtcttataattttggaggagaaaaaaaaatatgattttaatttttacattctttgttttgaaagatgataaaagtgttttctacacatgtttcccgctatcagaaaaaaatcactgttaagaggatattgctgatggaaacaatgttttctcaagttcagaatattgctagggaaatatgtagatgtggaaggctaccttgttaagaagttgtgcaagaaaaaaatctttaatttttatattttgatttataatttaatttttatattttaatattaaaattctaatatttttagtgtactttgaaaatgtccaatttgtacatttatataatccctgggttttatttttatttttaaaattttatttatttttacttctttttaatatgaggtcttgctcggtcatctaggctatagtgcagtggtacagtcatagctcactgcagcctcagacttctaggctctagctatcctcccgcctctgcctcttgagtatctagggctataggcctgcgccaccacactttgtaacacagtttttatttaatagcaaaattagcaagtatatttaatatagtttcatataatttcacattttgagataagtttgaaattattataaattgtttttgtagatactattaaattcctaaacttcatggaggaattattctactggatttgggcctgagttgcagattttgtttctgcagtaattatgggcctttctatttcttcatttttataatgaggagactctggttttaaaaactctttcttgaggggtttaatgatgaaaatgataaggtattgtatgtcaaacaatgataaattaaaacttccagaagaagtagtcatttttgttttctgccttatagattgacactctttaatatttaagtgtttaattaaaaaatagtctggcatagaaaaaaatcttgaaaatctctatttaggaggtctccgagttagttcccagttttttttttttaatttaactttcttacaccaacaagcaaagatgaaagtttccagttttaaaaaattctgtttcacacgagtttctgaattccatccactttgctttattctttccactattcatgttagtttccgtaattcagttcatttattcatgcctgcctcccttcctctctccttcccgttttttctctccttccttccttccttcttccctccctccttccctccttccttccctcccccctccctctttccttccctccccctcttcctgtctccctccttccccctacctctgtccctctctccctcctatgtttcttattgtcaaaaacatttattatgtgctagctctttgtcaggcactatgcatgggttatactcactggtaaggtagcactgaagtgatagacatgaaagccatctttcatcataactgtgttcagttagctcaccatcttttgaaaatgttacattgtgatagggatgagcactctgtactatggacaaaaatgacactgtacccctgatgtgtggtggaggtttagggaaccagtcagttagacagtcaagtgatggacccaactgagtcttggaaaaggaacagtagttagccaagggacaagtggcagaggagattccaggcagaaggaacagtataactataccaagaaaggtatagaagtgagagtaagcttctatgacccaagaacataagagcaaattaaataatatttaaaaaagaaaaccacgaagttaaaaaaggatggtcttcctcaagtgtagatatatttgctaaaaaataaatatttcaaaaatttaaatattttccagaaagtttgttaatatatttgatgtgtttttttaattaccaggatattatactagtcatcagaatcacaaagtgataagcgaaagtcatggtccataaggagcacttactctcttaattacattacataaattcgtgacattacttgtgcatttgtgtcatttctgtatcttctgaatcattgtattacttgcagtttaagcctcagtgccttgaacaaagtatgtacccaaaaaattttttaggcttggtttgaaaagatttatcttgaagaaagataaacatagaaaatttcaataaaagacattttatttattcatttatttatagacaaggtctttctctttgttgtccaggctggagtacagtggcctgatcatagctcactgtagcgtggaactcctgggctcaagcgatccttccatctcagcctcccaagaagctggaactacaggcacatgccaccatgcccagctattttttttaattttttgtagagatggagtctcttaatttgcctagactgaacttgaactcctgggctcaagccatcctcctgccttggctccccaaattgctgggatttacaggcatgagccactgcacctggctgcaaaagacattttaaaactagtttaaaagcttaattgaagaggactcaagataacccaatagcaactactgtacaaatgacaacagataatggcagtaagaatctggagagggagaggttatttttcagtttgaggcagtaaggttggctttatggcacaggtggtttttaaactatcaagtttattctgaagtttattaggtggaggggaaagatgttttctatgtgaataaaaaatcttgagtaaaagtcagtttcagaggtatattcagaaatattgagcaagtaagtttgacagaaacagtgctgaattaagtatttttgaagtttgatctgtttgggcgccgtttccagttttgctttttaattctcctctctctctctctctctctctctctctctctctgtctttcagattttcaattaccattcccctttcattccagccccagttgcaactttcttgttgttaaaatacatacaatagggctgggcgcagtggctcaagcctgtaacaccagcagtttgggaggccaaggcgggaggataacttgaggtcaggagttctagacaagcctggacaacttagagtcctgtttctatgaaatactaaaaatcaaaaataaagaaataaaaatttttttttgttgtagtgggtatgtctgtggtccccactctcaggaggctgatgtgggaggattgcttgagtcaagagtttaaggctgcattgagctatggtcgtgccattgcactcttagctgagcagcagagcaagacgctctcttttttttgagatggagtcttgctctgttgccaggctggagtgcagtggcgcaatctcatctcactgcaacctccacctcccaggttcaagtgattcccctgcctcagcctcccaagtggctaagattgcaggcatacgccaccatgcctaattttttgtattttagtagagacgggatttcaccatcttggccaagatggtctcgatctctccttaccttgtgatctgcccatcttggcctcccaaagtgctgggattacaggcatgagtcaccgcacctggccagaccctgtctccaaaaaaaaaaaaaaaaaaaagacatactagatttgttgtgctaagttagagtgaaataataatacatgtacttttggagacattttagaaacatttctgagatcaacctttgtcaagtcagaaccccaactgtgttcttccatgtaaaattatttttagagtttgttccagttttatacacatttatggtttagggtgaaattaggaagattactagaggctggcaagatggatggaaggtgataaatcagctttgagatttttgcagatgttcagaaagaaagatgttaggacagagggattgaaagcaatgggaagaggattaaggtatttcagggtaagaatcaatagaacagtgaatgtgtacctctttaaaatgaagtaccttttgtattgacagagctatattttacccaaacttaagatgaataatgctccagaggatttttggtttcaaaactattggagactaggctaatttcatttgtttgtgtgtgtatccatgcatacatgcacatatatatttagtaagcttggtttaaagaaaatctgttacttcatagtagatgtgattttcttttaccatttcacactaatgcatttctttgttattataagttagcaattgaaggttatatgtataattcatgctaaattagtatattggtctagaaggtttttcaggagactaataatggagtagaggcttctttaatacatatgactatataaaacattattaatattaacagatgttgcactttaatcccctagaatgactggtaccagcaggagatttattaagcctgaattgtgtgaaattgtgtgtgcataagctgcaacttagactgtaaaaatgctactgaaaactgttaaaaagatttagctataatttggcagagaagtattaactgtgctaaaagaagtatgtgtgtatggttggcccttcgccttaacctttttatcatttatcttcttgtattaatgtcactgaattattaattcatgagccaggatgggaagggtgaaggcaccatttaaatgtgtggcaaatttatccttatcgccagagacatgaaaaaagtcattttgtgttatctgtaaaatggaaaggacattttaaaatttcatttacagtaatccacttcacttccagtcaaacacctagattattactaccataatataatgttattaaaaatttgtaaccttctccactcttttgtcttatatatataatgttgatagaaaaatttagccttgatttatttcagtgtgatacttgttaattgtaggttaaaaatgttacttttacgaatgatatgttatagtttgacttaaattttaaggaacagtagacttatgaaaaataaaaaatatttactgtaataataacaatcaggatattttcattgaggggagtccgcatatagggaattggaaagctctaaatatatgtttcaaagaaatgtttgcatttattgtgacttcataattatttggaataagattggtgatgttggccttgtggaacttttagcattatacaagaaacttagcaaattagaatttagcatttacttgttgaatgtaatgtggatctgggatatatccagtatttcatatggataagtagctatggtgacaggaatttcaagagtttgaagccacttttaccagcagctcttcgaaaccatcatgctaatggaagaatacctcaggggtcttgtccaaacctcatcacttttcattctcccgttatttactattttgattggttttatatactctcatgccaaacaaagtagtaagataagttactgtggtaatgtcctttgttttcttttctagaatttctccccgaacactctaaggtatacatatggctctgttatacacacactgaaaacacgaattgttttttttgagatagaatctctcttcgtcacctgggctggattgcagtggtgcgatcttggcgcactacaccctcagcctccccacttcaagcatttctcttgcctcagcctccagggtagctgggattacaggtggtgccaccacgcctggctaatttttgcatttttagtagagatgggatttcaccaagttgtccaggctggtctcgaactcctgacctcagccaatccaccggcctcggactcccaaagtgctaggattacaggtgtgagccactgcacctggcctgaaactctaatttgttttgatcagtaaataatgctactttgtttttcttattctagtatggttaatttacctttacattaacatttaaattaatttcttaaaataatagactaaagttgatttgattattttggcagacatgaatagttattagttcattatgtgactgaactgcatccagttatcttggtcttaggattgttcatctataaacaggggttgggcaaactatggctagccatcagttttgtaagtaaagttgtattggcacacagccaatgtcatttcggtatgcattgcctgtggcacctttcacactacagtggcagacatacatagttatggcacagaccatatcactcttaaagcctaaaatattttctgtctggtcctccatagaaagagttacctaacttctgatctgactgtctcaatctgcataaaatgttggttctaatccttacaaatgtagtggaatataattgataattttaagctcaagagattggaaaattcagtagtttttatcatcattggaaatgtttttttttaagcagatttttgcttttctttatatgtggagtagcaataataagtgatatttttcctgaaagttttctgaattgaaacattttaaaaaccattaaaatgttgcaaaaatacattagtctgttaccacatgaaggactcttggcaagtaattcaagcttctagtcatttttctctgctttttataacctatgtttcttttttattaaatgtcactgctttattactactttaatgttatttgaaattttaataggttataaaattatattttaaagttgaaaaagctcttttctaaaaaccacatacctctcctactccatgtttgagtagttaagaagcactaaaacataaattttaatttaatggaagaccttttggtttttaattttttcatacctaacagccactcaaaatgacacagtctgttactgtttcttaataggtgtgtccatgaatatttttcttaccgtctcatctaaatctcctcatatttttttttttcattttttttgggacgaagtcttgctcttgttgcctgggctagagtgcagtggcgctatcttggctcactgcaacctcctcctcctgggtttaagcaattctcctgcctcagcctcccgagtagctgggattacaggcgcctgccaccatgcctggctaatttttgtgtttttagtagagacggggtttcaccgcattggccaagctggtctcgaactcctgacctcaggcaatccacctgccttggcctcccaaagtgctgagattacaggtgtgatacatctcctaatattcttagaggaatcagctacaccaaacacagagtttcaggctgacatgggaagccaaagaatctattctgttcattcacttagactctagctttatctttagtactattaattaagttaattatttagaaataattggtatattccttttctgtacaactcaagaaaatccttttgttttgagttttacttgtagacacagatataaatggtatggaacatttggcataatcgggactaaccccagctaaggcatagaaacttgttctttcttaaagaagtccctgatgttgttttgaattttcgttatctgtagttttcccaggaaggcagagtgtgaaatatgtgagctaaatgcttcaggttattataatattcctgtcaatataataatctataagtagatttcaaaaacaaagattttctgaaacagttgcttctttttaagatatgaattagaataattgccgagacatattttgatagaagagacaagtccttagttaaacatattgcagaagcccccagatggcttccttaacattacttaaggtagaatcaggaccataaatttatcattgggaaaattggaaaatgattgaatcatagatttataatctcttcctacccttatatagttgctgaacttgagacctagatgcttgctactgcagtccttgtaggggcaggttgagccacgattctatagtgtgcacttgatctggatcttgacctcttcattaagatgactgattgatctaggtacacgtctcaaggaaacacagatccagaaactgctgttagttacttctcttagcttctcatcacatttactaccattaagttttgggaggtttagtaattattatttaatgcttattttggatcttggtcattttcttgcatatttaattctcataagattattaatttcttgaaggtggcagctatatcttaatctgttttataatgcctttagaacctaacacaggaccagttaatacagaaggtaaaaaaaattaatgaataacactcgttttagcactggatatccattaaaaatgtgtaggaagtactcactggatattcattgacttgactggacatacatgaaagtatagtgctaatgtgatctactttatgttaaaggcaagaaatgtaagtttagataacactatattgacatagtttgcaaatgaattgtatcatttaattacaaaggcaatgtgctatagcacttcacaaaacttcagcttcttactgtgtattctttatagttaatttttcacatatatctatattttattttatttttttgagatggagtctcgctctgtctcctgggctggagtgcagtggcctcatctctgctcactgcaacctccaccttccgggttcaagcgattctcctgcctcagcctcctgagtagctgggattacaagtgcccgccaccacgcctggcaaatttttgtattttagtagagacggggtttcgccacattggccaggctggtctcgaactcctgacctcaggtgatccacccgcctctgcctcccaaagtgctgggattacaggcgtgagccaccgcgcctggccaatttttcatatttatttttaagatcatttgatgtattttactcagattacctcattacctctaagaaacctctgatggtgatattgatgatctaatatatgacagatcctgggtcattattatttcatttagtggttgtatatatagaccaagagggaatttgaatattgattcggggaatggccagtaacggtgatttatgaacaaaggatccagtgcagtgagccaaacataagattgcatcttatgagtgagccacgttgagttttttctgttatacttacccgaatgatgattagtccataatcttgtagatgttaatattaaaacctttgttccatgactattaaagatacattgctagttatattggaggaaatatttatgtatttattctttggacttactatgaacaacttctctagtagtttggttgataaaatttatcagtgtaattagttatataatttaggcactttagtaatataaatgagtaaattaggatagctcaactggaaatagtaaaaattaagttaatatttagctgttattacctaagggatgtttagctcatgtaaacattttaaaaatcaactcgctattcttttggtgtttcctcacttttgtatctcaagatgattttgttctgtattcatttttttattctaaaggaaaagatagtaaaataaggttatctggtctacataattagtaacagtagtgattttagaacatgggcttatttctcagcccttctgcttgcttactttccttgagtaggttaagttttctgcttttaagataaaatggatatatttcttaaggttgttgggaaaattgcatggaagagtaagcacactgttatctacctagtttagctgtaatttttttgggagcctaactgtgtgcaaggcagttacaggtttttactaggacgagttatttttaaagtacagtgtaatctccctgtggatgagaaattttgtttctttttttcctcagtacacaacatatgtaataggtgctcagtaaatatttgttgaaggaataatttggtgaatagtggaaagaatggctttgtagatagccttgattgggatctaagctctgctgcttattagctgagtaatttcagttgagttattttacctctcggagcctcagatttctgacctttataatactgatcttgcttttttggtaaggattagtgatatgtatcttacagtatttcagacaacacagaagttagctttttcccaatttgaggtaaataaaaagttatttttaaatggcagtcctctccaattttaagacattgtatttcctccgaactttcttttcttctttttgatatggagtctcactgtgtcacccaggctggagtgcagcggcacgatctcggctcactgcaacctccacctctcgggttcaagcaattctccttccttagcctcctgtgtagctgggattacaggcatgcaccaccatgtccagctaattttttgtgtatttttagtagagacggggtttcaccatgttggtcaggctggtctcgaactcctgacctcgtgatccacctgccttggcctcccaaagttctgggattacaggagtgagccaccttgcccggcctgaactttctaatagtctagagtcctcaggcagtttttttgaattgaattacaagtaccatgactagaaatatttcctgagtgtctactatgtctgcgaaacgaagaaattttagtaaagggtaagaccagtgatgaatattaaggggacttctgtataaatagtttaattaatgtcctctagacttgatagcagtgcctgcagaaagaaaatgaagaaagagggtggtgactagtggctggccacgtggttttaaaatctctgtgagcattgccagccccagccctatccatgtgaagaaaagaaaataaactcaaacctcaaagaatgctgaatgtctgaagcttctaagaaagcctttctgattagggatagcaagggtttgcttagctgacttactgaaggaaaactcccaggggtaatgatgtgttctctgatgttaagaaggggaaatctagtctgtaaagattacacataaaatatttctgaaaagtgaataacctgattgaggttcagctaaagtgaaataaaactataatttattttttcattttctgagcctttgcacagaaaatgaaaaggcagaattgggttagtgtcatccttttttgtgtttgtttgttttggtaaaatacagaaaagcggctcttgttagtaaattctgtctcataatgattataattttatgatgcaaataagatctgagactgattttgtaaagctaacttcagttttcatttagagttgacatgtatttagtacatagaatttaggcttacctaaaacattaatgtttcattttacacagcattagtgcataataacaaggatgggtgactttggtagttctcatgcttagctggctcttttcttttcctgttctcttcatgttataactgttttgggcttaatagccagtgtttgcagtagttcactgtccatgagtagaaaccaaaaataaagctttagatagaactccttatggtggctttgctcctggtggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatatttgattatttattcgttctattcttagctgattgtggtttgttaggtatttcaactttcattaacatttgtttaatggaaggttgtttaaaacttgggtcacagcagtaaaatcttttgatttagtttccaaattgcacttaaagcttgaggttttggaaataattttatttgatgtaaaagcgattgggcacaggttgtagaatgataaaaataaatttgacttttttttttacttattcattacacaggcagattgacttaagctttatttttgtaaaagaagccatgattttatacattctagaacctgtttccatttgtcagaaacaaccacttacatggtctcataattgaatgatatgtatttttaaaattgtgtttcacattctcaaaccttcagaatacactgaatttttagtatataaaaattttcataagatattctttcctggccaaagaccacaatagaggtcttgattgtgtggtttcctcctcctttttcccttcacgaacagaggttttcctatcttggcagctgtttcctacaaagcagtcatcagtccctgatttcttccttcctcctccttcccacaaacaagggctctttgaatagtggatgactgaagacagactgatcttggatcactttaagaaagtggaaacgtgtgcaagagttgagcatgtgggcaagctgcctgtaggcactagctcattcaaatcaaacaatgaaaacttggacagtaaaaattctttgcttggaatctagagtggtccaaaggctgacttaattttacttgcagcacttcatccacgcgtttacattattctgattgcttgatcagatcatcgaacagactgtaagaatataagaaattgttcattgatggccttttaaatgtgacaagccatgagattatctgactttttaaaatgctttatgtagaataactttcaggtttaaggcaggcacattgctacagcagttgtaaactgcaggttcacttttggttttggttacctttgaatagtctatgggagctcagagtgaaaaatgtacagagccagccagctagttttgcagggatgcgtgccatgtgtctccatcagattaattttggatacatcattctttttgaggaagtttgcattttcctttgtttctttggacagataagcatctgaggtgttcttaaatggcataatactgatgttggtgatgcctccctctcccctgtgtcttcagtgctttcagagagagagctaaaacttgggccaattctgggtcatagagggatccttagggaagcatttacatctctgaaactgtgggcctgaatgatttcagattaatttcttacattatttttgttgtgttcttaataaagcaagatagtacctttataggtaataagtgtttcaaaccatttaacatctgcctgcttttccaatcaggttacattataatgaactgatagtagaatgtagtgtactgctaatagcatcccgtgtgataagctacatgaagcatgtagtaaatgcacagtaggtcagataatgtgcaagaactcaaaagttatcaggaaaattttgttttctaaattttctttatggtttagtgacagcatcgaaatgatgtaatgagtttgttttactgagttatgtatgcaacctcagaaagggagggaagagttccctccctgctgcactttgtaaaactctttagttgcagcaggttaaggataactggagaaaacttggtgtaagagtattatgtagaataaaataataggaaacgaacatgaagaaactgtaagatgttcctttaacagaaaagtttgtgatttcctttccctcagaggctaaatgaggaggctggatatatttgggaaatgccttcattttatgtgcattataaggctaatgtttgctgtgattcctcacacgacctcagaaagaagtaaaacacttggacagaacccagcaaatgacctggtctcatgtgatcctagaagccgagaaatactaagtcatactcctgaagtttttgtacactctgcagtttggagaactggatccataggggctatgaatacctagcagtcagggaaataagtttgatttggtgattaggaatgtggcattttcagaatccctttgtatatggcattattttgccatgtacaaattttggcaatttgactgtcaaaaaggcagtcaacctttttgggcttttgactgttttcagaatgtaagattcagatatccagtgtataggagcagcttccatagtggacatagaatcaaaatatgttttatattcaggagagagagagaggaacggagagagagaattgttttgttatgtagaaagaccatagagtaagtgatggatttgtttgtttttcagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtaagatccagtttacattttgttttttaaatccaggagaacttgaactatacaatcttcttaatatggaagtgcctagaatatttgtttattattttaaaaataggtgttaaaattatttcctgaatattgaattgtttattaggtggttgagttcttttgataacacagatatgatatagaaagtgctagatatgtgaatttatattttacgtgcatttatgaaatataaccattctaaataatcccgagggaactaaatgaaagctctgttttggtatacattttacatttattcactacatttattttagtaaagtggaaagtattttgtggaaattttcatctttagttacatttgcttaagtgtgtgcataattctaaaactcctaagttaaaatatgtagtcttttatgaaaacttacattttaataatagttcatctttttatgttgtttatatctttagctgtatatgtgtgtgtatatgtatattctttgtaatgttaaatttgcagaaatataactatttctttgtacttaaaaatagatgtggaatttttcttaagcactattgcattaaacatttttaaaatctaggaatagtaatgagtgtatttttcaagacagacctgatttttaaagaaataaatatacttttgaagcctaatgaaataattggaaccatcatttattaactatatagatttctggaatccattgttttcttagtcttaaatattatttccacatgaaaacaacacacatgcaggtgttttttagagcaggctagaagttaatatggagctaagatgtataaattttatagctagttgatagtggcagttattggcacgaaaatgtattaatcttgtaaagtttgtgaagggtataaaatctctgagaaatgcatataaattataatggattttaaaaaattccaattcttgaaaaaatgtttaagaattaaaaaattgattttatatgtacttttaagtgatctcacttataccgattattaaaatgataggtggagaaggggcatactgtcaactaatagaagtgtattattccgttgtctgtgtaataagcttcaaaatgttaacgttttaattttgctgaaagaattttacttgaattgcttgttccaaagttatattttatcatgttctccttgtccctccagtcccctacgttcagtatattgatatgatgtaatataatttaaataaataacaaatttagaaatacttaaaataagagtttctgtattcagaaagtaaatagtgttcacttggatttaagtcacacttggcagttacaatctttgggttaatattttattttcagatgacattgctctttgctttagaattgaagatgcatcatatctaacatcatatgtaatctgtgtgaatgaataatactatcataaacagtgaacaggaattgtgtttaataatataaatttctggcttggattgttgtgaaaatcttgtgtgtagtctgatgattttacatctcgtttttggggaagaaaacctaactgaattcctgctgttaggtttgaatgtttttatacatttaaaaaagattccaggtgtggaccaatggctcattagtccacataatgaaaaaatttctaatcaagttagagatcactttgcttgcacagtagcttaactcagtggggggctagcaaacagagagttttttcatgagatactgcagctttattttcagtgtcatctatcaggtcaggattcatatctgctgttaggagaaatttcatttttggctcatcaggccagggggtattgcttctgaagcacttccctcctacgggtaaaaagaacctgggacgaacccatactgctaactgctaattgtaagagtatacatagttaatacacactgttagaacattgatctagtattgcatgggtttgtcttagaaagtcttacatgacatcatagtcctttattgccagaaagcagataatgctctgtgaacatctatagagaaagccaatcaacattaggtaagaaggcataggaaggcagatatgaatttaaccttcagctattgagtttcttttgggcccttacatgattgtaaccttttaacatcttacacagtttagttctttttatacttctttttataccagtttctaggttcttgcaggtaaactcagataagttttcctgagtgatttcttccctttttcctcatttattgagtgattaaattgagctgcatgcttagggttcaaaaatacacaaggaaaaataatgcataaggcacggttctttttttgtttattttattttttattttcccgtaagttatttgggcacaggtggtatttgattacataagttctttagtggtgatttttgagattctggtgcacccatcacccgagcagtatacactgcaccatatatgttgtcttttatcccttgtcccactcctactgttccccccaagtccccagaatccattgtgttattcttatgcctttgtgtcctcatagcttagctcctacatatcagtgagaacatgggatgtttggttttctcttcctgagttacttcacttagaataatagtctccagtctcatccaggtcactgcaaatgctgttaattcattcctttttatggctgagtagtattccatcatatatatatatgtatttttttcatcatatatatatattttccatcatatatatatatattttccatcatatatatatgttttccatcatatatatatgttttccatcatatatatatatattttccatcatatatatatattttccatcatatatatatatattttccatcatatatatatgatggaatatatatatataatatatatataaatacacacaacacacacatcacagttcctttatccactcgttgattgatgggcatttgggttggttccacgattttgcagttgtgctgctgtaaccatgcatgaaggcatgattcttactcttgagaagctcatggtcttgtgcagggattgaaaccttaaatacttgttggtgccttgagaacattcgacttgaggtcagacaagaaagtgcttgtcagaggacctgtgattaccattccagtatttagcttggtttttccagtcttctgactttcagtagaaatcaaacattaggatttttaagtaatggcaactaattaagattttgtttaaaaaacaagcgtgtataccatagaatagccatgggttatgcctttccttttagatctttttttttcctcctgttacagttgtattttaccttggtacatgattttaaaggcttcacataattttggatttgctttacatcggtacataatgagacatacatttccaaattcataaggacttactctgtgttcaggcaaacattataaatgtcatattttgtgtacacatacaggggcaaatcactaagcatttttaaagtttgaacatggcaaaagctaattatacaaaggtttaattgttatatctatctatctctattttgaatcaagtcttacccattaaaatttacctgtttgtgtaagaatcaagtcttacccattaaagtttacctgtttctgtaaaataggattaatattttacatattctctaagcctttcctacaacgtattttggggaaaattatatttagaatttccaaataaaaatgattttatacagaccaaacttgcaaaatattttgtaaatatttcttataattgattttatttctagagaactaatctcagattcttgaaaagtcagttttatcgagagactggtatgctttgattcttttggccagtttttataagcatagtacccactgtggaatcatgtatcagtaagtagaaagtaaattgaatttttgtgtcctagagaattaaattatgctgtataatggagccttggcaagcataagttagacacatgaaggcttgctcaagtgacaagttacaaataatagtacttcttcagcaaattcagtaatgcagatttcaggttgaatcctttatgcagtgaatatgtaattagattttattagtcaaaattttacttaattacctcaaattatattgttgcttatccttatttcaaagaaaaatgttctgccaggtataaatatgagacatgccagaaacagctttatgtatttattttatataaatcaagaaaatataacagttgtagaaatagtttcttgccagtttttactgtacttttaagttccctaagtacattttataatgacttgagttaatgttctctctctaaaaagtgtgtgtctgtagggtcttttcagtatttgggtagaagaaaaaaaggcagatttaggggttaaatatgaaatagtgaaaactgtttctggcatatagatatttccttcagaatggtctgaatttggtggaatgattagtaactttattctccaaggttaaatttaagaaagattaatgtaattcagactactgtgttcattcctccttttttctttcattctttgatttacacacgcatataacaaaatctgtacatatatacacatatttgtgtatatatgtgcacgcgcatacacgtgcacacacacacaacatgcagtatgctagtttcataagggcagggatgttttgttgttgttcactgatgtcttcaagtgcctgaacaatgcctggcttatactaagcactcaatccatagctgtcacataaatagaataaatctttgaagaggttcatagtctgtataatgagggaaaagacaatgagcagttgtaataagagtgtgataagtgccataataatgatattcacagaggcattgggatgagcgatagttggatggttgcatgtgtgttaggaaattcttgtagttggaagtgatgatacggcagaatcacctggaagatctgcggtggggcccaagcattagttaacattgctgacaaattgcagggtgatgctgatggtgttgctcagcatcacactataagagccactgcgtattctatgtgcttaggggtggttgtggtgagggtaggggtgcatgggtgtagacatggtacaactttttcaaaagtatttttggaaaaaatgatgagatgattgatcatgattcagaagttagtatccagttgtttcttgggagttagtatctgtttctttgcagattgttctttattcccctgattaggcttcttgggaataattttagtcttcagaaaaggattttttttttcttttagcgcttttttttttttttttttttttaagatggagtctcactctgtctcccaggccggaatacaatgggatgatctccgctcactgaaacctccacctcccgggttcaagggattctcctgcctcagcctcccaagtagctgggattacaggcacctgccaccatgcctgtctaacttttttatttttagtagagacggggtttcaccatattggccaggctggtctctgactcttgaccttgtgatccacccaccttggcctcccaaaggactgggattatatgcatgagacaccacacccagccttttttgctcttttcaagagtatactcagaaaaaaattttgaaaaatttacaccaaattggaaaaaaacgtatttttcctcttagggataaatgctctgtttagtagagctcttaaaactcttgtttcaatttgtctctttcactctaataccctggttcttttcttgttgagaataactacatggccaatgctgtgataacactgaattgacttactgtggggatttcagatttcccaatctaacaaaattaactacttttgttcatttcagtatatttgattagttgaagtctaggaggtaaatttttagcaaggtacttggggatttggctgtaaacctaatgggagtcacaactcccattaaattaataggaattgtgtatttgtgcctgctgcatagcaaatgtaactttattttctaaattcacaaattatgtaaattaacacccagctaaagcaatgaattttttaaaaattactattattattttttgagatggtgtcttgctgtgttgctcaggctggagtgcagtggtgtggtctcagctcactgcaacctcggcctcctgggttcaaacaattctcctgcctcagcctcccaagtaactgggactacaggcacccaccaccacgcctggctaatttttgtatttttagtagacacggggtttcaccatattggtcaggctggtctcaaactcctgaccttgtgatctacttgccttggcctcccaaagtgctgggattacaggcatgaaccactgtgcccggccaaaaaaatgattttatttaagaaaatacttaactgtattgctcttaggacactttagatattctttattttgtttcatgagaatattgtaatttgattgcagcagctttcttctccataggtagcgataattcggttttaaaaatataaatcttaatgcctttacaaattgtatgatgttgttatcttctcttgcaaaaatcaaattattataatattactatcagcattcaagatgaaggtaaatatgttacaaatgtgactcaaagttgccgaaaataaaattaagcttaatcggatacactggcatcttttcaaaagtaaatttgaattatactttggtcatcttatataccaatatttagtgtcagaatatgccatgtttcataaatgaagataaagttcaagtgcttgattgtcgatttttttttcttcccacttttcctcatgctttcttcttgattccatcctcttttgcctctttttcatttgtggaaaaactttgtttatccacagtcttcgttgattcaccagtaggtctgttgttggcggaaaaagtattgcaaacgtgtatgtcattcacaacagtcacccagcagacctcaaaaacattatattgcgtggctgtttaatttcggtaaacctccattttctgacagaaaagaccatatcaaatatttagtaaataaatttgtttttaaataataatttgctaaaagtaaaaaggttattagctcatgcatactagagtaaattttagaaataccgattttacatgcatattaggcatttacacagttatttttatagtttgaaagaaccaatagtgtattacagggagtttaattaaaagcacaggaggcatttaaagcaccttaattttgtggaactgtgattctgttaatttctcattactcattaatttcagcattgaagctcttcattttttgaattaatacactttaattttttaatatacgatagcttgtgatattagagaataagataagtgattgaacacatctgaagaccacatcagaagactattgtagaacatgctgtgtctcaaaaaactgatttatctgccatattactaagggagtgtcttactaaaacttgataccccatggtactctattttcttttcccctcctctgcaagacaaagaatgacatatgacagccatgcaagctacacatattagacatcaatttggattagtgagtatctcatggcatctttcaaccctattcctgaactccttttgtcaacttgacagaagtgattccaggagaatacctagtcccagcctcgggatctcctggctaaaatgtaaagctgagaagggaatacgtatcagcacttcaggaagcagaaacaacatttataatctcttcttatcagcatgggactctcctgagtttgacttttatgtctgccataattcttgctttgagggcttatttttcttaaaagtgttttttttcttctgattttgaatgtatatatcttcatgagaaaagagaaaattaaaaaaattaagataaaacttttagaaggttcataattctgtgactttcttatgcggcagcacatttcttttctgtttttccacctatacacatacttcatatggataaagccaaattatgtataaatacaaaattaggttattcatctacatatactcttatattcatattttcacttttaattatcagaaacagtattactatgccattacatatttagataatgaatgctaacagatgcatagtaatttatttaattatacaaatttaatacaaattatttaatcctccttttctacttgccagccatttgtacttaatttctttcaagtataagtaaaatacatatctatataattatttttccttcacaactggttatttcccgaggatagaattctataattctgataattgtactggagatatagacatctttcaaattggcttttttgaagagttaaacctatgtgcacacattgatgaccagtatataaatccatgcactttaccagcaatgatctgaaattttaaaaagatttaacactttgatttgtaaaaaagggtatctgattataaattaaatttgtaatttgggggatacttctggggacaaaaacattttttgtagatttatttattggttagttgtcattttgatatgaactttttgtacactgcttttgccagcttttctgtttgtattgctaatacttttcttatttttttttttacaatttattgataatccccttttttcatttttattataaaaacctatttttgccttttagtttaatttacactgtttaaaatttttaatgaaaacttcaaatagaagagagaaattcgtagtataacactaatcgcaggtttaacaattgtcaagatattgttacatttgcattattgcactctttcttcttctttcctttttgttatatagctattttcttttgtgagaccttccattattttatgcttaaaaatgtatatcttgatctcagttaaatatttattcattacatttccctgtagctcttaaatatttttatttaaattttgaatccgtcaggaattaacgtttttataaggggaaatctaaggtctttgatcacttaatttaaaatcaagtgaactaacattaaaccaaccagtaagaattaaattttaaccaacacagtagttgaagtttggaacatagccaaattaaaaatggatgatggatgatagttgaaaaaacaaaaaagaaaaagaatagaagtaaacactgtttatatctacatagattgaattgtgaatgaaagtgtgactgttctgaatccagtaatatatcagtgttcttctctccttaaatgatttttgtatcccatgtatttaataaagtttatttttaagagtttttatgttgttaaacagccgagagaagcaaaagcatgactgtagagatagattaaaatgtcccaccatgaagatgaagttctacattttaggaattttggagtttcaagaaacataaagaatttcctggaaaaaaaagaagggattcgtatgaagcctggttaagttttgcacagggatttaatctaaaaaaaggatccaagtaaaattcttattttgttgcatatttacagggtgcgtcttactattcctgtacccatctctttgtatctaattgttgtgtgtttgtgtgtatgtattaatcattaattagttctcttttcccttactgattcttctttttctctttgtagtactaaaatctaagccaggtgttagatatgcctatatgaagttcaagctttggttagagacaatatagtaggttaatacaagtcagagacttccttattttagttacacattacaatagaaagcctgttggattttaagaggctacttttatatggtagaatgctgtgatgaggcgatgttgacaggctttttaaaaagttggtaagtaaagtgaaggagacaggtgctgtaggttgagtttatttccttgtttaaggaaagtgttttgttgtttttttttttttacagttttcttgtttggttgcttttggtagatatgttgaatacctgaacatttctccagttggaaggaagggaaatggaacccattgcactggtaggaaggctcattcagggaagtaaagaatgtgtattaggatccagagagaggaaagattcaggaagagatgtgtacagccgcagaagaaagatgatggaggtcatgctgggctttaaacatcttatttatctagaatagtgcccctcaaaagttaatgtgcatataaatcactcagggatcttgttaaaatgtagattcttgcttcagtaatctgggatggaccttctgagtctgcatttctaataagctcccaggtgatgctaaggttgctggtctgtaagataatgtctgtattagggagttttggttattaaaatgtttggtctagaaaatgagagtttacatgacagtgacttccgctgttaaaaatcgaggtttgttttaaacccaaacaaccatagttgaaatatagaaataacatcactttcagttgtataactcattttattaaaaaaggaactaagctaccttgaaactttactgaacatttttatattttgtggcacttctaatcctattttatatgccttctattgaccttttatgtggtgagttgctttgaaaaatccctgagtaacaatgcagcctgaccctttctccctaatatttccctctattccctattgatctgtcatactttcattctatcatacacagaaacagtgtttttaacagcattttaatacaaatgttttattatttaaagtaacactataaagtcatgtaatgcaaagtgtatgtttgtcttatttagaaaaagtttatttttattatactaatttttcaaagtcaacatatttaatcaactaataattgttgtttttgcctaagtattaattccttggcttatcagcaccataagagtataggatggaagtacttgattgttaactggtcattaaaaatggctaaatatgttttatctgccttaggttatctagtgatttttccactttttagtattgtatagaatcaaagattttcttcttcttagtggacacaatctccttttcccttttctttcagaggcaaagatatagggtactgatatgatttgttttaattttacgataataccaattataaagtaaatttatttcttaatgaattttattagactcttcaggctcttaaaccactcaaaagtaagttagtagcaaattttaaaaatagagactcctatataggtacctgagaggtcgaagtatttttattttgatttttttggtggaattaaagaattttggactttgaatcacagcttggatattagtagtgtagaatttttcattttacagatgaagaaactaaggcctgcagattgttcctttgtcaagctctacttaactgccagtccagttttcttgctgtagaactttatatttagcttcagatcattagtatattttcctatctcagcaggctgttactcaagaatatttaaagtatactttatattgcttaacattgcattacttaatggtaattatcaaacgagctaattatgtcagttttcttaatgtttattaccattttagatgaaaaactatgttaagatttgttttttagtgaaaattatgtagagtacaggaggaccaatcatgctaacacttcaactttcaaataatcttccaaagtttacagccataagcatatattttttaaaaagcacaatttatctttgaagttaccagctattgctgagaaccattaactgtcagaacaccgaaaacctgtaacaattataacaagaattgtaactcttactatgtttagttatcagtccacacagattatcagtcatcattaaaacagttaaaaggcatgctcctcctgagcccctccttcaggtatgtgttttggacattatcttttcccttttgtttgcttacaacaggaagctcgtttaatcctttgctttgttttagaggtaagcaaatagcaaccatccctgttagctttcaaaagctcttacttttgttgcattaatggcactcactgtagattgtgtgatcttgctttatttaccagaaagcttgcctttgagagctgtcactccattctttcaacaatgttgttaattgactgatagcactgattgagtggaaaaccttcagtgacaaaagactggatataggtgtgagtccatttgaaaggctggtgaatctttgcttcttaatcccatttctatttgcactgaaatactaaatacagcctagaagaacaaagcatatttaaaagcattcagaaatgttaagcaacaataaaaccccgtaaccatttaaatgacagcagctgactatttgaattaactttgtgtttggcttaatttggggccctaattattcctaacttacgtgagtagatttcaattatagtatcctgcagggatttgtagctaaggcaactaaaagaatcattttacataaagtacttttgttcaactgattagacaagttaaaacgtaatgatgtaaaattgaaacccttctggcaaggtccaaacaaatggttctagtaattttgtccaaaaaagattaatctaagtttgattttaaatactattttggtcttttaggacgattgactttcctgtaatactgataagtatataaaaatgccttaagattgcatgttttggtaaaggagtaagactttaaaggtgaggacaaatttgtcacagtggatggacaccttcctaagtaatgtttatttgctttataatcttcgatacacagtttgacagctttaaatgcatagatttagaagataaatacatacaaataacgtgaatgactagtacctatttaattctgtattttggaatacatttcagttgaacacagatcagaggctcatttatggatttgaaatgctatataccaagaagggacacaacatggttgacattgtgctatagtcagtggacagactgtttgactcgtcctgccgaaatactcctccccactacaaacagccacattaattttaaacacctttaccagaatgaaagctactttaaacttaattactggtgctggagcacaatattaaaaaaagcattagccagcatccatagatcattttgaggcttaaccatagcatttcactggagtcttacagctgtctaatatcagtctattgtagtgagtgaagttaagaggcagcaactctgttctatgtcttgtcttagcactgctttaagttctcttcgttgtcttctttctccccctcctcctcttttaccccttctttcagtttttgaatatctacaacatgtgagtcattgtcttttcacacttgatattttcattatttcctttaagctagtcaattctatgacctgtttttcactaagtgaaacaaaatctaaaaggcatggtgtgaagttcacagacctcacctttttgacttcaaagtgaggttttcctcccatagcacaaatgaagctatataactgcttcttgaaaacaatgtcaataaattcattctttgacctattcagttcctttttgttctttagtatactttttgaaagctagtaacctttaggaggctttttctaatctaaacaggaatcctctgaatttatatagcaacacagtacaatacagtaagccacaagtagttattgaacactggaaatgtgactaatgtgactgagaaaatacatttttattggtcagagcaattttataggtacttctttcctgtaaggctttgttgttgttgctgttgttacctctttacacctcctttatatgtttcagctaattcattgaagttaagcacaatgttttatttatttctgtatttttcatagtgcttaggcattcaaaactattttaaatgattgagaagcacattcaaagagacttagtaccaaagctacattttaaatatatacttaatttatagggcagggatttcactaatgatcacccaaaaaccaatatggttagtttatgaatatcgaaaacaaaggagtgtccatgcatgcatagtgtatatcttgcaggaattcagcccttaggattaacagctaagtatactttaagcatattttaataattatagcaagccctagttatttactgcagcctcaattcttattaggagattttgatagttgtttaaattatttggatggtaataacctacactgaagtcagctaacgttggcttctcttccctaaatatggaacttccttcttaaaatccattgatgaacccagctaatattgccatttgctttttatggtttgagaatatgttttagagtataagtaattatgaaggtatcagttaaaaatgatgagtaatgaatatctctagtcatttcgaaaattcttgtgatcttgtcttgtgaattctttagtaactagaaaatcctctgtgattttagcttaaatataaggaggacattttatcttcataatgggtaatgatgtattttattataatgatattttatatagatttatacatcacacctgaaaatatattacttttttggttcttaatgacttttggctctttttcttaattactttactgttaatattaaaatgtttatagcttgtaatttataaaaattcgtagcttttttggggaaattgtcataaaatgccacttaaatttgtgtgtgtgtgtgtgtgtgtgtgtgtgtatgtgtatgtattctggctgtcagaatttcttattttccacgtacgtttgcaaatgaatttctgatttaccattctgtctctgggtctaatttagaaaaagaagtagtaaattctatgtttagtagaaattgaggtaaatgcagagtacaactataggattttttttatatattaattttgaagaggaaagcatctgacttagaatggcgaattaaaaaattattatattctgtacaatgatgaactattctagcttcaagtacttggtaactaaaatgtttgctcagtaaacgtaagaatttttcattgacatattcagcatggatttgaggtttcagaagtgctagtttctaatcctaacatctaatggttcattaccacctcgttttaaaacaatagtgatatctctcaaatgaaagcattattttgtcagactttattcctgcatggtttacatttgttttagaaagtcagtccactttaaaaatgaaagtttggtaccagtgaaagtagctgaaaagaatgtattgctgtttgataagtcaaatagaagaggagtgttagaacagatgaaaaaccttccaggtaaccgcctggtaagagaaagatggaaagatatagcttcttttcggaagagatacttatgaatctaatctgagatgtatgtgggaaaaaaatttttaaaaagctgtattctgtaagcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacggcaaaaaagtggaggttggtgtttttaagaaaactggaacattttattaggttttatctttgaatctctttaaaaactttatgatttgcaacctatgtgaataagcagtgaaattttcaaagactgtaaaaaatgaaagcaaataaagtattaataaagaaatattaaagatgatttttttgtttcttcgagctttgtggtcttactggaaagatttactataacatgatataaggttaaggtttttatttttctgtcatttttttctaagaaattgtttcataatatactatgatgtttgagaacaaaattgagaattttatgctttataaatttgtatcacaagatgttactaaatactgctcaaattaaagcagtatttgagcagtatgctcaaattgaagcatttataactgttacctttcttgaaatttaataagttggatcacagaattatcctttaattctgttaatcatgttttctttttttgtcataaatatatttttaaaagagtttatggcctgccttttgcctattctatgggcagtgaattttcttaataaattttccaatgtaggttgcattttctgtttctgttttctaatcatctttgcattatggcaagataaatgccaagtgctcaaaatgaagattttatgaaaatgttttatagttttccttggactctgaaagttgtcatggcatttctacagccattcacattacagggatactgccgaaccactggatttatcctgtcagctttgatttaggattaggcagtgtagtcatttgtattgacttggtctctgttttctttcactgacataccctgtagtgaaattacatttgtacgagtatttcatgggaaagacagaaagtataatatactcaaaggcagcaacttttggtgtaacgtccagtggttcaaattctgactctcatcagctatgtgaacctgtacaagttatttaacttgggttttcttgcttattataaaattgggaaaatgcctctattttagaactgttgatgcttagaaatgaaatgtttaaacatttattaatcagtgattgttgaacatttgccatgtgctcagactatgcagtgtgctaggtatgggtattatcttaaaggaacttaacaataatggtggtaccttatgacacctaaaggggaatccagagagagctgcataggtggcatactcagctgaaactcaaacagcagagatatctgaatgagcaagaggtgaccagctgagaaaagttcttctgagctccaggagagtgtgcaaaaatattgccactaagaaatggggtgaattgcaaataggtcaatgtgtgccgaaggtgaggggtgacaaaagatagctctggatgaagttggagccagatgactcatgtggaagagttagaatttgatcatgtaggtgagagataatcattgaaaaatttcaaaggtgattatatatttttattctggaagtatttctttaggctggatggggttgactattgaaagcgttgagaatattgaacaagttcctgtgggaccagggaattaacataaacaagtgaagtagacaggatataaagaaatgatacaaaactggaaagtgcatgcttgtctaaagtaggcagaagccaggcacagtggctcgtgcctgtaatcccagcactttgggagactgaggtgggaggatcacttgaggccaggagttaaagatcagcctgggtaacatagataagaccttgtgtctacagaaaatttaaaaaattagccaggcatagtgacatgcacccatggtcccagctacttaggaggctaaggtgggaggatcacttgagcctagtagttcaaggttgcagtgagccatgatagtgccattgcacttcagcctgggccacagagcgaggccctgtctcaaaaaaaccaaaaaaacaaaactaaacaaaatcaagtcggcaggtgctattcagcttcaggtgattattttatcagtattttgatactttttcttcctcttctttttctttttcttttttttactttttaatattttttccttgcaagcaggaagttatgatacattttcaatgcgaatatgttgtcaattgagctgatatttttccccaagaaaagtcggacattggatttgaatgttacatccccatattttgaaatgttggcagctaattcaaacagacactgagggggcaaatgaaatatacctgtgagctgaattcatcctgtggtctgcccatttgtgccctttttcttaaaaaataagattgttggagtaatccaagcaagaaagaatgagagactagaaaaaatattgaatgagagtagataaaaggaatgaattgatgaaatttccgaagtcatattcacagtagaagtgaggcaatttggcagatcgctgatgagggaaagggtgatttatatagtttgttcgtggtaagggacagaagctgatgtttgggaataaagtaaactggactttcttgcaggcatccaggggaggtcatattgcccagctggtccttgtggagtttggaaggtggtgtggaaactggtcatatatagcacagatgcataatctgaagcagcaggtgcttctgggactctggttacttgcttagttgtttggctcatggattccctttgtatctacctgcttctgcctaatagcaactagctgttctttccctcaactctttttattttttcccccttgcagttttgttttaggatatctggggtacttcacccagtcttgtgccaccctgtcagctgcagctctttctctagctctggaattgcttcatgtttcccagttcaaattcttgagaacaagagaaacgtatgggcttcttctttttgtatgaagccacagcctacattggtctgaggatcatggactgattgcccttgagtcaaagaaccatgtctttttcgatcagctgtttttgattgctggtagggtctcaactgtcaggctggctttgcccctttagcagtgcctatcagcagatcatttgagttagaataaactgagcaccagcagaaatggtgatttattaaatatatctaggcctggtgagtgatgaatgtcaggagtcaaggtggatcaagaattcaccaagataagaaatacaagataaatggatttgatggctaatttgtgagcttagtttaatgaagttactgccattaacaatataattaatactagtaatatgccaaaacttagccatgcttatttgtagggcatacttaattacagaattaaaaaaaaaattagggccttaatattccatgatttataacaagcatttaatgtgaggcttgctttgatcattaaataataaacatgtttaatcattaaataataaacatgagtaaagtttgggaaacttttgttatagatacatagaaataactagattttaatgtctctctcattttgtacttttaatttaaatctaaaaacaatgactgcacttgtcagtcctttactggatattaatcactgtagtaggtgctttttattcattgtcctggataatgtttccaacagctctgtgaggtttatgttgttttgttacattttagccaaggaaacttatgcacagttaggtgacttaggcagggttaaatgaataatgaagtgatgagattgattcattcccaggtatgcctgacacagaattcatgatgctttcaatttgcataataatggaaatccatttttatttttagatttgggatatttctagatgtatatactgtggtatttgtggtttaatcatgcataattttagcaacgcatatatatgtaaaaaggaaatgactttaaaggtttataaatgtataagcactgttcacacttgagctaggtctactgcagacagccaattgagaaagtggaagatgttccattcaacatatgcttttgtctttgatgccggacatcttacttaactctctattataattgcgttgactagatattttggcattgcgtagtcacctcagtagaaaagcctttatcagcccacagacggttctttttggtggcaactttcacatatcagcttcttctctcaaatcagcatccattgacagcttctgaatagaaaggattttgttcttgatctatagagatgcaattgaaagattatattgtgatttgaatataacacttcttattttaaatttctcggttcttgatacaagacaatattaaataaattattggatacatgaagacatttttaaaaatccattttttggcatttttggagagaatatcattgccttaatgatattattaatataatcatcttggaatttttatcttatttatacagcaattaatcttctttatccttactactatcaaccaaatctttcctttttgttaaattgatatttttagaatggcccttgaaaatgtatgggaatgtattttatctcaaacgtgaaattaagatttatggttagttgcgattagggaaataggaaaagttaaaaatgactacatttggaccagtggagataagactaggaatcatagaggataagagttaaatattatataatctctaacactctgaggtataagcagttagttctggccactaaaactcagtattattcttttggggataatagcagtgttggtttagattaaggcttcatacataaaatttgaaattctgtaaaaggtacatcaaaataaggaaagccagatccaataacacataggacacagaattaataactgagcctatagtactactattccttgatttgatttattcatgaagtcatttgttatttcattcagcaaatgctatgtttttgcagtttttactaaatgcaacttttttggtagttggtggtgcaaagaactgaaactaaggacaatgaatatcattttaccgttcctgtaaaattcctcttagggcaagaacaaaggtggtataaaaatgtttagaaccaagacttaagagaatgtatttctttcctatttttgctgtcttcctaaacatgacacatccttacctctttagatgttcagcttccaccgactgcacagggtcagtatttgacttggtgttatttcttaaagtatcagaattggggttgagtacttccgtcagggactgtgaaaatttagcacactctaaaaaatgatagcaagtataaaggtcctgaaaaaaaatcatttgcaaaatgtaaacataaaagacaccaaaatgtagacatatttaccattttttcccggatgtaatataaagtgcgccatttgtaacttagagtgcttatttcctattggctgtggtttattttcagtctactatggagtttttatgttatggcatgttaacatgccattttatagtcgtatggcagctattattatttatttttactacatattggacagtgttgactgagtaaatgtaattttgatatatacctctatgaaattaattgtttagaatttatttaagtaattatgtttgaacattcaaattatttgataactagagagattaagaagatgctactattaaagattgaaaataatggacagtttaagatggtaaaggaaaattttgtcactgagtttttaccttttaataatttgagcatcagattattttaaaacatttgccaattcagttctaacatgattttgtatacatgtatttatttgtatgaaaagaaatagtgttgtttaaatcgtgtcaattcagtgctattttctctcttattgtgtagtattctttgagtgttgaatatttgaatattgtagtttgttttgttcttctatattagaaattctcatgtaagtaaaatgaccatagaataaaaccttttttttttttttttttgagacagggtcttgctctgtggcccaggctggtgtgcagtggcatgatttctgcctactgcaacctccaccttctgggctcaagcagtcctcccacctcagcctcctgaatagctgggactacatgtgtgcaccaccacgctcggctaatttttgtatttttttgtagacacagggtcttgccatgtttcccaggctaggctcaaaatcctgagctcaagcaatccacccaccttggcctcccaaagtgctgggattacaggcatgtgtcaccgtgcttggccctgaaataaaatttttaatgttatttaattaataatcatttcatgtcatttagactttaattttttgtgaggctttttaaaataaaagtatttttaaggactttattaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttctaacttcaaaattttccttgcctttagttttctttttattctttattgttttcattttatcttatgaaactactttcagcatgtgataggtgattgttcttaagtatgcagttgtccaattgcataactttggcctattttgataatttttgttacatgtccttattaatttaggatatgtacatatttcactgactttttttttttttttttttgaggtggagttttgctcttgtcgcccaggctggagtgcaatggcacaatctcggctcactgcaacctccacctaccgggtgggttcaagcgattctcctgcctcagcctcccaagtagctgggaatacaggtgccagccaccacgcttggctaatttctgtatttttagtaaagacggggtttcaccacattggccaggctggtttcgaactcctgacctcagatgatccacccaccttggcttcccaaagtgctgggattacaggcatgagccactgcacccagcctcactgatattttaattggatgataaagtagcaaagtatttttatcatagctagttttgcaaaggttttaatgatttcataatattaagttaatttaagaaattcatctagcactttataagagatgtcagaatatcatggcaggttccatatgttccatatgtttgactaaaggtgttaccgtgcagtgttatactaagagaaatttatattttattgattatgtcggtatcaattataaactatcttttaacatttaatgctgttctttatcaataaacacatgggccatgcacagtggctcatgcctgttttcccagcccttcaggaggctgaggcaggtggatcacttgaggtcaagagtttgagaccagcctggccaacatggtgaaaccctgtttttactaaaaatacaaaaactagccagttgtggtggcgcttgcctgttatcccagactcgggaggctgaggcaggagaattgaacctgggaggtggtggctgcagtgaactgagattgcaccaccacactccagccagggcaacagagcaagactccatctcaaaagaagaaaaaaaaaaagaaacacatgaatttgcttggtttagtccttaaacatttttcattatgtgttattttgttgtagaaaaatttataattgttttttgttaattacatccgtcttttttgtcatcgtagaatgcggccgaagatactttataataaaagaaatattacgtttacgctggaattttgttttgcttgctgaagttaaaacaagcaaaatttgtaacttaaggtaatagaaaattaatatggtaaaatgtcagattataatgtggacacttaatatgttagttattaaggaatttaaaaaagagactaagatggatgagacagaaaaaacttcctaaatttcaaaaatagataattttaaagaatagattagacatattgtttttacgttatgggtaaatttcccagaaaaagaaattaaaaaaagcacaactgattcataatgagccaaccccttttagggcatagctcttgctacccttttaatttgtggcctataaattttagcccctatcaactctgacagttactaggtaagtactcttttcatttagccaatagctctgtattgatatctaatattaagataacaaatagatcttgattcaaagctagtcttacatagccttgttatatcttaataagagcaggtaccatgactttgtcactatatatgaatgaatgaatgaatgacagaaaaaatgaatttcccagcagatgactatgttaatagaacatgagtaagccatttttttgttgctggatttgtattttataaactttagggaaagaagaataatatttagtttttttgtagtacttttactcttttaccaagcaagtttacttaccactttcgcctctaccagtgtctcccatgcactgaaacacatctgatacagaggagataataactgttggaggagtgaataagtgaatgattcctaccccattcacactattgtaaacaagaaaagctttttcaaaaccaaaatgtgttttgaaaaaacaaattccccataaaaccaaatacataagcataatactggtttctaagtactaagtcaagaaaaacgaacaaacactgaaggctgagaatctgatttttggcatcatgtttatactttttcaagggaatattctgtatagactttttaaagacaagggtttttaaaaattttatgggggagtctaacagtacagtgaagttagatgatttgtttgtgattaatagccggtgctagctggtgtcagacatgaattagaaacctggttgtttggttcccatgctgctgatctttgcaggattggttgccttctcactttgggccctgtcatatatgaattgagggtgggcaacagacagctcaggttcttcttcattactgtcttgcaagcttttgaggcacccaaaccacagccattgttggaacttggttgcttggttgtggcatttctctgttgcctcctaaatactgcataatattgcccaaggaatgtcaggctttatgatggtcccagaaaggatcctttttcagaaacagaaaaaaactctctaaaattatagttggcaatctctttgctccattatcctacacccctaacttgaggactctttgccctaaatagcagtggctccctcctgtgattattcttaagttgctgagagtgggttgtagtgagctgatgaaaagatggcagatgatgggaaaccttaggatcttgctgctatttaaatttgatttagtataaagtgagatttaagtgttttatggctaattaaggggtgaactcaagaaaccaggtatcatatattgagtgcaagctacagaataaaagagcatgttttctcacaaagatacgtagttgatttgtacatatttagctgcagaaagagattaaagtcaatacatctgacccaaacttactgaattatgtgtcaccagttttacaacaccctagatagactcttgtaattccttagtaccaagagttgaattaatctgaagagcagtagatactttctttttcagcaattttaagtgtttattggaacaacattaaaaataattacaattttctgatattaagtggtaatctattgtggaggaagagctaaaaatcctagaatttaatttttcttcacggacactaaaattatgaaaaccacgttaaaattttagcatttcaggtattttaattttatactttattatggatatatttagcatagatatgggccaacaatcttatggcaacagtcataactgttctagtaagtttcaatatatttcatggcttaattctgtatatccatctattataagagactcagtgtgagcctcagaattgtcaagcaagaagttttttttaaatggggaattaagtgccaagtcatgtgtctgaagtcagcatatatatcagttggcaaatacgtatatatttagtgaggacctatttctgatttagaaaaaaattgattgtaatttctacaacattgaaacagtgtctagaagaatcctttccccacccccaaatagctgttactgacatgtccagaatattgcacctaagaatgaattgacctatgacatattaaggataaattttttaaaaaattaagtgaatattgcattgtttctatttaatttgatagcctcatttgtatctgttatatgaaagttttaatcaccataaatatatttacaatgaagttggaaaatggaatttccccacctccttggatttgatttttctgttttactttatttctaaaagttacgaagctgggcatggtggctcacacctgtaatcccagcactttgggaggctgaggtgggcggataaccggagatcagaagtttgagaaaagcctggccaacatggcgaaaccccatttctactaaaaaacaaacaaaacaaaacaaacaaaaaacaaaaattagctgggtgttgtggtgggtgcctgtaatcccagctacttgggaggctgaggcaggagaatcccttgcgcctgtgatgcagaggttgcagtgagccaagatcgcaccactacactctagcttgggcaatagaacaaggctgtatctcaaaagaaaaaccacccccaaaaaacaaaaaaaaccttacggcttccagtataccactttgtaggtagcagattgtctgtgtattttgatgtctctgccctttttctctatttactatttaaacaaacaggctttactcttacagagacaaagttagcaaaagtaccccattgtttttcaggtttcttctacattcccaaagctgtaaccttattttgtttttctaaaatttaatgtagttctaactgttgacaaagctagttgtgacactggccaacattttctttattgagagttgatgaatgacagccatgtctgaaatctccagtcagactcctcctgatataaagataaatgtgaaatattagaactggaagtattttagcagctttcactacatcgaagctattttttgtcacttttatttggggatatggaatgttcacataaattctattttaaagatgtttaagttttttaaaaatatcctcttcacttaccaccatagatgaggagcctacctattctagaaagaaaaattgtctctaattcttaatttattatgttttctcatgtgagattagtagtttcattactagttttgagccgatggtacatttctcctgagagatacccagggagtgaagtggactttgttagtaacctttgctacttgccctgcagacaaggagaacttagggagacaattcatcaccctaaagggaagcagaggagagggctgacatcacaattgtctatgaaatcttgatcattttaagcagcattgaaaattttgttggaaatggttttattaaaaatgttctgcataattgtgacatttaaagagaaaacagtttgtatcttctaagttaagaaaggtaaaagtgacagcagttttgaagaagaaggaattgagcattttctgtgtgatgaaaactttttgtgccaacagtcataaaatagggatcttattttctccattaaatagattagaaaaagggagctaaaaatgttttggtaacttactgccaagatcacataactgttaagttagagctgagattaaaatcgaaccttcctttctcaagtccatggtttacactgttaagccttgatgctcgtagcagaataggaaagaaataacatttcatgctcttttcttctttctaaaacatgttacattttttcttgcctctggcactcattcctaggcttgtcatatcactgactttttcgcatcctttaggccttggttctaattaatgtcaaccccagagaggcttttcatagccattatatggaaagcacctcccaattacatcatcctatttattttctccttaacagtcttagtacctgtaaatactttatttttatgtctctcccactataaactctatgtataaaggacagggacctgtcattttcctttttgttcaaagttttgtttcatagaatagtacttggcatatattagtatagtaggcagctattggttcaatggatgaatacaactttttatatattctggcatccttttaagtaatagagacaagtactatttcctcaaagaatgtttaaaataaataattaaaaatttaccttcagttttaaatttgaattgttactgtggcaggcaaaagttattttaaagaaataagttatatataaatttctctgaaaattattgaaaattcttattgaaatggtgttttactgagatgacatttgtaattttgtatcttgcaaaatgcaagataatctttcattattcatataggattcatttctgcaagcatagcttaatgattcagttattaacttcattgtatatcttaccccaaagaaactaatctctgatatttgggatgtatggggtttttttggggtgtgtgcataaaatagatactctctggatcttgtccataacatgcataggaatcttaggtgacttttaacaaacattaagcaagggtgagctcaaagcacagaatttaaagtggcaagtaagtgcttcattactggaatataagttatctgtgattacaaataaactgtacagagttataaaaattgcattatgtttctagacacaagaatttgagatctatgttatttaaaatagtggttacttttaaaactgggtagtataaaaaatccttactaatgttcttagtcatcttacttgcttttgggtaataaattacttttatgattagtgtttgattactaaaatcttaatgttttgaaatgtctactttcctaaaactacagccaaaaaagcctgtatataaagtgctttgctatactgttgaacaaggtagcattgttattgaaccccatgggaaaaaaggagtgctgttttgggtgtctataaaaacgaaccaaacttcttccctggagtattctgactgctgttgctatgtgctcatgggcctatgccatgtggctcttttcagatttgtatcagcaagtcagaagttaggaggcagctctactgatccatgagagaaaaaacaatattgaagctgatgaatgagttttatatttctgtacttgaaaatatttagttaaattactgtgcaaaataatgtctgattatctgtaggttaattcttatctacaaacatcagatttttaaaaagaagattgtgaactacttttgtttacatggaattgctaatactaattacctaaatgaaataaatttataaaggaaaaccaaatacttcattgcaaagtcaagaataagtaatattcaaaaaaattttaattcataagatattctgtagttgagtgaataatcaggagttaacttatccatttgtgaagaacttagattttatttcgttttctgttctattttagattattatctctttatatcgtatggtaactctaccttacagtgttagttgttcttaaaaatttggagcttatagactctttggagaatctgacaaaagctgggcaaccctcccagataaatatgtaggccaatatgggcacaaataattatgccattgtaatccacttaataaaaaagctccactttgggcaaggctgtgtgtgtgtggtgtgtgtgtgtgtgtgtgtgtgtgtgtgtgtgtgataaaaattattttccttttacattgaagaggttttattgttaaaatccgtgccactgctatgtgctaggcattgcagtaggcagtgctaatactgttgaaacaaaactactcaaagttcttgcctccatggaacttacacttggttaagatgttgcggagacatgcattgactaaattacaaatagggtatgttctacaaaggtggttgctttgtgtggtggctactttcatttttgtcctcctgtttttccatttattccccatagcttagcaaagtgaactttgtgaaatataaattggatcacttttcctatcaaaaactctcagtggcctcagtaggcacacaactctaagcagtttggccctggatcctctctccagcttgccatggagctacccttcggtaagctctcctgggttcagccatactgatcttattttagttcctttaaacgtttcagtgtctttatacatctatagtttctttgcctaggatcgttgtctcctcctcttcttatgataacttcttttttagaacgacatgtaatttttcctatctcagagaagctacctgcccaattaaaacacccttctcccctacaacattcatacctacaaaactctgttaactttgcttcttctttagcacttattacaaacatgaacctgtttatctattttacatcttttttggggggaaaggtccctgttatttgcactagaatgttggctctatctgggcaggaatactgtttttgttttactcagccactcacaggtaggatactgtccgtatttagtaaccaaagatgcattggaatgtgtaatgtggatattcatactgcatataaagtatatgcaggggatttgaaaggatgttgtgagagcagtagaataaatgatcaatatgtggattatcttgctacagtagagatggtgtaaagaaaatagtttagagatgaaacattgaaatcagtcagacttggagatgggagaagtgatgtcaaggattgcttactcttcggtttctggtttgtgcaacctggatgaatgttggtgttgttgactgagatagaagaggaccaaattattgttaagatatacttataaatcacttgggtccttttcgaggtcttttttttctttccttttcaccttcgaagtttctttttagttattttcaaagactgtcgagaatataaaaatttagacctattacctgatcaaagttctgattttaaaaaacacgcttaaaaaaagagactggaaggcccttgctacgttactttaaactacagtataaagatacacagatcagtttattttcttaatggaggctgtaatcttgctgttcctttcttcaggaaatccacttaatattggccacctgttagtattagatcaccatgtataatgacttccagccattgtaaacataactaagtagacacataaaaacatcatgataggaaagtactaatatatgtgtatagtttgaatactttagtctcttcacagtttataaataattacagtttctcactgttctgaaaatgaaaggtgaatgtcagtcacattgatcatcaaaactgttgattaaatgtatgtaaaaaaaaaatataatttgtgactcagaattgagtaatatacattatatgttcagatgcatactttatttaggtagacgtgttaagttttttttaattaaaattttttagatttaagttgagtcttcaatgcggccaagtgtaattttgaattcctttgtattcacttaagtattcagatctctttatgagaatttgttagctatttgatctacattgtaaaatatgtttaatggctgtgcatcttaaacagtagtgctatatatcatgtcaaaatttaaaaagtaggaaatgcacattttccttacaaaacaacaataacaaaataacacttaaagacttagcttgttactgccaattattcgggttaagtttgtacatattagcgtatgtatctgcagataaaacttacacattttcatgagagtttttacaaaaggagaataaagtgtcattattttattataattttttgataatctaacttttgttgaaatagatgatttgcaaacaaaacaccttttatttactcctaattacataaattgaaatacctgattctctaaattttatttcccacatctacagtcccgacacccagaacgaccagtgatcctcctccgttcatacatttaaatgttctaaaatcaaaactaaatattcctgtttattctttcttggagcattttgatacatgggaaaaaaatatgaaacttaataaggtcacacttgaaattgcaaggatcaattttaaaataaaaccaaggtagatatggaaacttttagtcagtttcacattaaaacttcacattttgagtaatacccatagtgataatctaattctgacatagttgaaaatgatgggcctaggaagttattttcaaaatacaggaatatacactacattctaagttgtcagagcttaaaatgaaattattttttgcagacaaaaagtattatgaaactaccaagcttttgttttttgttggcactaatagtgttgaaataaaatgaattttacctgtattttattcatttatgtgttagcatagttaaaacaaccaaaaacatatttatttttcatggttctctatttttctgttcatgaaaattttagtgtttatagtggttggtattatttgtataaaactactttttgaaaactttgtactctttacctaaagcatttgtagatgttaatctttcctttttttttttgaagattttttttttctttttttattattatactttaagttctagggtacatgtgcacaatgtgcaggtttgttacatatgtatacatgtgccatgttggtgtgctgcacccattacctcgtcatttacattaggtatgtctcctaatgctatccctcccccctccccccacccccaacaggccctgttgtgtgatgttccccatcctgtgtccaagtgttctcactgttcagttcccatctatgagtgagaacatgcggtgtttggttttctgtccttgtgacagtttgctgagaatgatggtttccagcttcgtccatgtccctacaaaggacatgaactcatccttttttatggctgcatagtattccatggtgtatatgtgccacattttcttaatccagtctatcattgatggacatttgggttggctccaagtctttgctgtagtgaatagtgctgcaataaacatatgtatgcatgtgtctttatagcagcatgatttataatcctttgggtgtatacccagtaatgggatagcggggtcaaatggtatttctagttctagatccttgaggaatcgccacactgtcttccacaatggttgaactagtttacagtcccaccagcagtgtaaaagtgatcctatttctccacatcctctccagcacctgttgtttcctgactttataatgatcgccattctaagtggtatgagatgatatctcattgtggttttgatttgcatttctctgatgaccgatgatgatgagcattttttcatgtgtctgttggctgcataaatgtcttcttttgagaagtgtctgttcatatcctttgcccactttttgatggggttgtttgattttttcttgtaaatttaagttctttgtagattctggatattagtcctttgtcagatgggtagattgcaaaaattttctcccattctgtaggttgcctgttcactctgatggtagtttcttttgcagtgcagaagctctttagtttaattagatcccatttgtcaattttggctttttttgctattgcttttggtgttttagacatgaagtccttgcccatgcctatgtcctgaatggtaatgcctaggttttcttctagggtttttatggttttaggtctgacatttaagtctttaatccatcttgaattaatttttgtataaggtgtaaggaaagggatccagtttcagctttctacatatggctagccagttttcccagcaccatttattaaatagggaatcttttctccatttcttgtttttgtcaggtttgtcaaagatcagatggttgtagatgtgtggtattatttctgagggctctgttctgttccattggtctatatctgttttggtaccagtaccatgctgttttggtaactgtagccttgtagtgtggtttgaagtcaggtagcgtgatgcctccagctttgttcttttggcttaggattgaagacactgtttttattgtctagtcaaatggtaaacataagtgactacattattgctggaagatgaaaaataaaactatactttacagttcacatatttcaacaggtgatacctcatttctcattgattttaggtattgtcactagacaaattagtctctctgataaccagagagagattaatcaagtgttggtgcttactggacttttgtgtttcagtttggctgttgtaatactcacatgtcagactaagtagaaggaggcatatgcccttggaaattattttaattattttagatcattttttctaaaaagtcattgccaagagaggacacttagctatacatatctacatggatatttttctggatttttaaggactaatacataaacaatataatcatgattttcctattgtgatggtgttaatgcctgttagtgttcatcagtataaaggaaagctaaaaagtttgttgtgtgcaaaaataagtaaagttaaatatgaatatcagaagcacttacaatttcttactggcttatttttttcagctatatcagcttaaataatgcttaactctctgaagaacatggattaaaatgagcaaatttatagtatgaaatcagtatatagaatgtagtttaaaatgaaaatgaagttaaagctcacatttgtttttaattcaggctcttgacatgtaaaggcattttaagccacctacctatttccaagatggtatagaccacctgctgttaacatgctttaaggaaaatggagagatgtaaaagagttttggtgatttctctgctttgagtataaatgaaactgaaaatcttctgtcctgtactcttaatagtgaactattagagtgtttaaatctttgtgtgaaagtgaagactgtcataaaggattatcattagcctctttttatttttttgctatgtgagtacttgttagcactggataatctgaatatagtttagttacaatacttatttctgtatgtctctaaatttggtattttgtaaatgtgctttgacagtaaagaggtaattctgattgaaatgtaaaaaaaccattttacttgaacattataaatgatagatcagagtgtatgggtaagaattacagaaaatggagtagcctttacaaggtatatagcatcaacccagctaaggtaatcagaacagttttagaattagaattccttccacatgagacaagaactggtaaaatttgctgatcatgttagatagcaggaggctggaaattatttgaaaacttggatagtatattctatgaatattatcataatctttgaatagagaatgaggtcaattaaggtgtaatcacttgattcttagtcccaccctgcatatggaaatatctaattcttaccaacaaacacatccaaagtgccaaagttgctgaaaataatttgatttattttagttaagcattaataaagtattgaaatttactattgactcatattccttctgatggttgaaagatgaaaaatgtacaaaggtctctaattatatatgtaggtaaaaaagatggagtgtgataaatatttgtcagtaagtatttaactccagatttctatgtaatgtttagggagttttatcctaaaaatgtgtaaagagtttcttagatcttttcccactcataaactttcaaaatcacaaaatcatgatttgttttggttgggtagctactccaacattctttcttcacattcttccgtggcattgaaaacttgccatttcagtcttcatggctccctttggaaacaacttaattatgtgaaattgtcatgtagctttaagcccttctgaagatcataggtcaagctgaaaattaaaggggacccttgctttatagtgtcagttgtaccttttggaaccttggcagaatattgattaaacattttaccaataagtttcagattgatttacatattgtgtaaaatttatcaaaagtaacagtcaacatctgatggaattatgaagttgatgggattatgaaggtaactagaggtacctgcctcttttcctcttaatgaaattagtcataaattaaattgttactgaaacttaaaaccaagataaagctgaaagtgtatccttgagtttttctgaaatgtttctccacttgctttcttcctgatctgagttttctttctttctgtctgtcttgtcttgtcttgtttgtcttgtcttgtcttgtcttgtcttgtcctgtcctgtcctgtcctgtcctgtcctgtcctgtcatgtcttgcctcttcgcttctcttctcttctctttttctttttttttctgagatggagtcttgctctgtaccccaggctagagtacagtggcaccatctcagcttactgcaacctctgcctcctgggttcaagtgattctcctgcttcagcctctctagtagctgtgattataggcacacaccactgtgcccggctaatttttgcatttttattagagattggggtctcaccacattggccaggctggtctcaaacttctggtcttaggtgatccacccacctcagcctcccaatgtgctgggattactggtatgagccatcgaacctgaccttcttttttaagttttaatttgcttgtgctgccagaggaaaaatggctggattgcctgtgttttaaactcttaacttctataggctgcacactctttctccccaaaatccctgcagcaagtgaccttgtcaaacaaaagtgtggaataatgggaggcagcccagtgatggtgggtcgtttataagtagctgtttgctactgtcagaacaaaggcaaatcagagttgcattaaagggatatgacagagtgaacaactgctggcccacttccctaataatacttgtcttctagtgttggattgaaaactgagtggctggagtagttattcgtatgggtttgggatgaaaaatatataggaaaataaagatctatttctgtcatttaacaaaatacagaatttaggaagcaaaatttgattaaagcagctttataatgcttttgagtgacagaaacattatgagtatgttatgttctattacattgttaatagcattgttcattgttatataggatttttaactgtgatatatttgaatctgtttaatattgcaccatattgtgaccagattcttgatgtacttgtgtaaatttggaacaacaattaaatcttactctttaaaatactagttaagtgtagcactcttcttacatgtccataatggaaaaacacttgccttttatttgtagcttgatatgtagtctgtccttttgttattgtttttggagggggcttagggtttatgtgtgacttaggtgctgctgtgaaatggagagcatcacctatatctggcatttgcatttttgtaatattgttttcaaaatgttccagagaggtacattttcttccaccccgtctctctaatgcacagttaacagtatgtccttcacttgaactttctcccttgtaaatcaattatgcatttgctatagtagttcagctttttaaagtgcataaggagaatactgtataaaaagtgcttgtaaaacaagtctttttctaagagtctagaccttgagaattatgtttttgtttttcaataaatggttaaggtattgtaaaaagttggacattttaccagagttaccatatttgagctaatttttagaatattttttaaagagttaagttatagtgctttccacgcaagactttatatgaaataaatacattaagaatgtagagtttttgatgccttgtcaaaagtggaattaaggttggttttattatatgctttgaatgtgtttctgaaatattttttgaagcggatacttgtaagttaaataccttttatcatttatttttatcataattttatatatactctgtcagggaataatatttaagaatcccaacatttgtttttatggtatatctttacattgtaatctgtagtattttaatttcctataaacctcttaataatactagacaatatgtgaccttttacactcattcatatgtgctataaaattactttttcctttgattctattaaatcctttcagaccactagagaaatccctgatttgtacttaacagaggttttcatgtattaacaagtagagttacctggctatcaataagtacttgtttaactagagtgactaagttaaagacttgtagaagttaggactttctgaagctaataatccaacaccctaatttgtgactcgagggatcagatgcacagtagttcaagacttgatgtttttgttcagggtaaggtagtaatttagtgacagaatccagataactcaaatcctcagactagagaaaaattattaagatttcttgacatttattgttattccctacctttagcttttacacagctaaatctacttgtggaagttcagcttcaaaaagttttagccatagtttcaaagctgttgactgtggttgaggtttattaacaaccttggttttctaatgtagtggaattcaaagtagatcaaattccttccctgagccaggattctctgagtgctcttcttaaccactcctgcccaaccgctcattctacaatattgagccttaactcctgttcctgtctcctggccatcctttttaatagttttgtattaaattgtccatgatcaacaacattttgttttaatagatattctcacttcaaggtggcataaaatagtatatatttctcaggattgactttcccaattaagagtatttgccttcatctctgtgcattaaaatttattgctgcaattgacatgactaaggtggcataacagtgctgtgagcataatctagagctagtctgaataagtctgaatcatagctcttctgttcatgaccttgggccacttaccctttctgtgctttgttttacatatctttaaaatgaggattaaaatattactattaggattaaagtaattataatattattcataaagtactgagaatcttgcctgatatatatagtaagatgctacatcagtgttaaatcatagaaggagccagtaaattgtttcagtattttaatgtgtgtacttgaggttctggagatattccaagaacaacacacattcctagtttgacctgaatgaaccaggaatatttaaatacatagcatttatttttagagccacattttactgaaactaaacctaggaacaatacgtggctttttttggggaggggggaggttgttgtttgctttaagaaccttgctttgttaaaaaaaaagcctaacttgcctttttgggaaggcaagttagacgtagaccttaaaagaaatctagctactgccatttataggtggttatatggataccttacctttagaagttattgagtgtgacttatctgcttaatagcgattaaatccgtttaaaatgtttaccaggtgttaatcataagtcaaggttgacatagccagttaaatcttatttgaaagaaagaaaaatctctgtaaatcatgtttacagattttttaaaaactggctggcaatgtttattataaaaatccataattttccatttgtttgctatattagaatactatgcagttgtaatgaataaacatttatagtttctgctcctaaaaattggactacagtttcgtgagtttagtctcatctggtaagctttccaagagattcagggaagccatagctttccaagtatgcaaatctcttacattcaaagcacttccctcaggcacaagaagactatttcagtggcatgctttgctcttttcccttaacatatctaacatgaggaacatagataggggacagcctatctatgtttgaatagatgttgaagaaattatatgagaagaattgatagaaagttttatttttaattgtttgctttgtaatatatttatttggtgactgtaaaaagtagatttcagaagatttatttatactatcaatgcatgttttaaaattattcgtttgagttgtaaataattaatgaaaaaggcattttatgtggcactgaatcaacctgttagtttcagttgttcaccctggatttctttcatttaatcgtcttcttcttactgcaaaggaggacatttattcattactttgcccaaataatactaacacactagcagatggtcactttccaactggtttgtcttcagaaaagaaattaaaatattatagtgccagagagagatgttgtaatgtgtccctttcaaattaacaggtcattcttttcaactattttgtaactgtaaaatagctcaatgtcacataaaaggctaaaagctagagtaaatggtgtcatgggaaacatgaaataaacacagtgtaatggtttatagtcttgtcttgaacacactaagaatatttcttttctaaaaagacacaaattatatgctacggtagtattttggttttactggattctagtttaattagttcatatcaaaagttagcacttgttttaaaacgtgtatacattctgaaagaagatacttcccccaaaacatttaaaaataccttgaatatattcttaaacaaatatgttagcctagcaaacaatgaaatgaaaaccaaatatgaaaataatgtatcttcttcctttaccccttcaatgaatgatctgtaactctgataaaaagattagtttagagattattgaattattttaatactaggaccagactgaaagtaacattgtgcatttagaaatgcaacatataaatgagtagaattggagccccacatgattgggaaataagctggagaaactgaagtatgcttaaaacacagagtaattagcgagcaagctcaggaaaaaaaaaatctcagaatacttagaagtagtgtttgaggaactagaatcatcacagtttaaattatttgttttgacctttctctgccactgaattgctgtgtatctttgggcagtcacttagatcatttccttgactagaacagtagcaagttggcttagacaactcttaagccctttttttaaagtgttatagctatttggttggtgatgaattacttaacccagaatttaaaaaaaaaaaaaacaacttaaaatgcatttgcctaagtgagccaggtagatttataatgagaaagaaagaagtttttataatattatttattcttcttctgaaaaaaatcaagtgataatagaaacccaaatacaaaataactgaattcgatttgcattcctcctaattactagcactgtgaacaaaaacaggtcgtttaaatatgttgtatgggcttggtgcagtggctcacacctgtaatcctagcactttgggaggccgaggcgggctgatcacttgaggccaggagtcctgaggccaggagtttgagaccagcctggccaatgtggtgaaaccctgtctctattaaaattacaaaaattagccgggcttgttggcacgcacctgtaatccctgctactcaggtggctgaggcatgagaatcacttgaatcctggaggtggaggttgcagtgagccaagatcttgtcactgtgctccaatctaggcgatagagtgagacattgtatctaaataaataaataaataagttgtattttggatcctcaataaataagttgtattttggatcctcatccgaacaatggaaattataatttttctggttatctcactgtgtctaaagcgatgtcctactgtgttgcctttttcaaagagtgatcatttgactattcctataagagcccttattggaatgctttctagcatattatttgcctcagatactccatctgtgtggggagttctttctcaaatagttggacactttctgtctttttaagggtaaaatatatgagacagccttttctaatttgtacagagatgaaaaattaagtcagccttaagttctttcttaactgagagtttttcttagaaagtaattttaagatattgatgcaggttattttcctccttagcttaacaaggttcaggttcttgtctcagtaccaggaagaagtaggcatgcggacacttgaagagtgagtggtgtagattttattaagcgaaaggaaagctctcagcaaagagaggggtcctgaaaccaggttgccgggttctccctttacagttgaattcgagggcttctatatctgcttgatggggctgggttttctatttgtataaggcatgaatttcttctccctcccaccgccccccgccccattccgtccagtgcacacgcgggcccttagtctgagccattccacattgatttatttcccttactgtgcatgtgttaagggacagaatttttcaccacgggcatgtttaggcaagccccctgtgcacaatgacattggtgggttggatgttgtcctgggacccttccctatctgcctaggcatttggctgtctcctgcctctatcaatatctttttgtccttccctctcaaatccctactttaaccagcgaagtggaatatttgtcttaaacattgtggtgttattactcatcccaccccatttcttcctatatttgtttgaaatgccagtatactcatattgcataatataggataaacaggtttatatgtggaagtgtgaaattatatattgttatgaatggtaggggaattggtagatctgggactcaaaatgattgctagaactttatatatatatatttttggtaaggcattaattcactgagtacttcaaatattttattttatttttgagacggagtcttgctctgtcacccaggctggagtgcagtggcgcgatcttggctcactgcaagctccacctcccgggctcacgccattctcctgcctcagcctcccgagtagctgagactacaggagcccgccgccacgcccggctaattttttgtagtttttagtagaaacggggtttcaccatgttagccaggatggtctcgatctcctgacctcgtgatccaccagcctcggcatcccaaagtgctgggattacaggcgtgagccaccaagcctggtcgtacttcaaatattagtcccatgttcatgtttgaaattgtttaatcaaaagttgttacaaatagtactgaaaaaggaaagaaacctgcccttgtgattgttcttgctcatggttatcctctctgttctgtctgttcatcctgccagggtaagctgagatctcccttcctccataatgtattttacagctccagttctcattagtctttactctgagttcctacaccgcttacagtatgcaccacataattgagtatttacttatatatccttccgtgtatggattggtgatgtttcatctgtttctttgcttcccctgtagacctcagactatacaaggtgaagacaatattttgtttaatctttccctaaatgttcctaagaatgtgttagagcacctaagtggtgctcagtgaatactagattgatttgtttttttccttttctccatttcctttcactgagtgtgaaaattgctagaaatcacacaccatcccccctttttttcctgagtctatctttttaatgggcctctcttctttcctggtatgccaagatagatgtactacaaaagtctgtatatagaatttgtacaatttgtttcttgattttaagtatatgaagaaaaacgtggacatagagaaatgatgattcataatatgttctaattagaaatgtgaaagttggttaaacattaaaaaatcagcttggtgttacagatgtgttttttttccctttcttaattgtttgaagtttgcagaatttactgttttctaccgtaactaagagatatgctttctggcagacctattgaagaatttggtttatgccaaatatactactaataatttaaatgtcccacatagttaggatcttttggtattcatcagagtaaaaattaattttatcttaaaaactagagtaaaaaacctttttttaaacagtaaaaaatctgctttctgcaaactgtgtccagataaccagagctgtttagctggataatgaaacagtaaatgtgaaagcaatttgaagaacatacacattaacattatggttagaagagtgagggatggaatgccttttgtatccatgacatatttcaaacagaaaaatatgcaatctgttttcatagttcataagatgctccacaatcccctctcaaccagttctggtagataattaagacctaacacatttattgtatgtaatgaataatttctctaatgcatctagaattcaacagaattgggaaatagccctcaaataattttatgtggggctttattttcttgtggaaccctagttgagaaaggctatgcaatctcttttaacctctatttgaacagaatcttattttgtcacgtatatgtttgaagaccttaacccttctagattatttttacttgacccaattacttagtggttaagaatgtattgcctatacaatacagtccaaatctggttggccctatttgttttctaaagttttaaatgtagctatgttttattgacagcatttttgctacttaattatgtcttttcttgacagctcaaactatctctgtttactcttatttagaatgcagctggcaacagcagttggtttgtgaaacccaggcatataattaacttccccagttaaggtatggtttgtttcattggaagagaaagaattttgggggtatgtttctttagtctgagaagtaatgcagtttattttcagtatggtatattttatgtgacagaacataagcagagaattttttaaaaaattataacattctaacattacttgagcactaaagtgctacaaaaaatactttgttattatttgaaccacgaaaatcagatattagcattcagcgtaaatgtcaaattaacacaggccagtaggaacatttgtgatcatgttcttctcacatctacttgcatggataatgaagctttgactattgctttgatgtagatttttggaggaaatcctcctcctatttccaagacactttgtagttactaattctaagagagtataagcgaatccatttatttaaaataaaataaaaatggggggaaagatatttaagcaataaatttcataccatgagattttttatatcctggttactttaaaacccagtaagctgccctgggttctctcctgatactgcacagaacttttgttttacatcctcgtcttcctattattagttcaactatattgtttttctctttccagcactctatctggatttttgtaattattactgtcttcctattactagttcaactatattgtttttctctttctagcactctatctggatttttgtaattattactgtcttcctttatcagttttaaaagttaagatatgtggtatttttgagatcagaattgtagccattatattgatgtgctgcagatattaagagaaaaagtccttagttgccagctttttgtatactcaagtgttatggattcttaagaataaatgtttctttgttttcatatgaaattgtcttttttttttttttaggatacatgtcttactttgtcacccagtctagagtgcagtggtttggttcccttcagccttgatctcctgggctcaagtgatcctcccccctcagcccccagaatagccgggactttaggcatgtgcgacaactcccaactaacttttgtactttttgtagagacggggttttgccacattacccaggctggtcttgaactcctgagctcaagctttgtaatcccaaagtactggaattacaggcacgagccaccgcgcccatcccaaactgccttcctttttgcccagcccatgagaacaacctgtgctagtgaatgatttttaaagaatcttgctacttttttctgcctgggattatgtgttgactgaatatagtttcctaagagatactgttgatttttttaaactaaacgtctaccagactttctgctctgttgttccaaaattggacaatttcctgcctggtattttatttttaagttgaaaatgggaaaattgctaatgatgttgaaagcaaaaatggtattgaatgctttctgactaaacatatattgaacaaagcaaaacactatgtatctgctctttcatataacattcggaaactcttgtgacataatcagggctattttctgtataagatggggaggtaggcttataaatatgctacgtaagtgaccagctctagaggaacctgatacgaatgtgaccccatactgagtttaagtaaataaaacagaaataatgaatatatagaatcatgacccttcctgctgatgaagaaaatcattttgatttttgatatagagtgatagaatgaaaactatattggtaatattgcttatattatatagtagttgaagtgagtagagataaattcataattgagtgatctgtaaaagagtgttccagaataacatatggcaaaatgaactgaaggaggacttttgaaaacaaatagaattatgttggaaaacaagtgtctttaatggattagttaaggaagtaaaaataattaatataaagcaagggaaacagtgtatggagttagagacataaaattgccaatttatttattgattttgttttataatagttattatttgaaaaacgaccaatacgaataaatagaagtaaggaggggaaagtgaaggaaaactgtttttagctggtatcatctatttggcaatgtctttactgttatgcttataatacttgatttataaatgttaactgtaacatattcatgtaaatatttgtgtttattttatatatgactcttttaacctgatgtttcatctctattttcagaggaatttaaaaaaaatgtttaactttagacattagcgattactggttcagaaacaagtcttctaatgataaattaattcattagtaaaaacttcccataaacacagctgctaaggcctgccaaattggcaccttggttccacgtcttatccagggcttgacaagaatatactactgcttacttagttaattactgctcacagatagaaaaggaaaggcctttaattcagcatttgtatcgtcgcatggccctgttcagtcaagctgagtgcatgttacatgattgcctgagaggaacagaaaagctagtttctcagtctctaaccagaatgcatgataaggcttggtgtcaaaaagggcaagatggggatcacagcaattatggcagaggcaaagtagttactttgacaaccagattgaggattcattgcgatttattatttactacttgaaaatctcactctgatttaattaagggttgagatttccatgaagtctgtcttttctaaatttgagcaccctgttactgttgtttatgtgtgcactgaaataatctcaaactgatgttactccaaaactgtgacgaattaggcttaacatgtagttttttgaaaatttagacaggtcagataacagttaactgaaattaactggatcttatattgggcgatggtaatcaatgcttactagtaacttagtaacattgactccctgggtatcttcaaagcagcctggttgtaataagtgaattttatcttttttgttgaaagcagctttaaataatttatacctgatttgtatttcagtgtatcattttagatatacacgttatttctttgcagttacttaatggtacacttttttgggtggggagacaaagtcttgcttttgtcaccaggctggagtgcagtggtgcgatctcagctcactgcaatctctgcctcccaggttcaagcgattcccctgcctcagcctcccaagtacctgggactacaggcatgcaccaccacacccggctaattttttgtgttttagtagagacagggtttcaccatgttggccaggaaagtttcgatctcctgacctcgtgatctgcccgtctcggcttcccaaagtgctgggattacaggcatgagccaccatgcccagctggtacaccttttatattgcccaaattatagtctataaaatgtgattgtaatcagataattcttggccagaaaacgaaagttcaccttcttagagtgagttaaccattaggtaattttgtattttatgtttttttcttcccaagtattcctgaaatgctttttacctttgcagatgtaactcagttgactacttattcagcattaattaataataaaatatgataggcttttcaacctatgatttttatttaaacaaaacctttcaaataaaaataattttaaacctgtatttgatttctatttaaaatggagtgttttcatatactcttttaaattaaaatagtgtctgcttagctcgtttacattctttctgtcagaatgtctgcctcaggattctatatataattaatgtaagaaaaacaagagggtaatcccttggtagaaaactggtaatggattaaaagaccatagctctgaaattccagtaatgtgacacattttctctgaaagatgcacttaggcccgatatctagagatattaaaaagtgccccctattttaattagctaaagatagacattcctaatatattttgttgtatgtttaatatggaatattataagtaaattcatacactgatactaaatacgatttgagaagaattactgctttggtgagaagagagctttgagtgtcacttgaagcttcaaatttcttactgaaccaattgataaaatgtacaaaatgtgtattgagaatgtgcagaacagccacccaggtagtttgatcagtgtctttctacatagtgcctaacatgaactagtttaagaaacttgaggaatccacataactatccttggttccaattttttaattaaaaagtttagactagagcagtgcttttcaaattgtgatttccaacccattatcagtttgtaagcacagtatttagtgggttacaatcatcacttatgaaagagagcaaatatcagagcacagtttatataatgagtattatttcatgaaatttgcattaattatatgttcatatcttaagggtacattgttttgatataacatgtcatacttaaggaatgcagtaaaaatatataaaaggaaacaccgggctgcatgatcctaaaaatctctcccagttccaacattcccgagtgaaattttaaacatgtagctcttccttaagtagcattatatcattatgttatttcaatagaatttgtcacatgcagatgcattttgggagaaaaagaggagaaaggtgcaagacttgatattctgagagactaatacctatataaattgtaattattcctaattgctatgtgtgataatttaggcctgcacaaaattgctgagagcatatcaaacaaatgattagttctcattgtcaggcccagaaaatacctcgtgactaatattagagtacatcctttaaagatgagtatgatttcattcatttgggatagagaattcagggaaagagtctggatactttggctgtggctagacagtcaagcggccttctatgccatacttaggcatttggaatttatcttaaaagaccagggaaagctgtcaaacccattcagcctgctaggattagctctccttttagaacgatgaaagtagtaatgtgattgttgaactcaagtagagaaaaattcaaggtatggagacaataagttacaagaatttcagaaggtcagctataaacgtagaaactcctcttttgataaagagtgaaatacaactctttatcaaaagcttgacagtgctcatacaacatacgaattgagtttcactttagtattttggaaatactggaacagctttcagtacctttgcaaaatgcccaagtaaatgtatgtgaaatgttgaaagacttaaatgagtccggcatataggaaaaccttgttttattgagctttgtagatattgcattgtttttttattttatttatttatttttttgagatggagtcttgctctgtaacccaggctggagcgcagtggtgcaatctcgctcactgcaagctctgcctcctgggttcacgccattctcccgcctcagcctcccgagtagctaggactacaggcgcccgccaccgcgcccggctaattttgtttttgtatttttagtagagacggggtttcaccttggcaccttagtagacccaggatgttctcgatctcctgacctcgtgatctgccccccttggcctcccaaagtgctgggattacaagtgtgaaccactgcgcccggcctgctttttttataaattgaaggtttatggaaaccttgtttcccacaagtcttatcagcaccatttttccagcagtatgtgctcacttcatgtgtctgtgtcacattttgttaattcccacaatatttcaagtttttctattatatctgttatggtgatctgtaatcagtgatctttgatattattataactatttgatgtgtattattgtaattggagtgccatgaatcatgcccattccagacgatgaacttaaggaatattaggttttctgactgctccaccaactggcccttccctgtctctccccctctcatcaggcctccctattccctgagacacaaaaattttgaaattaaccaattaataatcctacaacggcctatatatgttcaagtgaaatgaaaagttgcacatttcttcatattaaatcaaaagatagaaatgattaagcttagtgaggaaggcatatcaaaagcttagacagaacgaaatctcggcctcttgtgccagttagccaagtcgtgaatgcaaggaaaaagttcttgaagtaaattaaaagtgctacttcagtgaacacatagatgataagaaagtgaaacagcttttgttgcttatatggagaaagttttagtggtctggagagaagatcaaaccagtctcaagattctcttaagccaaagcataatccagagcaaggccccaactgtcttcaattctatgaacgctgagaggtgaggaagatgtggaggaaagtttacagttaccagaggttagctcatggggctgaaggaaagaagccattgttcccataacatagaagtgggaggtaaagcagcaagtgttgatatagaagctgcagcaagttatgcagaagatctagctaagatcattgatggaggtggctacactaaacaacagattttaaatatagacaaaacagccttctgttggaagaagatgccctctagactcttcatagctgaagagaagtcagtgtctggcttcagagtttcaaaggacagactgtcttgttaggggctaatgcagctggtgactttaagttgaagctaatattcatttaccatttcaaaaatccttgggccattaggaattatgttaagtctgaggaatacagatgtacccacccttctctttgcctttttatcaagactcagtgtacaaggattgtatgtgtgggtcacctcggtctcctctgctttaatgctcctcatctctggcaataaattacttctctttgaaaaacttaacatttattaatgtgaattttgggatcttatgcacataatttatacgagcactaacttgtcatcctgtctctgaattgaatcttttgatagtttcctgatatagtttatgctgtgtcttctgttagaggaggctttaaaaggagggagctcttgatccctataggagaagcagagcagatagaagggcattccaagtggggagaatactgtgaagaacgctacaaagacaggaattcacataccagattttatatagtgaatatttaagactcaattccatagtgtaaacagattaactttgttatttaaataaattatatggaaaaaattaattttggaattttctactatagcagcttggtgccacaggtaccatttgtttcttttatagaaaatttatttttggaaaaacagttcatccatctacctttcagcatgtcaaggttaactcaacagccaagtgccagccgtgggagatactgggaagaaacttggactaagttgggggtcggggagaatttggaacaaacagcaagaaggtaattaagagttgggagaggtggggattaggaaaaatgtatgcaatatataggaatattttgcttgagcaaaatatctcttattgaatcaatgtgttggggcacacatcacgcaggggaaatgtatcttagctgtgataagggaactgtggtgtagggtgcagagatacacggcagtctttgaaaaaactggcccatctccatgttcacctaggtctacagtctggtagctctgaaccagtaagattatagaaatcttgatatcttctctttggttctcagggtgagaaattgtatatttttagattgttcccacaaaggggacagaatttctgttattctcctgggccgagtgcctttttgttcatctactcaccttaacccaagtcccgtttcttggtacctcagggttggcagccatcttcattagctctcttattactgaacctagttggtttagatgaactggtcactgttagtccaaaaagggtttccagttcttgtttttgttttttatttccccccatgcatgtatatagaagtataattttagtcttttacatacttttctgggaacccattcccaaatcactaaatattattatagtattatttctaatatttatttttactgtatttatattatttaacgttatattgttttttattctattacattgttttatgatgttttgcatcatattccattttgtcaatatagttttaaaatacttctttactttggaccttcagtttgtctcaacatttttattcataaattttatctaaatcttagtcaagttttttggttattgttagagtatgttgttcttgcaaatgggatttggtaaagctcttctcagaaagactgtaccgcctcataatttcagaaatatatgatgctgtctgttttaaaacagccatacaaacaaatccttggtaatttgataggagaaaatgtcaccatattttaaatttttgatgcctttttgtccttgccaattaaattgagcattacatgtttatttcctacttaaatttatttcattttccctttccatttcttacctactttgaaattgatactctttatttgtaagcacttttatgtagagtatttaaccttgagttactcgtttagacagctgatctttttttgctccactacacggcttttcaatatagaatgcttcagtttgaggtagatcgatttatctgtcttttggtggtttttatttcatgaatccgaatttattgctattttgagatcagatttacccatattttcttgttagtattattgttattctaacactgaaattattaacgcatttatgtttggaggtcttttgtaactagaacttagtcctttgcagaacataataagtgtggctaataagtgtgtgtgtgtgtgtgtgtgtgtatgtgtgtgtggttttatttcagagttgctttattttaatttatgatgaatttcagtttctattagagtagtgcttttaggttgagatacatttttttatccatcaatctttgtaccaacactgtgaattaatttaatatcatgactgcttttcaaatgaagagattggggactgatatttgaagtgatttatccaatgtcacagagctctttaagggatagaacaaggattccaagccaagtcagttaactccttgtccggaattacttttcactgtaaaatagttacccattttagaattaaacacttcagatttaagtagtttgatctcaataatatctgtacagattaaattaatatcttagggggaagtaatacttaagaggagcatttaaaaaatgtagttattgacctaattatttccccacccaccacactccctgtaggattttcataagcagagaattatattctaagattgtgttcttatttcattagcactgtgataagccataagaattgtgttttactatctttaatctgttctactccatatcaaaacattcattgacaagaggagattgtagtctattcactgattttgtccaaaccagttggaatagtggtcagcaactgtcttccataaatggctagatggtaaattttttagactttgtaggccaaatttaagggtgttgtatagatatttatataatgagagaaatgaatatccaacacatttattgacaattttcagatcttattacttgacactgacaatttcatacatttttatgtgtcatgaaatattgttcttttgattttgtttgaacattaaaaaatgtaaatggaccatgggaacactagtagtccaacccttatttagaagggactgttgtgggtatctggtagatcagatttgaattccatttgtaaaacatttgagtatttactttataataatattaaatataaattaacatcacagttttctgaggaaactgaagttcatttgtaaagaaacttcttcaagttttgccaagtcagtaaatggcagaactagaattcaaaaccttatctatttttcagtgcctgggttctttcatgtgttcattgttacatcttctgtgccaggcatggagataggcacagtgcatactggcatgaattagatgagttcctgcttctacatagtccttagtcatgatgctgcacagatttgggaaatgtaattttctaaaacctgcctgtcattataaatcagattcatctacacttactctcattttctgataaaaagtatttgcttgtttttgtgacttatcaatcctgtcttgtatttttctttttttcttgaatagtacaggaacttttttatctggtaacattcagcttcttaaggatgaaattaaaactatttgaggttgtaaggggaataaacatttaaagtaccaaggaaggggctattagagtagtgcaccagggcatggcaacaatggctctcaagcaggattcctatgagccttttttcctgcaactccttgtaatttgtcagaatctgtgtatccagaagttggaactgctctgtttcctctgcattgttggtacctgtagggaacaagtatgaaagactacaatgggctgtagtgtgtaggggcagagcttataccattggttctgctaccgtgctgttccttagttcccttgatgttcagcttgcagttaaatacaagaaaggatataattttaactctgcagaaaagtagtattacttcttttttaaggtaacattttgtaactttacaatgttaaaataaactccctgctttcccctttccccaaatgttgtgttgacaagattggaaaatagtttgtgttctttaataaaaaccttatcatttcattaaaaattgaacaaacctcaatagcaaacacaaaaatggtaacactgaaaccaaccacgaaatcaaagtcattacattgtcatttaaggaatgactttataaccttcatacgaattttgggaattggtttctgtccaactcatagtatcacagttaatagactacttctgtaagtcagctctttgcttcaggaagagcttttacaactggatggactttctgtagtttctggaagtggtagagttgtctccaacttgtattgttagtttcttttggttattccagcattgtctaaaggaggaattcaaatgtgttaaggacacagatacataatgaatgaagcaataaattagtgctattttctgtttggtggtgttttttttaaattattttcagtttgcatctattgtgttttgaggtagagttcacagagtgggttccttgctgcattttgttttatttattcttctattttgcaatttttaattggtccaagagcattcattgagaaaagtaatagcacaatagtcacagcattcactagagtatttttgtttcttttgtgtgtatcatattacccacttgattagttgttcccacaagctctgtatatcttttggaaatctatctttatatctgtgagataaaaataatcttcagttattaaaaaagagtcatctgtgttagtagtgacaatgtatattttagaaatttcatgtatgtagcatcattgagaatcaaatatgaaacattgtttaaaggaaaaagagtagaaattaaaaaaaaactttgattgtataagttattttttgagatgagaaattatttcaatatgttttttttttctctagaaacctgttggaaaatgccttgttactccagcagaaaagcatgtctattattaccaatagaattagtgtgttcagaaaaagaaaaggcttaatttacagccttttgaagttttagggaaaattccttttttaaagcatgcaggaggaaagacatgacatcacagccttaagtgggtaaaaggttacatggctgatactttttaagtgattgaattattagcatgggtaataatttgtggaaggtgaagaggtgccactagtttcagtgtgttaatcttccccacttaaagtgagaaataaatacctcataagaatatatatggggatatagtgtctttcctttctaagacacttgcttgagtcagcagtggttgcgtgtggtcacctttggattagtcttcggattcagagaaatgagtgggtggtttcagtgcagtttcaatgttgttaacccaaataagttctagagttggtattaattggcccccttatagaaacctttgaggaggaagctgttgttacacaggtaactttatacctttagagtttattgttgcctagtaaaaattaatatggaaatataataaaaattggtagggaactctttcattcatctacattgtggtcactcatgtgattcaatttaaatgtatcttttttttttttttttttttttgagatggagtttcactcttgttgcccaggctggagtgcagtggtgcagtctcggctcactacaacctccgccacctgggttcaagcgtttctcctgcctcagcctcctgagtaactgggattataggtgcccacagctagctaatttttttgtatttttagtagagacggggtttcaccatgttggccaggctggtctcaaactcctgacctcaggtgatccacctgcctcggcctcccaaagtgctgggattacaggcgtgagccaccgccccagacctgaaagtacctttttaaaaaggaaattttggttaagagttttttttgtgttagtgctttaaaaaaattgcttatatttaaatacaacaacgtattaactaaaaagacttaaaatccaaatttttactctgtttgatctgggaaacctgcctgggaaatacttaaaatgaagtctccaccctaatgagttttagcatcagtgacaaaaaaggagtggaaacctttacctagcaatgttggagtgactcactggatatgggaacaaatagctcatttctgcatttttgcttcttatttaattatttttaagaataaatacatactcaggctggatggaggtgggagtgaattaatgaaatttctaataacaaaaggatagtaaaaattataagagattacattaaataacatagagttggaaataaattatacctgcggagatgatgaaattgtcgtttacttattctgtaattgtttgctagtttctttgttgacagtgaatacattatacagagttacttaagaattttaatttgctaggacaatgcgaatgacttcagatattaaatttttgttagaaacttattgatgttaaactggttttaactagttataaaaaaaaataataattgtaaagagtatttcctgtttccctgtgagggtgggagggggacggagactctggaatgattttgaactctagcaggtcgtcagtcatttaagagcatattttcatagttgagtcccactgattaggggactctgatgaaaatgtcatctttgtcctgtttgtattctttatctcttgatatctggatttttgaaaaaacattttctgatgatgttcatgtcttaaatttataaactcaaaactttaatatatatataaaagttaaaactgtggtctttttgtttcttttcctcttaaaacaacttttatgttcttgagtatgtttaacatcttctggtacataagaattatagtaataaataaagcataaagtaaaataaagtaaaaataaaatgcctactgtgtccctgaataactaatattcagtttttgttgaaaagctcagagtccagtaaggaggtaatataagtacaaagacccttagaatgtgttacctgctctgatagaggagctcataattgttcattcattcatatatccatttatttaacatctttattttgtcactccataaagaacaccgtaaattggtcctttcctacgttttggcattatagtagtgaaccagataaatgacacttgtcctgaaggaggtctcatcccccatgtttgttactcaggaacagggattattgtatttttgttcctagtatcccaagtgtctagaagagtgctaggcacatagtagttactcagtagatgttaattggaggaaacaaaacaaatgacccaaacctaagctcaggttctcctttccctgttttcaagacctggtgtcttgaactgggttttgaagagtaattgttgcctaacagaaaaatgagtggaacatcctgtgcggaggagatagtttaaacagaggcactgaataattgggtaatattgaagctcagtgtgaaagtcactttttttttttaagtaaatcggaattaaagtattctgcctttgtgaacttagaagttgtaactatatactgagactaatagcatctctttgtggcatatattatttttaatagatgtgcttatcaggaatttttttaagttaagtattaaacataatattttataactgaaatatgttttcatggtacttgtgaattattaattagtggtagataatttagaagtttttaggtaggagaaattaatttctttctagtaaggaatttaaccccacagtgtttttgactcataatgtgtactttctttttaaaatgtcaaaaggcttttcagaagtagtagtatttgaaactatcagctaatggttttctaaaagtatatttttaccttagagcatctagagtgtccagaattttgtgactcttagcaagtccccaagttgaaaatttttaccttgtagcttgcataattggatttaaatatgtattttcattatgcatgtatttgttagaaaatattggtgtatttcttagtgtaacactattttgtatttaagttgattttacttaagatttcaaataaactgttaacattcttcttagaaaaaatttttttgaagtacttcattatttaaaatatttccaaaataatcaacagcttatttagctgggcatggtggcatgagcctgcagtcctaactactctggggtgaggaagaggctgatttcgagcccatatgcttgagcctagaagcttggggctgcagtgaactatgattgtaccactgcactccagctggacaacagagtgagactctctccctaaagcagacaaacaaaaaaacagcttctaaaccaaaatgacacataaaactaaggcatatcacttatttggactgagttgatgattgtgtagttatatgatcttaaattgttggaacactttcttttgcaacagtttcatatttctgtaagcatttgttgggtatttcatgctcaccccacttatatacaaattacaacattttctaggccagtgtgcttattctggaaaatgacattgcattcttttattttctgaattatttgcataagaacaatttcaaaggtgacagtagtaggtcttttttactttccacgtgtcgtagtttaggtttgtaacataatacagacaggtgaaaggaattacgtataagtaagcacaaaaaagtagatgttttagggtttgattgataaaggcatttctaaagtggatctaattaagtaattaaaacaaaaggatcttctacaaatttacacgaaataggtttttaacattctgccttgtggtataaaaaagccttattacgcatccttgattttaaaaattgtgcttagttggctccatgaatatgcagagatgagtgaaaaagttggactatcagtgacaacttatcttttaggtttacttttaacactattttcatctaagttaagatgaaattgaaataagctttctggatgcttctaaatttcacttcagcctggttgaaatcatgtcccctcctccttaagtatttttctcatttccattttaggaagaaattttgctaacatatataaacaggagtaataaagagatttcatatgccagcactggtaatagactatggcttgagttaatgtttcagcacggcgtagagtcacagcctcactctcatagaggtccctgataatcaaaaagcatggtgcttcctgggaccctcaaacagcatgagcagtagcaaacatgacagtatttagttcaaagtaattaagaaaaacagtacaagaaaagttgaattctttatagtacagcgtagtaagaacacttttatgggaatgtgtgattttacagaaatgttttaaggaacagagttaatggagactttgttagaaaagcaaatgttcctcaacaagcacttaaagtttatcacaacaaaatgtactgtttgttgtcagagcagcatattttcttgcagaaatgcttataagtgatgccaaatttaatgatagaatttcaattctggtcttacaaattcccatccggtagcagtgcatctgtttattaggaattacccctgaatgtgaatgatttcagtcttaagttgctgcacctgttgccgggaggtatttattccgatcagtagcctaaagcagagagagttatatcttgacattttatagcttggggggaaaaactgtcttttcaaaatcatttgttcagagaggagaaaatggagcaaaacagttcattttactctaagcaccgctatttggtggtattcacatttgcacagcacaaagctgcaatattgattttttgctcacagagcctcccaccagttctctcttcaattgtcagggttgcaagatggattagattacattttgctggttgggatgcttatttttttgttgttgttgaaatagaaatagactgaaaatacggcttggaatgaatatcacagtaatagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcctatggtttttgtgcaaagtctctgcccagtcattggctgaccactaagccatgcagacagaggtgatatctaggagccgaggctaaaaaataaaaataagaattcaagcgaattaaaataaaacagtgagcaaaggtataagcagccacacactgtgagggcagagattctgcatattaaatacagctgaggtattaaaaagaaaccacgacagcagcagcaattctcaggggaaagaaatctgaaaccggagttgctaatggtgtattatttaaaatgtatagttttcaacaacaaaacatttataagatacataaagaaacagaaaagttgatccataaaatagaaattgcctcagatgtggacccagtgttagatttagcatataaggattttaaaccagctattacaaatacgttcaaaaatcaaagtaaaactatcttggagaattaagaggaaatatgatgacaatgacaacaaatacgtagtcagagaaaaaaaaactatttttcaaaggccttagagacattctttgcacatcttagttattataccagtgtgctataagtaaattaatattttgttgtacaaattacagatagtgtagcttcatctgacccagagattgtgattcagtaggtctgggatagagcttcaagatttgtctttataaaaagtttactaggtgattctgatgtaaccatatttgggaatcaattatgtagacttggcaaaggattaaaacatatatatatatatttttttttttgatgatttcttcccgtgagtcagtattctagatcattaatgtgatacaaataaaggaataaataaatgttttcaggaatgggtttttatgtcttttataagatttatttagtgaaaatgttgggttttaaaagttgatactaattgcaataattttattaaaggcttttcaaagttcctttaaagtagcattgttggtggaagaggttgagctatatcccttgaagttttcaggaaaatagtgtaaaatggtcaaagaaggcacaacaatttatatttttcttaaaaatgtgtgtaaactttttattttccatcagttgttttgccaagattaaggacatgcccgtgccacagcctcaggagctcctgacaacatgtgcccaaggcggttgggctacagcttggttttatacattttagggagacataagtcagaaatcagtacatgagtgatgttcattggttcagtttggaaaggtaagacaacccaaagggtagagttaggattccaggtaataggtagattcaaagatttcccgattggcaactggttgaaggggtttgtctattaataaagacccgaatcaatagaagaaagtgtctgggttaagataggggttgtgaggaccagggttcttattatgcagatgaagcctctaggtagcaggtattaagagagaatagattggaaatatttcttaccatatttaaagaggcagttctggccaaacgtggtggctcacacctgtaatcccagcattttaggaggccaaagtgggcagatcacctgaggtcaggagtttgagaccagcctggccaacatggcgaaacctcatctctactaaaaatacaaaaattagccggtcatggtggtgcgcacctgtggtcccatctactggggaggctgaagtggaagaatcacttgaacctggtgggtggaggttgcagtgagccaaaattgcaccactgcactcctgcactccagcctgggtgacagagcaagactccatctcagaaaacaaagggtggggggcagttctgtcagtcttaaggtctctgttttaatgttaaggatagtcagactgtgtcagaattccaatgaaaggaaagtacaatgaggcatgtctgaccacccattcccatcatggccacaactagagaacttttccataattgattcatgtttattttctcttttccactaagtcattgattaaaatagttaacctaggaagatgttttcctgtgatttgtgtgaactctgcttagtttgtcacatggacttttgaaaattattttgacagtacctcacaatctatatggatgtgcacagcacatccatgttaacaatgttgttatatttatattttaagaaaacagagcaagttgtttattaattatcgatcacttgaaatgttggaatagcatgtgtacttgattaaaaggagcttgcctgtttagacttacagattgaggaaattttataagactttgaaatggctttaattcttcagaaaaggttttaattaaaacccagagaagtaaaatgactttgcccaaagtcacaagactgacccatatactcatacttcagtgttcagtgctctttccatgtgtacctacagtatagcatttgctgtctttatatttatggtacacatgtttacatttctacaaatatgattttcactactattcatgtagttttgtgaacctttacaataattatttcttgtcagttttactaatatattctttggtgattttcagattgtatgaagacttataaaataaatcttgttattttatcagcaaaatggcttgagtagtcagagttgatcagagaagggttctggagtctaagctccctgcatgggttagaatctaacgtgtggtaagattgagaccctaaatttactactatttgatgccttagtttcatactctgtaaaattggtactataacagcaactattccattgtttattttttatgttgttgaacataaaacaaagtgatccatataaagcatttaagccagtgccagcacatagtaattgctttgcaagtaatacttatttctctcttcatatttgttttttaaagaatatatatatattcattatatatatatatacattatatatacacattatatatatacacattatatatacacattatatatatacacattatatatatatacacattttatatacacacacacacacacacacacacacacacacacatatttggttggaaatacagactttagataagagaaatgtataaatatgtaacccatctgtcttatgacaattccagtgatacatatataataataaattgacaatttaaatatttttttggtgggggagatggcatataattttcattgataagtagtttgccttgtttttaatgttcaccatttgttttcactaccaaaggaaatagacattacaaaggaaagcacattgcaatttatgttgtgttaatcactagtttaattcaacaatttggttccacatttataagaattatgtatcatgtgctattgtaggcattgagattataactaagagccttactacagtctagcagggtagatatatatatatactaaaagtgaatatgcactgtatcacatgttaataagcacattagtaaagattaatatatctgcatatataaagtttaatcaaaacaggtaagagaaagaatttagaaaagaacattaatgatttaaatcaaaatacattgtaggattaaataaagtggtatttgctattaagaactcttagtgcaatttctgttgctataggaaaatactcagactgggtaatttataaagaaaagagttttatttagcttatggttctggggttctggggtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactctaatcctgcaaactaacaacaacaacagttaaagggcttgggttttaaaaaccacagtgcttcataatcagttctatgttttgacaaaatagtaagaattgcgagtgtggctccaagccagtcttttaataatgtgttccaatattcctagcattttctaataatagatttattctgttttattatagaattgtaattgcaaattgcctctgtatttaaaataggttgcatttcaaaattttatttgatgtcgtttgtttgaattttcacatagcttttgccacagaaatgtgtcagcttctgaagccataaaaatattttctattaaaataaatatggtactactagtttaagctgaattatttgtatagatatttcagtacaaggtcaggagatggagaaaaaagcagagtgtgtgtgtgtgtgtgtgtgtgtgtgtgtgtgtgtgtgtacatataaaagtttatgaacttgttggggaagaaatatattttggaagtttggcctgtgtaccatttgtcctgacatttacccagctctgtttctgtatcccttctgcattagtagtgcacctctccacatgctacagtactctccatatactataaaccttgttagtgaaaacctaccaagtttggggtttgccacaatctcctgaagatttctgagttccaggttaggtattcttttcttccctcttcagtccagttacacctttagttttctctgaagaactgagagttcagccaggtttgaaaattgctgctttttaaaatcataccagtatgtcacccagtactgctttggaagaatatacttacatctcagaaaagatcatgttcaggtctttgaatttgttgagttggatgggagcagtgctagctcctttgaatgtccatctgctgattcctttcagtgtcagttttaaataaagggtatttaaatggaaataagttattgtgccataagcatcttattgtcataaatatcttagttattgtggggaaaaaactgctaagatgaaggtattttttaagataatgcaatagcaattaatatgtatacattaaataagaaagtaaggccagtgggtgtagcagagccttcattccattgcacaaatgaaaattctttcttgattagtagttatattttctgtttgtaaaacttgtcaccgtttataaaatccatgattaaatttgtcattattatttggatttactaaaaaagccatttagtttctgattatacagaaagtaatttgttagggtattttgtaaagatgaagagtccaaataaagatgaataaaaaataattttctgacatattgtagagaaccaaaaaattatttaataaatgcctgaattttatgacatctcttgacgatagacatgaatcatattacttgaaaatgctttactaaaataatttatcttataaatgagttacagtttaattttctttcttttttattttaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtaaatattcatgtgttaatgtcccatttgagctattgtatccaaattagaaaaattattacagttattccaaagcgaatggatatagaccacatcccagcctatttattaaactgagttgggtttttacctactaatgttgatatctacactttatattttcatcaacattcaaatatgtaaatcattctaatatagctgacatgtatcagaatatgtaatacgtatctttttgtgttatataaacatgaaataaaaagcaagaataattgaaatgtaatcttagtttttaaggcttcgaaaatttgaaatactttttgtaacatcaagaatgttgaagtgcctgggtctttggcattagttgctacttaactttttttttttaaattaataaactttgttttttagagcagttttaggttcttattaaaatcaagtagaaagtacagagatttctcatatgatccatatccacacacagagtgtttctcaactgaagatactttgccccacagcagtacatttgttaacagtccatgaacccacattgacacataattatcacccaaagtccatagtttacaataggattggcttttggcgttgtacattttatgagttttgacaaatgtattcaccattgtagtatcatacagaataccttcatgtgccacataatgactactttttggttagtgatgaactgcgtgtaccatggtggttccatagatgctaatggatctgaactgttgcctagtgacctcttagccatcatcaagtcgtagtgtgacgcattatcttttctattttaaatgtgtttagatgtacagacacttaacattgtattataattgcctgtggaattcagtacaataatatgctattcaggttgtcgcctaggagcaatagactgtaccttatagtctaagtgtgtagtaggctatactatctcagtttgtttaaatactctcattgctgttcctgtaatgataaaataggctgacaatgcatatcccagaaagtatccctttgttaatgatgcataactagtttcactgccctaaaaatcctctgtccttggcctgttcatccctcttatcctcctaactactggtagccacagatattttccagattggcttatttcacttagtaatatgcttttacatttcctccatatcttttgttggcttgatagttcatttctttttagaatggaataatattcattgtctggatagacacagttgatccatgcacctacagaaggacatataggtagtttttaggttttgtcaattatggatagagctactgtaaacatcagtgtgcagtttcttgtgtgagtataagttttcagtttatttgggcaaataaagtacaattgctggattgtatagtatgagtatgtttagctcaaagtggctataccactttccatttctaccagcaatgaatagaagttcttatttctccacactcttgccagcattcagtgttgccagtgtttgaaatccattctattaagtgtgtattgctgtcttattgatgttgtaatttgtaattccctaatgacatgaaatgtttaacatttttgatatacttattgtatacttaactgtcatctgtacatcttttttttctttcttttttttttttttaagacagagtctcactctgttgcccaggctggagtacagcggcgtgatctctgctcactgcagtctttgtctcctgggttcaagcaattctcatgcctcaacctcctgagtagctgggattacaggtgcaagccaccaagcccggctaattttttgtatttttagtagagacagggttttaccatgttggccaggctggtctcaaactcccaacctcaggaaatccacctgcctcagcctctcaaagtgctaggattacagatgtgagttgccatgcatggccttgtatatcttttttgtatctgtttaatcttagcccatttttaaaattgaggggtttttttttagtatttagttttaagagttctttgtatattttgggataacagtccttcatcatatatctctttctcaaatattttctcccagtttttggcttgttttttcattccttccagttaagagttatcatttatatagttaagacttaaaacatagaaacaggcaaacagaattaaataacaagttcaacttaagaaagcataaaactaagtatagaattccttgtatccttcaacgaattataggtaaaatatctttttaccagattaaacactttctggcttttcttcctagcagatttggctttactcagtaggttagagaagtcatagagaaggctgtcaatatgacagatgtgttaagccaagatgcaaagtatgtttttgaatattaagtgagaatttctgccatcttcaaatagtatacagatagttaaggtaaacatattctgattaggttctattctttctagttcaaaccattgcttgtttttttttttaccttatatgttgcccaagatggttataaggaagagaccagttgccttttctttaaaatttagatgtaaggaaaattttgcccacgttcaaattcagtatcattcaaattcaagacagtataaaatttgacataattgtttgattgttggaggtactgtagtttgtattaaggtgttaaagatggttataaattggtgtttagccactttgaaaatagtacaattgccaggtgcagtggctcacgtctgtaatcccagcactttgcgaggccgaggcaggtggatcacctgagttcaggagttcaagaccagcctggccaacatggtgaaaccctgtctctactaaaaatataaagattagccaggcgtggtggcaggcacctgtaatcccagctacttgggaggctgaggcagaagaatctgttgaacccaagagacggaggttgcagtggccaagatcacgccactgaactccaacctgggcaacggagtgagactctgcctaaaaaacaataataataataataataataataataatactacaattgagaaaggtagagatgaatataaagtatacgtatgtcctaatatgatagactacctcaattcctgagttgaaaggtaaactcataatttctactttattgaatttgagcagttttttttcttcactgagccccagtttattatagaaagtagataatacatcattggttaattttgtgttttaaaaatggtgtgtttgagaatgtgttataaactttaaagctatataaatgatacctcttaactggactgttgccttcccacatataagtataatacagaaaactgctgagaatggatatcattttttctgtattagatacgagacacctaactcttggcacctttttttttttgttttaattgtggtactccgggcatctttattagaattttcctatatgtaagatagtataaataattattgcttatatagaataacttgtccttttttaaaaaaaaaacttaaaaatcccaaaaccctaatagtttagcagattttcccctttatatttctcaaaaaatgtgatattcagtcatgtagtgatgggagacatgtttatttctttaatgtagaaagtttgtctttgaaaagttcacattaaaacattagaatttttccattaaatttgaaagccccccttcctttttttttttacatgtgatgatagagatgggcatagaaatttcagtaccattaaaatatgttttcattgtattttgctcctcttgtgtttttcactccctttcttccatgttatctcttcagcagttgagaatcaagtaaataaatacacttgtaattcaggctgtggacatggtaaaaatattgtattcactctccattttctatttcctgttcatttaaaagtgtgaaactaaaggctctagtagtaactgattatagtatactgtcttaagtattctgagaggctcatcctaaaaagtgagaaatgaaatgctttcttaaaatgatatttgttttaatattttatagaacagtcaccatttagtactctttaaagataattgttggggggggcaacttaaaaatatataaaagttataacactttgaattcattaacaaaccaaaaaaacaaatcctactattactttgaagtacttgattaacaaattaatgagaattttgctaccagtattgtctctttgcagcagttgggtacaaactagtaggtgtcttaaagtgatacactggattatacctgaagatcgtcctgccaaattttaactgttttttcactctaaaaacctgctcattgttatcaaggtagttttgctgcttcggatgatgctttataacatgacctcaagtttttagcactttggcctagagatctaaaagtaattatgtaaatatttactggtttatttttcaatattaaatgtgagtttcacatgcatagttaggtcttttgcaaagcaattcgtagacatgtgagtgtacctttgtaaatacaaagaagtatgaaacgtaatacataccgtgtgaggaagacggtgaaaatatgtgcttcagttagtccctattgtagtaaggtgtattttgtataaaataggccccctgcctcccattttttttttttttttttgcggggggatggattgaaattgcccagggaaagtaaggttatggcctagatttatggaactagcctggctccttcaaagcttttaaccaaaaaaattttacttaagcacagttaaaggtagcacctgactagaacctcatagcctacttacattatgatgtttcttttatttttttttattttttatttttttttgagatagggtctcactcccttgcccacgctggagtgcagtggcatgatctctgctcactggagcctctgcctcctgggttcaagcaattccccagcctcagcctcccaagtagctgggattataggcgcgcaccactgtgcccggctaatttttgtattttcagtagagatggtgtttcaccatattgtccaggatggtctcgaactcttggcctcaagtgatctgcccgcctcagcctcccaaagtgtttgtattacaggcgggagccactgcacccagcctatgtttcttattaagtaaaattcattatatttttggttgttatactatccattcaaattccttgaagtttatttcagaactgggtggcatgtaaataaatagtgcagcaagccattgtttatacaggtttggcacttaaagagtagtcaacaaagaatgtaaaggagaaacaaatgtaaacataaagttgaatagttgccagtgaataaatgatatcacccacagagattatgtaatttgagtacgcaaaacctgctagacaacatctgcatttgaggagcagaggtaaaattgccataaaaaaaaacggaacagacgtgggagaattaatgttttagaagccagtagcaaagtacaaaagagatacttgaattttcttgatgatgatgaagatttttattctattttgacagctcaaataaaagaacatgttaggattttcgagataggagagtttcaagatagaaatcaagaaatagcaattagccttgccttgcatagaccagcaggaattaggtagtactctggtcacatggagccagatgatgaataaatataagacctgaatttataaagtagggataaacttctaggatttttattctatgagaaagagaaaaaaatctagctttagaactttaggtatagtttaattaacttaagctctataagcaacaaagctgatttcaaagctcagtgttttctgaaaggttgggataatggaagtaagctctaaatgtaggcaccagaataatctattccctttctataccccattcggtaacttttctgttcttgaatttcccttttctaaacttatcaatatcctaacctattatctctaagtataataattacactttattttactttttaaacttgagagcatatggagtggtgagaacttcttgtgtgccagaggctttgaaggaatgtgttgttgtatatgtatgtgcattactttgttctgtggttctttacattacagtggatgcagagtgagactggaaaattgagtgcatacttccacattcagttagaagtaagactacatggaaaggaccatgtatgccttagtctggaataagcagaatgatcttaccctctaccatgacacctcccattcttgccacgaggcaagccatataaatagggactctgtaggggatgggagagtttataggccatggcttctattttaagggagttattgagattgttagagctacggaggagcttgaggctcatcatattctaattccctttaattacacttggggaattgatgtcattataattggtacacttagttcacatagctacatgtatattctcacttttaaaaaaatctccttgagaaggagtggcaatttgatattctttttacttcgcaagcctttagaacaaggttggattattttccacaggggctgaaacctcaaatcgcctgtacctagaacctcattcatttaatatcttactggcatgaaaatgtattcataaataactttgaagttcagttttgctatctagacttttaacatgtctattattttcaaatatactaatagatactaattttatataaaatatttaaacaagggagatacttaatgcacacatacacacacacacacacacacacccctttactatgggaagtggtgaatattggaagcctctcagaatttaatcaagaaaattcattacaatgcactcacagttctgccagtgtactctggcagacttcatgattatagatttcggcttgtgtatactctcgttgacgtacagtcctctcaactttttacattgatcatccattcttcataaagaagctttgtatccaagtcagagctatatgaaagatatttttatttaattaatatttgttttctgatttttcctataggttacaataaactgtaaactcatctttctaaaatcttcatatttcttcctcattaatggcatttttcaaagggaaaaattagtgcagtatgtcttatggtgtttcataatattttggggttggtatattttattcctgaattattatgaatgcttactagtcagggttactcttgcttagcatattcattcagtatacttactcattctcttaggatctaagcctgccatgtctcagaaactgcattcttacccttatgttatttatcccaggtgcttttatctacttgacatgtcaggtttatccaccacttgtccattagggtaaaatacatacgggggaaatgaaataacttggccgctcctaacccatcatgtctatgcaatctacttaggttattttctattagttgatggatttctactaattctctcactcgtggcctagttgtttcaagacaactaactggtattacaagcacatctctgtggccagtctactaatatagattcttgaattttagtacagtaataaataaccattaaagctcttattggtatacctaattggacacatactttgcatgtcacttactgatggacattaaagcaaagcactcataggaaggggagactgttggcagtaataaacatgaaacttattaaacattcacatttagtgtgcaagaaagactaataaattttgaaatggtttagaagataaattatctaaatatcttttatgaccctgcttatcaaatgtagaaaagagagaaataatgtcacatcaaaaattctgccctataggatccttggtttctccttttttttgacagggtcttacagctggagtgcagtctctgctcactgcagccccagcttcccaggctcaagtgatcctcccacctcagtctcccgagtagctggtactacaggtgcatgccaccacacccagctaatttttgaaaagtttttttacagacagggtttctgccgtgttgccctggctggtctcaaaactcctggacccaagagatccgcctgcctcagcctcccaaatgctaggattacaggtgtgagccaccaggcctggctctgtttttcattttaaaatgaaaatcagtaaaacagttctactagatgttgaagactgagaatacaggtgtgaattggctcattttcactggtacttctcattaatttagggggtttttaccttttgtattatgtccattgattggttgaggaaaccagagtattttccataaggacattacattagtggtcttaagtattccctaaggcttattcagtgaaattcagaagcttgaaagatactttaaaagtttgaattttattttatttttgaacagatataggctggataagggtaagggaaattagtttttgaaagcaaagccatatctcatttcaactttggtgattttgcttcagtttttatttttagttttgaaaccaaagcggagagatgaagaaataagatcaaaatcaatagacgtgaacgtgaacatttcatttgacctctgcatttcaatatgatcataatgatctttttatagtgcttttcatatccttagggattattatgtattccacctttctcatttgaaaggagagtattatggatgggatgacaatggtatttctgtggtgtctatatcatcacataccttgtagtttttcactcacctagaacattccttcctgtacactaaaacatcggtttctatttacaaagtatgacatttaaacaagttaattgacagaactgtgtttgactggtatctctaaaatgtactaaacaatcaagtgttaaatgtatttacttactgtctaaggaaaattattgtgggtaattaggttcatggtggcattttactaatacacatttatctaaacgaccacgagatcagctttcataagactattttcagatacccattcaaggactttgttgttcctaagtatgatttcttttcagtatggatctgcttgttgatgtcatactaataatataaaaattttgcttacaagcatcctttttaaaaagttatactttgaacagataagaatagatgttcagttacagttgtaaaaaatagaaatgaaattttattgtaaggtttcacatcaaggcaaagtcaactatttttgcttgtaatttggcattttcttctgttttttttctttttttgacaccaaaattcatagacaaatgctactgaaatgtaatataatgcatgttttctaccagttaaaaaaagaacaagttgtgaagtgtaatgtcacttaagaatttggaattgtttttagtatgctgtaaaatttcctatggcatttttattaggaaaataatacatgtgtttattaaagctttggaataatgtcactgaaatatgctgtttattaatacttttaatttaatatttaataaataatagcaaacataattggggcaaaattgagacttttccattctaattattcttgtacattttaaggagatatctaaataaataaaatgcctagctgtatttaatagagaaaacatcttactaaattggtttaccccaaatccatattttgtttttgtactaggttaggaacacgatagcatgatgagtcagtatactgtattgactaattttattgaatgaagagaaagagagaaaaaaaaaatacatatatatgtctttttttttctttttgtggggaacatggtctcactatgttgcccaggcagatcttgaactcctgagctcaagctatccttcttctacctccttcagtgctggaattacaagcatgagcaaccactcctggcgagataatttgatattaaattatttaaagatcttaaactgtcatttattatggccctattaattttccatatatcctatactgaaattgcataccaaaactatgatagtaacagcagcaacagcaacaacaaaaaacaccagtacctactttgtacattatctgaggagaataattgtgggtaattaggcttctgatggcattttactaatacatatttttgtgccttgcatattttaaagatccattcttttttctttgctatgtattttctttaagtatattatagcaatgtagttagattttttttagtgctgtttattactccactattagttttagaggtaatacatctcttgtggatgttagaaggaaaaatctcattatgaaaaaaatagaagtaaatgattttgtagtctttaacacatttaaatgttgtataaataaatcagatatattgtgaaactaacacgtcacggttctctcaaaatttgttaacatgtcatatgtgaagaccaagaaagacatagttttagaactcacctatctacattactcatggctttaagaaagtgtctgaaatgagagttgctctatttaatttggcttgagatgattccagtggtctttctgtttgttttttcagaccgcagatctgttattgttattgaactcacctgtaatttgtggaaatcttactctgtctctaaagatagattcatggtaaacccatgaaggtaatgaatcttaaaacatcacagcccttcacttgcgtgggtctcttctaaggcatttgaacaagttcatggggtcaaatacatacagtaaaaattggcagaaatacaatatttaaacacaatctctaaaggctctgatttcattctctgacttttctgatatacttcccctcatttatggtggcttaggaatagccaagcgcatttagagatgcagttagatggaagttcagttggtgttaaattcaatctaggtttagtggagttatttttacgtggtttgtagacacttgtatacagttttgttactgctaactattctggtgaagaaatggcctctagaaatacttctgttactcattatacttccttcctgatcgtgacataaatgtgcaaagccagatgtcatattgcaatttaaatatgtcctatgacacctgagatatgtgggtagtggaagagagataatgtttgtagtgtatggagccagaagctagtctatggaaaaatcctttcattcattacatatatatatataacattaagggacatttggttttcatagatagctaatccaaagagaagttttctcttacatattcttggtggagtatgtagagtacacagagcacatgacaagggtagtacttaaaattaccaatgtaccatactttccccctcttgatgagtaaaatatgaaatagaatttatcagaatgccagtgtttgtaaggcacaggctggagcagtgtagcaagcacgagctcttgtggcagtgtgggtgcatgttttatgcatcacaactatcagtagtaaaaaacaaatttggatcagctgttcacaggaaaagcaacattatagaaagtaaactgaaatttttacatgaagagacactcatagactatgtcgctaaaaatattgaagtattagaaaggaatatcaggcaattaattaaaatgctttagttttctggattttgttggttgtggttcttgttggcttttacaaatttatttcttgtgatttctttttctaaataaccattcactttggtatctaattttctatatgtaatttttctattttgttttttatagaaggacccttaaattttacaagttttagaccccacaaaacttgaattcacgcctaccttttttatttatcaggtgatagtttcaagaagttggcatagcattcccctggacattcacaggttgatatgtacattttaggatatttcattgtatctttagatatcttctttgtatttcagagatttaggatttgggagaagagagactgaaagattaaaaattaaacaaattcattttttaaaggacattatttaagtttataaactaaaacatttatttatttagtaaaagctttgagctagaataacccattttcgcagtttatgttaaataaatgcttggcttaaagccctcctattataatatggacaaaactaaatggaggaataaacagattttaaataaatttcactaatatactttgcttttatactctcctcccccttcttctcctcctaatttttggaagtttccctcaccctcaactcccattacagactttatatgaagaaaactattatttaagttacttttccttagtaatggtgtttctgttagatttataataaaaaacatcctttagtaaatgaaagctttttttttttaagttttactcttggtacttagaaaaatcacacaggaatagaatgtatgctgattttttaatgatattttataattctgtaatttttttcatacatttgattatcttatgacatcctaaagtgttcttatcattaattaatagaattctatgtaaacttgaaagaatgtttgtaagtaacttttgaaatcaaattgtgaaatatgtgaatgagactgtacctttgaaaatgtacaaaagcaggtatgttagatagataaatagtggtcataacaaatatattatctaataagttggttcaaggcacttttatatatcttgccatttatttcaacccttgatgagtagacctttattaagctgtgatgattactgaatatgaaatgtaaccaagattattttttattcaaatataatttaaatattcatcaaagagaagttatgcttgagactgacagagactattaacatcaaaaaatataattaactgcattgggtatcatgaagcagagttagccaaatagccgagaggtctaattgctctagagtttgagaagcaatggttttattttatgctgtagctgtggaattaatagtaatgcggtttcctatgtgggccaattaaaagctgcctgttaaggttcactgctctataggaaacccattgaatatcgcttagtaaacaggattgacatgtcaatgtgtacaagaagataaaatagaataaaaactgtgaaaatgagaagtagtattaaaagaactgtccttgaaaacaactcataaaactctttaccattagtgttatggttggtgttgtagtgtgcctcccacgttcgcctttcaggatcaggcactgtttctcccagctgtcaagagagttgcctgctgatgggctcacagctgagtcactccacaggaactgccacgggctgaagggatcttaaactcttctccccagaggcagcccccagtgaatcccaatgaatgccagagtacaaaggattggcttcttcatctttgcttcatttcagggacatctctgaaggtctctgccaactccagagctcccgccctgaggaatttgctgggcttttgttgcgactgcactggagttcgccttctcactctccccaaccctgcatctgtcatggcttcaatgatagttctaagagcactcccaataagcctctgagagatctctgcctcaaatctgtgcttcccttgttatccaaccaaagaaaagtgctaatacattataggaatctagtaattaagtataaaaactaaaggttttaaaggaaaaaaaaaacaaaaaaaaagcccaattcaggtctaaaaatggctttttgcactcaaaacgtttatctttgtcttgtcatcctttttctttaataaaagtaatattttgacctttgtggctctattaagctttttaactgaatacaaaaagaaagtgcttctgattgaatccaaaaggttttgccttgccttggctatagaggtttagaagtgggcagacattctaatggcattttgacattaatgaggttgctgaaatggaaaagtttaagggtcaaagataagagcagcgacaagttattctagtgtttcttttacttaataatgtcatatcaaatatgcttaagaagttgaccatgattccttatgtagaatatgtaatgttttatgagtatactactttaagtattataatactttttgcaaataaaaaaattctaagacttactataaaacatgccacctcagtctattaatatgtttagttgcaacttctgcaaaacgtgtaaaaaattttaaaattgcttaatagattttattgtgtacaatatgataatgtgtatagtgtgtctttaaactgcagtgataaggctgttttcctagtcattcattatttaatgtgcttactctgtttatatctgtggcataagagtgcacgttagctttcagaagagcacaacatttgctgcttcacagcacacggccctccactcccaagcctgcacatggtgttagtgatagttaaagcacttgagtctaacattttatagattttgatgaaccgagcctttcagacaagttactgatatgaagctaattcaggctagaagtataatatgaggatagacactttctgctttcattgtcacttttaaaagcttctacaaactgcttgtgtaaactataaatcagatacattttagtttggtttatatcatatggttatggaaccatgcttggcttctgaaaatgatatcttgtctttcattgattgatttgctgccaaatgattagtgggttctgagatatagaagcaaatgtgccaaacactctaacagtatttattaacaactggtaagaatatattagtatatttgttagagtacagtctgatgtttatggagttaatatattttagaataaggtagagcgttatgcagtgcatatgattcagagactcttaaaacagtgactaacccctcaaaggctctgtagtctggtgaagaagaggagataatgtacagaaataactgtgataccaaatctcccttatagtgtaacaaactttcaaaagctggtggagaagggaaagtggtaagttatggcctgagaggggaaaaaatactgtatgctcgggatactgaggaggtctgttcagggaggtattcagcttctgtcccctttctttcacactctgtaacatggagcatgttcgccagtttctttttcctttcgggcattgtgagtgaattccctcctttcacttaagctaaggaggaaaggatctttcaaagattgtgtttatatatatctcaaaaattatgaaaatagtcgtacagaatatcatatttaaaaaactatttttaactctgtaatgtcagcatggaaaatagcactaggatttgagtccttaatattaactccgaaacagtaaggagttcaatctttttatagtagagaagagtaaggtacagtttgatattcacttgttaatttttatctgtatagatattattcagatgtggcatatttatggtattactatgtttccaaaattacaggtatttctacactttaggatataacagcacgtaatgtcttctaccacttttttttaaaaccagcatcacagatgaataaaaagttatctggctgggctcagtggctcatgcccatagtcccagaactttgggaggcggaggcgggaggaatgcttgaggccaggagtttgagaccagctggaccaaaatagtgagaccccatctctataataaataaaatataaaattacatttcccctccctgcctttcttcttttcctccttcttcctatttacctgtgatcaattgatctatctatgtatctgtctgtctatctttttaaagataatttcttgcttttgtgactgagatgcagcaaaaggacacttcccttgatctgtgctttttagaaagagctcattgggtaataggctgtagactgaatatttacgagttggtgttcagttatcaagagaatgccatcagcaatgccttgttgctttcttatcagctacttcctgctgtcagcttggcacttatttcaatagaaaaggatttgcatcaaatgtaatgccttattatatacagctaacgtggggtttttaattgtacaaacacatgagactcctgcagtggtagtcaatttgataaaaggattagattatgaatgttttgtcatgattaaagattagttcagatttatcagaagtaagccagtgaaatttgtcatatatttatcagtcaggtgagactccattaatctgagagtgtatgaaccacaagtagccatctctttataaaagtctgctgaatttggttatttatattcaggtgacaggtgctaaggattgtttttggccttccctacttgctctactgctcagagtatcccaagagtctatgtctctagcttttggtcactattttttttttaatctcatcttatagaatagtttggtaaacatctacacaaaatttctgtagtttttattaaagaaatgacaactagtgtatacctgaagacattttgaattgttcctttgattaaaaaaccttcagtaaaatacggaagattgagaattccaacttagaaggtatttaaattgagtacttcttgccataaacaagactaggcattgagatagattgaaaagaagcctgacatacaacagaaaggtgaaactacagtcccagacacaactaaaattactgtgtgaggcctgatacaacagtacccactgctcttggagtgtttgggaaataatataaacaaggacataagaagtttaccgtgtaattctagacatggaaaataattagtgagtttagcagcaactaaagtgcaaaatataggagatgccataaagcagaatgtgattaacttccaaattaataatatagagctgctgctctaggaaaagactacttccgattcaggtagtcagggaatataatcctgtttggccagcatcatttgtattggctttctgtataccacctgtgtggctgattcttcccgcatatgtgtgtgcctccctcaagtatataacagggagatcctgtttttaggattgcatggagggcaccactgggagttggaaaatagcagttcctcagactagaagcatagtatcctaagctctgataattttctacctcagggacttaacggtccttcaaatggatcttcttattaaggaagagatagttcaagaactgtacatagtcatttatgtgagaactcagttcagaggtatttgctagtgtgctagctgttttaaattacatagatatcaagattctcaaagtctacatagaaaaggttgcctctgttaggatgatttttgtagagacgagtactgagccatgcttatggagtagataatatcgtagagagatgtttaggagagagatctttcagatgcagtgattcctctagcctgtggtgttagtaagtcaatcagattctctgggccttagtatattgcacctatattaatgaagaattatattagatcggtgatttttaaactggatttcttggagaaaaccctcaggttgaggggtgattgaggtatatgggaggagagatcaagtggatttttcaggggtttggagccgaatttcgctactataattccagacctgtctcaacttctatttctaatccattctattaagcaggatttttttgttcattttttaagtaaaatttttcatgtcaaagagattgtgttgccagaatctgatactgatttggtactactgtatttgatgatgatacataatttatgctcatatttgttattaagcacatacttgctaacaacatttttaaattaagggagaaggatcctctgttagaacagaatacttgtatgaaaattcctgaggggagttgggatataatttgaccatgagggtatactctctataagtagatgataaagtgaattccttctatgtgggaaagaaggacataaggaaacacagatcaaatttgaaattcaatagttaatagaaaaagattcatggctttctgaataattatgtagcactttgtttttagaataacagttttcactttgttgaacctttggagaaacatgaactatgtatttcccttgccctccaacattaacttattaattcagttcatatattcagatattgcttgctcattcttttttattcccttctacacaaaatatcctatgagtttgtttataaatgacatcaaatattttactgccaaaatattttagaagttgcaagaggaagaaaaattactttaaaattaaagtaataattagaaatgtttatttgactgaaaattaagtttagtgaagaaatacagtatgtgaacatgaaagttgggaaagatccataattcgttttgtgtaatgaatagcagtgttttcttccctcttgattaaaaaaaaaaaaaaagtaagcacttacagaacatagagtcattttaataaaaaatgggaaatgtttctgagtcagttaaatactttgacaaagatgcgttttttaaagccacacttccaaagtcttgttattttatttctatactttcagtttgatttgtataggaagttctgtcggcatttgttgccatgctgtaatcaaaatgaggtctgtaaaagtggaaattatattagttatcaattcaaatagaaaatcgtttgttgtatattcagagatttataatactgactaaatgacatttcatcaaacatctcaggagtcagaaaaaaaatctttatggcataattttcttcttttcaaaatgatatctaaaccaagggcgtaatctttaaggtgaatttaaaatagccgcaacacaaatctagtttactcaattctgccctctaaaactccttttagttgcaggttcttttgcattatttcaaactctaatcctctgagcgggtaattaacagaccagaaaagccatttgtggaaaagaagagccataagggtgaaaatatttcttcactgaatgatctttaagaagtaaataattacaaacggaaaggatttgggatgaccaatctaaaactgaggataattagaaggaatagagtatgaaaatcgaaatgcttggcatgtacaacaattctcatatcacaacaagactaattaaatatttagaaaccaaaatcccctcacaattcgaagaaaaataacccacgacaaaagggtctgtaactttgcagataattggcaagggttataggaaggaaaaacatcacagattggctccaaggctctgcaaggtcatgtcttattacgctgtgtcttttatatagtctggtaacaagtttcttgctaatttaatctaactagggcatcccatagcgatttcccatttcccttgttaaaaatgtgatagtttctgcaagtgcaaactgcagtaggttaacgtttttataaataattgctcttaagtgatacaggttgtaatattttttgaattattaaaagtgaaggctttgaaaatttagacacagaagcattatttttttaagtattacaaaattttatggtttttattcccatttaaatttttttgtttcattaagtagttagacctgatgaccctgtgaatgaaacagtctcagtggcatgctttgtaaataaatacttcttattttgctaataaaagcaagcacatttatgttgaatgtgcatttctgcaaacaacagattttgtactggattaataaggctctgagtgagtcaagcctaatttgcattaaactgaccccaaggtccggtaaaaactgcaaggaatttcaaaggtttctaaaacatagaaagttgtttttagaaaatcagcattgccatttcaaaatgcttattttagtaattaatgtggtatttttaaggaaatttttggagtttctaagttgtaaatgaactaaatattaaagtatgcatactttgtgtttataaattctggcataatattttactcaaatgcaaaggttatgggaagatgttattctgttttcattgactgaaaaaaagcacgacaacctcctagaattgattttccataggattttactgtcaagcttttgttgacttgccaccagttacttgatttttacttggggagtgaggactttctgtttctcttatacactatactccttttcagtcaaatggatttatgtttacacattgaaagtacagaaaaacattttgcatttttgcttatgattatcattttaataataaatgcaattttaaaataatttttatgcaatttcaaggatttaatcacaggtgcaattttaaaaaatcaggattatatttaaaactttaaaaaagtagaaaattgaatgtaataaaaattatattgtttatttttcccaaattatgtatctctgtgtaccagtattcatgcatattatgctagagattctgaaactaactttattacagtaatgatttcaaaataaataacacagtgttctataatgcaaattgtataatatcctaacatacctataggattaaattctatatgatggttagaaatctagactacacaaattattaaataaataatgagcaatagctatgtgacaaatgggaacattgttacagaacacctcttttttgccacatgaattacacaccgtttagcttcctaatgttatgtttacctagcaattagttaagctcacaaatcatcattaataaatatttaaagaaagcaagacccactttccctagctgtatagaatagaaatttagatgataaaatagcatttcattataaaataaaaaaaactttttgaaaagatttgatttaacattcaactccatttttctcttgcatttgtgaggatgattgtaaccttgtatcttgaagcataattctttgtattccctctccattcacttgattattttgcctgagcaaatctatttgcattggtgcctacctatttatgttctaaagttatatgctgtgtgtataaaattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtagattttgcatttttaatcttccttagaactgtggtgaataatggcccctggcaggagataatgaaattttcttaatttatattttcaagaagaagcttcaattgaaaatggcatcctgtggcctggagacatagctctagtgcaagtttcaggggagctgcaataataatgcagtgccatcggtgacggggaacgatgggacagtgaagaagtaatttaaggaagaaaagaaaatgcaccaaagctttattgtagcatatctaatgatctgctgaagattcccaatggtttttggagcatgactggagaaactaatgttatcttgccaaaacagaagcccctgcttaatcagcagaacaagactattgattaaaacacctctcacaatagattacacatggaatctcgtctccatactttgcacttggtaaagtgtaataatgagcataagataatcaaaagaagagtaaaagcaatttgttgggcattgtacaattcaagattagagttggaatggaaacaaatttgcatgaatagttgagcctgtttttaaagctgtacacagtaaagagtacgcacagtgcagggactactgtggaagagtaaaagatgttctgcttctttaagatttgcaaatctgttcatcttacataggggacattgttattattggtatttttggtggcggtggtggtaatttatatttcttgatgtttgttatccaggtattgtgcagagagttgcctgcactatcccatttaaccttaacaaacttctaaagaagatactacgttttacagatgataatgctaaggttgaaaggtttaatacattgcttatggactcacaattaagtaagcagctgacctggaacttacacaccaatttttttctgattctacagcttctgcttttaaacactaatcttcccaattatcaaatgattttgcttttgaacagagataaacagtatgctatattatttttcgatacaatttattctgagagtataagtaatgtgtgcattgtgctctctttcacatagagttttaaaagattaaggaaagggaacatattaatagtttgttttcattaatatttcattagtaatgaggcactatgtctcaaaaataaaaagataatctttcttgaaaatactgctgttaatctgtgcatgatatttttaagtaatttccatatactagtatgtaaattaatgataatacacttttataaaatgcctttttatgctttacacatttttttgagaacatttatcttaatttcaaaaaatactgtggatgccttaaaagttaatattgagacctgagaacattgattacatctggaagataaaatatactgtttgtaatactttcaccttcttgccatttgcaaattgggatggttaagtgatgcattagctatttcttaaaatcttttttgaaatatatgttgtgcacaagcctgggcaatatcaccaactttaaatacttactctaatttttgtaatcagcaaatatattggtaggaagtaaattaataaactattaatcttcaaaattatttgttacacttcagcttttacagatgcatatttggcttcattccagaattgaaccattgaaaccctcacccccacacctgtagggtagaaagactacagggatgagtttttaaaccatgagtaaaattcagtgttttgggccagacacggtggctcatgcctgtaatccctgcactttgggaggccaaggcgggtggatcacctgaggtcaggagtttgaaaccagcctgcccaacatgatgagacctcgtctctactggaaaaaaaataaaaataaaaaaataaaaattagccaggcggcgtggcacattcctgtagtcccagctactcaggaggctgaggcaggagaattgcttgaccccgggaggccaaggttgcagtgagccaagatcgtgccactgcactctagcctgggcaacagagcgaggctttgtctcaaaaaaaccaaaaaacaaataaacaaaattcagtgttttgtcccatttaaactagtttatgacctataaagcaagacttttggattttctttgttgtggttgatggattttattaatgttttacgaattttaatgtcagaaataatacttttattccggtatttgaacttaatattaaaaggttttattattgggtttattttagttatatttggaattctcaggttgagtgttgtactctatatactttagaatagtaagaaaggtctttaaaattgtagtcagaaagttgcaaccagaaattatatataggtgatacttcgtgcgtttttaacccagtgatgtgaaataatgattaaatctttgtctttgtatgccaaatttgaaaattttggaaatgtgactagaaaaatactaaaaatgattatatgtttagaatttgggactgagtgcttatgtagttttatgtttattttctacttagtatttaatcatgaattataccctggaaatggtttttgttccttgtttttgtttttgagacagggtttcattatgttccctggcctgtgcttcagtggtgccatcctcccacctcagtctcccccaagtagctggaactacaggcacataccaccacacctggctaatttttttaaactttttgtagagatggggttttgccatgttacccaagctggtcttgaactcctgggctcaagagatcctcctccctttgcttctgcctcccaaaatgctgggattataagcgtgagcaatagcgcctgaccccgaaattgtttagacattattcgcaaggcctacttatgcctctgagttctctctaaaaacagaaagaaagcaatttctgtatttattgccttcctagagttgagccactttattaacatttatttgaataagtaagtcaaagattgaatataggaaaattggcagtgattacaatgggtcatatttttctgttatttttaatgacatacttctgtagaacatagtatatttttacatattctcaaaagttttatttccaattttagtgtttcgttagcacatttttagcaaaacattatacttcttatctgttaaaaaattggttcatatgtgatgtatacatgtactcagataatatacttatttcaattctccatgttaagaattgatgaataactagacagcttgctcaaaattagagcaactaaaactcttgatttctacacttagaattagcaagaagacatattaacattgtaaactgtattatgtacctcttacataagttgtactcatcacttgttttctgtttcacttgttttactaagttttatagagcaaaatcatgttttgccattcatatttattctttagtaaagtatctaaacctatctcgttttaaccctgtggctctcacacaagttgcactgatcagagtcacctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgcaatctcagctcactgcaacctctgcctcgcaggttcaagcgattctcctgcctctgcctcccgagtagctgggattgcaggcatgcgccaccatgcatgcctgcgtggctaatttttgtatttttagtagagacggggtttctccatgttggtcaggctggtctccaaatcccgacctcaggtgatccacccacctcggcctcccaaagtgctgggattacaggtgtgagccaccgtgcctggccaataatttgtatttctaacaagttttcagctgatagtggtgctgttggtatgaggaccacattttggaaactactgctttcactatcttaagtcatctgttcatctttataaatataaaatgaaataagaccagttatttgaaagttgaagtgttcaaaatatattctagtatctgcttctttatgatgaaccgtaattgtagttccttcaaattgtagtaaaatgtctactcattaaaaccctattttttctcttttgccttgttctcattcataccgattttttatgcttaatgtgtaagaaaattgtaggttattaacgtaataaacccacatggtattaccaaaatatactgatagtttgattgttaaaacaatgatacctttattggtaaagaaatcttcttctgtagaggaagggagagaaagtcatgccaggaactgtgcccagtactgaaaatacaaacgactaaacactttttctttcttggcttaactctaccttttcgctttcattagtatgagaacttgaagctgagcccttggcgggaatttactttgcttctgtggataagtaattgctttctttctggatctttttaaatgatagcaatttacacttttataatcttatcaacagcatattgttaaggaattttcagatttttcttagtattaatagctcacgttgggtgtttcccaatgtctttcttgtctcctcactctctatttggaaacttaatgctgcttgcaccctttataaaggaatataaatgtctgtatttctatttctgtaatttgggcctctaaaagcttagattcatttccatgaatcaagatactggcatgcaaagttctaattttcttgtactttttacagttggatttctctcctttctgacccttaactgttttagctctaaatttgccatttttctcaagattaatttcttgcacttctgatatctctgtgtatataaacatatgaaattttcaaatttaaaatgaatattttttatattttgggaggccctgaattctagaattttttataattttattgcaggagcttcattaaatcagttttgcttaagattatagttgtagaattaatacgttttgctgtcttaaagtggatgctttgtgtaatgtgattatttaaatcaataaaaattatgtggttggtataagtaatcataattgctttgacattaatttgaacctgtaattggtcagaggactactgcaaagttgttcagaaagagtaaatatggacagttattttttattatggtgttggtcctctttcaaacaaaatgtaatggaaaccagaatgcttatatacttcctgcagaacataccatgacattgagaaacatacagtaaaagatctctaagcctgtactagttatattcattcatccaattacttctggtggaaaaaatctgggcaattttcaatgtattctttatttttgaaaaattatatatatatataaatggccaaatcctttgagttactttctccttcaccttaatagcaaagtctttcatgttcatgttcttggtccatttcaactttgagtacaattccctctctctcccaccagttgctagtttgttgatatgagaggagccttttgtgagaagggaaggttgataaactaaatgaagagtttactcacactagaaattgttatttggaggagtttttgtaatcatatttaaataccattcaaaacctaacagtttggttgagtagttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagtttaaaaaagaagaaaaatgaaacatcagaattatatttattagttgggaacattagttattgacctattgagaaactgtaaacctacctcttgtcttgaattttaggatgtgaaataggttctgtgattcatgttaaaataattcgtttacactaagtggtgaaccactggtaaatttcttcagatgagtgaaccaaattaagagaaatacagaataatgacaggaaaacatatgttacagaagattgtgacactataccatttacattatttacgttcttgaaaattacagtatatggtatatttctaaaaaaacactgctatactctattataatcatgataaaagttacttatactttatttaggtcttgtttgaagttcattgtagtatactttgaattataaaatttacctatttaatcctgtagttttcaggctttgctgctcttcaaagagaaagtctagttttgagttgaaatggcaccaaagtatacgactgttcctacccatctttaacatgattcaccttctactgccctttagttagtggtgctagaaactgggatgcttttcaaaattctttatagtgctattttatacttcagtattttatgtactatcgaatatgtggtattccaactgttacataaatgttataatgttcttgttctgcttgatttgccttcttaatgtatgtgctatcagaaaatacaataaaaaccctgaaaacattccattcattaggttataatcaaatcaaattataaaagaaatagttcttgcctttacaaaagttatgaaaagaccttttggacaaattcatagaatgtacatatcattttatctggaattctaacctatttctaatattcttggtgaattactgacattgcaaaaacaagaaaataattccttataacaataattagaacattctaggcatcatgttagtacaacattctttttaatgttatattttagggagtactggtgttgaaccgaggtacatagtcatctcattaattatataggcacattgatctatgaatagaaagagtaacaataatgcttagacattacatatgtgccaaagcatttttctaaatcctttaaatgcactttatcatttatgtggaccatagcatataaggtgagctctactagcttagtttctggtattccagaaagtatgtacaatgaagaaattcacacccaactggatttagaggataaaattaaaatcctggctccttgttttgtgttgtcaaaaacttcctgctgagaaattcaggttttgactcttacgtttctgtttagttataggaccatttttaaaaattgtaatcttaattcttaatatcctagtaagatatatccaaatatcttaatatcctagtaagatatttgttgttgatcttgttgtcgttcagttcatgttgaatatatcaaaaattaaaatgtataacaatgataggaaactgttggccattatttttttacttctagttaaaatttagtgtgacccatgataccactgtattacaacataaagaaaacaaaactcttataaaatatttaataatgtagagtaacttaacatcacttgaatttttgttttatgtttctggttgcttaaagaaaatgagaaaaacttctatgttatatttaagtgaaaataatcaaataaattatgttacacaagtttgatacattttgtttttcaggtgcaacaatcgaacacagtgtatagtagttactgggtcagatgtgtttcctgatccatgtcctggaacatacaaataccttgaagtccaatatgaatgtgtcccttacagtaagtatgcagtttatatttttttacactttgcccagcattacttgttgatgctgaaagactacacatgtgaaagaagcatatgtttatggcctacaaaaccattatgtatgcagagcactaacagacttgggcctccaattaacttcatgaagtgtggaaggaagccatagtgtgatgctggccaagtgtctgtctgtgttcttaagtgtttggcttttaaggctagtgtttttccagaaaacaaacttgaattagctattcaatacggctgatagaaatctgtacttttgcccaataccagttgctgacaaattggtttggctcacagttttctaaagaaggaattgacttcagttttaatcgtgagctacttgaatggctacctgctgttgtagtaagtttagtgctgggtaaaagctaccattgcagtaactgaggcaagtgctttactttttgttctattgtctttaagggagcatttctttatgggattcagtgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtcttttaatttaaaaaaatcagtaattaatttgctgttacctttctagacatttgcacgaggcagaaataagtctatgggttttttttaatcactctttgctaaagaataaaagtaattataattcctatatactctacagtagtgacactctataaattgcacggtttcaactaatattaaaatacaatgcaaagagccttcttagattattctaatcctatgtaggacagtgtcttatctctttttcccattttcctcaccttttgtttctttctacctctgtccattgtattcattccttatactttcttttagtttaagcctttagctttcactttctccttgatttagtagtgtttttatgttttgtaacatttgcatacctcttttacacgttacttagttgataaaattgtcaccatcagataacatttattatgtgttttttaccacttggctttataccaatttctatccccagtaaatcctccaggatcttatatattccaattaagtcctattataaagcaatttaagaaggttttcaagacttctgaaaattttaaaagaaatttgctcaacagagaacattagaaatgctgttactttgtttactttagtatgtttataaacaggcgcatgcattatatgtgatgcttgtactttcccagttaatatccatgtcaaaagtgtacatatacagggtatccattgtcattgccagactgttaggaattgcatatatttatatttgaaagaagtcataaagatcttggaggataaagcagagtaatcagattggaattttgcatcctgcaagcaggatttggttttgatttttgtaccttatatttcaaagtatcattgtaaaactactataatattagccacaaattttatttagtatgaaaaatagccattattgattaaatcattattaatgaataaacatgtttattcaatgaaatagtgtgtcacttcacatacagagtatgtaggctgtgtagttagtttgggttaatttcttgtcttgcatatccatgtagtcctccactgatgttcgtgggtcatatacttgtatgtttggtctaaagaaaagtaaatgtattgttaattcatacggctcttaagacaagttgtagtatatatttggcatgtgatagagaatactgattatattaattttattgtatttttgtactcttctactgatagaattttggctggtttcacagatgtctgtccttttgattttcataaatataataacgtagggacttttttgttgtaaagagcaatgttttccttatgtgattcattaatcatcaaaggtttataatattttaaatctttacttttgagtgttacttacttttcaacagaattataaaatatatacaatatataatttatacttattttccttcaatatgtgatatcaattaaatctcaagtaaataaagactttgatattctattccctaactacattgtaattttagtttatcaaataacaaaattcagccattttcaatgaatggaaagcaaaatacactttctacatcttctattgaacttgttttaagttcttttttaaataaacattttaaaatgtattatttccatcctttacatttaatttatttcagtaaaattatcctttccttaggggaaaaaagcatacagctgtatataaattgtagtttgagtagtcacaacgctaatgatttctcttatcctgattttctcactacgcccttccgttattgattctaagcaggtataatattgctcttcgctgaggagtaattttaggactagtggtttatacaaaagtattgttttcaagacagtaatgttgaatttcttgtttttcagatgtagtcagaataacacattatagagcaagtatgtttcctgaaagtggttacatagaccaagttgattggggaaagttgtagcttaatgtggaaagttgtatgccattcctatggcaaaaatgttcgtgtgatgttttttcccataagtgtttcagaaggccaacatttaatcttgatgaattattgtaacttttaaaaattaatcaaactaagatcttaataaaatgtgcactactctgtctgagtacattttggaaatgcagtattagcaaccctgatgcattttaacaacagaaaagggagaaacagacatcagtcttgtcattttatgaaatttaggcaacatacttcaagcctatatacaatgtaaagtagtattttatggtttgtaagtattagaatacggtttaccaacaaggatcttacatagcccccttcctaacttcataatctgtttcttgaaactgtaggagttgtttttttttttttcctcatgtaactctactaatcaggtttgttttatgaaagcatttactttttataaggtctgtggagtcaaggtatttgctctgaatgctcggtatgattgttgttgcatgctagcttgctttctatgtaaattgatgatggtagaattgtcataataatctaaccataattctttcttcctttttctccttgcctactgtgcttgcttttcccttgtatgtattttgcttactttttttatagacttagtattacaagtttgagatatataatatagaaaatttaataagaattttataataaaatgtatatgtaaacctaactaagtaaatatactaattcttagtgggggagaaaggtactaccttaccctactcttcaaaatcactactggtgatggggggatattgatatattcctaaagaggaggcttttttaatggttaaaattaatttatctaggaatagaaaataatagaaaaacaattgaaacatactgggatgcataattatatatttcttcttagtaaatatctatgaaaaacatgtaaccacatcagaattaaatttgatctaaactccaaaattaagttgtgatttttataaatgtatttttctattgttatgcttatctaaagttagtttaataattgagttcacataagataaatggggatgatatacctatgcatgcatttatgtctatagcatacatataggaagtaaaacttggtaagaatgctgagtgactttggaaaggcaagagtatgtataccatgcattagtgaagagtttcattatttattcaggtacactaagtgaagcaacatgccaacatatttgtattgcctccttaatctcctaaaatgattgatccatgttcttttatgtaactttagaatctttctcctgctaggttttcctgttgtgtgtttctctttatccaaagtagtacagctcttaattcttcctatatttagcatctgttacgaattcagtcttagactaatagtcaatttattttaatcttttttcttttttccttgcaccttttttatttttcttcctgatgcttaaaatagaagtggagcaaaaaggtaaataacatacagtctgaaccccagctccctgttatgtgccttatggatgttaacctcctccctcccctctccccacaacactcctgtattaaaataatcagcaggatctcataaatgccacctcataaggaagtcaactgtttacaatgaaattgtatgactgctaaacctggtgatggggtaaaaattctgaagtcggcgagggggatctgccctttctctgtttcttttttaccctttatctctttttctgacacccttggatattttcttataattaaagtgtcatcttgcctggcttccagaaccctctccatagcatgccatggttacagggtctcctgattgtttcatcactgcttttcttgcatttacttttctgtgctcctaattgcattttccaaatacttatgttcctcaaattgaagcacctttgttttcagtctaacttatgtaaaagttctaaataagtcttcacattcggttttctgttttatttgccttatttcatggttttgcttttaggggctcataggtgaagtagggggttgaaaggtataatgtttgtaataaaatgaaatatatactgttgtgcaaaagctcaaacttttaaaacatgggttaacagattataagatgaaaacatagcaaaaatttaaattgtcagaccacttataaatgatcttaaacttaggcttttgttagtgaaaataaacataaacttcagttactttgtaccctgatacactgattatgctaactttagaaaagaagggtagtatttgtatgaagtatacattttggtaaaattgaatgctaataatatgaatttttcccttttgatttgtgatcactgaaacttgtttgcctgtgtaattttttaacttggcttaatttttgtctttctctgtaactgttagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaaggtaagcgtgtttacttgctaatgcttatgtcattttgtgaaaagcatttttctttttaaagacttcttaatttttttttcctattttcttccccttttcatagttaaaggacaaaggacaatgttgtggtacattttagccttattatggttcgttttctttttctcaatttcttcattttaatgttggcttcaagaaattgtggcattattagtcagcttaaacttttttcattgctaaaaatataatactaaccagaaacctgttagcagtgtttttttgtttggttgttttcccctacttgactgctgaattgattacaatctatgttcagaccttttaacttcttggcgccagtggttaaaggaaacgtgtgttaggaagtcccaggagaatggctaggcttgatgtacaatgccagatatatgcgttctaaagttttggtgtctgttctctcagtaggagagggagccatccaatatttttctagattatcatgtaaaattacatgtttttattttctgataaattagtgacagtttgaagtcaatatttctgtgactttaacgatcacatgaaccaaactttaaatgatcccaagtgatgacttgtgatgacagatatgcaagcattgtgtgatttgtattctctttatggaggatcattactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtgaataaagttgagtataattcagttcaacaaataaaaacattacccatctacttgccacaaagtacttcagcaaatacaaagatggttagtaatgtcatcctccacatgtgtcatatattctagcaaataatttgatccatttcagatgaaaagtctttgatagtttagatgcttttggaaagagcagttaacagccttgaaaatgagaagcttcggcagatgtagcaactgtatgttcctacaactatggtttgtcatccaaaatagccattctttataaatagtcccagaacatgaaaattcatattgaccccttattcagcccttagtgatgaaaagtattatctgacctaaatttctctcactgctgtttgacccatattcattctctctctctctctctctctttgtaatttatattatgcatttagagactcccttctctctgatccaagatgtgtgctacctatatgcatgtaggtggggtcttgcagaactattctggcccacaaatttaggtcaaaccaataagccactgtcagctttccagaaacaagatccaagaaactgatagaacagagcaatcagagaaatgaggtcttttgcctgtcataaagtagtgattgatttattttgctgaaattcgtagttcaggtcatctgtgctggatttgctatcacatatatggccaaggcataaattgtgctataaaattatccattcgttttttttcattatctatgtcatttttcattgtggactgtttaataatatattagcctcaatactttttcccatttataaatccaagccttttcattcctaaaagcacacgcatattatttttgtgccttaatctttttttttttttttttggtgagttttgagctctgtgtgatccctgcatagttcatttgctccactcccctaaacgaggtctgtttttcctgtttcaccttctccctctctggaatggccttaggaaaaacactttccagtcctgttttaactcttttccatttcttaatctggattgctttatatttacttaatctgtctgcacatgtgatatcccaaatattataaagaaaatgatgtgtttttacttggcttttggcagttcctcaacatttgggttagactaattaatgatgtgatacacttctgtaataccaggaaaaaatttttataaagagagccattttgtttatatatagcatagaattcatacttccggaaataccttttcactgataaagaatgctgtataaaagatgatcagtgtttttagacagtgaacaggggcaagttgaataggtgctcgtttttgctttaccaagctacagaaactctagagttcatttcgtgaacagtgggtgagggtgaattcttggacctcagtgaggagaatattacccttagcataaatgtctgttgtcttcaaaccctttcatggaggaaaaccctggtaatcaatagaagttcttagtacataaccagagtaaactgaaccattctgtatgtgttagttaaaatcttcatgggtacttattaagcatgtttattagcatcatttcttaggtattttgtttctactcaaatgataaatggtaggtagaatcctaagtcagtgcatgagtgcatgatacggcatccggataaatagagctctataaaaaagggtttggattagagtcataattctattgtgagttgtgttttctattattatttataggatattcttgagttttgaaccttttgccatgtttcattatggaacttctcattgtttgttattctagtcttatgctttctttccaaattgttattcttttagagatttacacagaacaccatgtcagttaaatgttcccagataactgcaaggttacttgttggataccgtatttttctagagtctatgaaaatctgtaactaggcaagtaagatcatagcatttaagagtatgggaaagtgaccttaaacaaattacttatcttcatcgttcagtttccttatctgtaaaaggaagataattatagtacctacttcatggagttgtggtaaggattaaataagatgatctgattatccatgaatggtgattggcatagcacctagcacataaatgctaaatcaacgtacacttttatcattaccagatgccctatttgggccatttccacctgtggaaataaataataatttttagaaatatatctgcatttctagccttcacatgaggaaaaaaagttgcttttcttctggtattgctaaacttaaaccttccaaaattccagaaattctatgtgtacctctaaaagatttagttttgtcacttaagctttatgatcatgtttattttcatgatatcccaatatttcactgatttatttttgaagaataagttgattccctttaatctattttggtgatcaaaaggtaaaaagtggctgggcacagtcgctcatgcctgtaatcccagcactttgggatgtcagggagggcggatcacgaggtcaggagatcgagaccatcctggccaatatggtgaaaccccgtctctgctaaaaatacaaaaattagcagggtgtggtggtgggtgcctgtagacccagctactcgggaagctgaagcaggagaatggcttgaacgcaggaggcggaggttgcagtgagccgagaccacaccactgcactccagcctggtgacagagcaagactccatctcaaaaaaaaaaacaaaaacaaaaaggtgaaaaggtataaaaataaattatcaaaaaaaaaaacaatggaaacatggctgtagaatgttgcatgaaattttgcacatttaattgaggtccttttaatgtctaccttgactcggttattatgaatctcaactaatgcttagctaacaaatcactaattgtagtattaatacatatttcagtgattaaatatgtgctagttagtacagtgtcaagggatatatcaggtagtgtagcgctcaagcattttgctctgcccccttcttttttctgttctgattcccgactcccctttaagacttgattcagcagcagtcatttgacacttctgcaaaagattgtgatgcttttgacaaatgttaattgagaaagcactgaaagcctggctgcattgtaatcaaaagaaaattacagaggtttaacaagatgtcaagcaagtgctttaaagaaaagatagacaggtttgaataggtttctgcagcagctggctaggcatgatgtttgactgatgtacataggcatctctcatatggtcaataaattatgccctggaaataaaacacatgctttagaagtttctcttgaggtagagggggggaaaggaataaaacgtgtatagtgtacttactggtaacaagaagtatgtaactactaaagaactagaaacatgtcacactactttttcgtagtttactgtcagtagtgtcagaattaataaagaaagattgatggaccagagagcttaaaatagtaaacatatcagtgataatatgaacttgttttctaataaattctaatattctagcttattatctcatgtgtagataaagtgtaaaataagttgattttattaagatgatttgaaaacatagctatttttcatttgctctactacaacaatttaaattgaaggcatcatatatgtaaggttttaagagccaataatctgtaaatgttgatacaactttcgtgtgatttcctccaacagtttttaagtggtagtattaaatttttactgacagatttttgttgttgtttaaattaattcagtggtaattaatggaagaaacattgagctccactatttcttaaacctagtggatttaacagtttagtaacattggaaggcaaaaataacctttgaaaataatgaaaacatttttgcttttaaatgtgtaacgatagttcttttaaattctctgttaagggtgactaagatatgaagggttggtttgaattaggcatgatttgatctgatgctttatcttggtaagagattccacctctgactggaactagctgcttcttcatacctacctttttcaaggtaacgatgccgaagcctgagatgtttccttaataaaacagcgcaagcatgccaagcttatcttctgtttggatctaatcaggcatgctgatcatgctcaggcaagaacggctgctgggtggaaagatgtcacagtatttattttcttgcaatatgtaaagtgggtgactttaaatttttttatcatcctaattacatataatcatcacagttttgttaatgctttgaatttgattgcttatagaatgtgagtttatacaatagaatttttctaaattaaactgtcccacatttcctgttaaacagtatgtgatgaaattatacttaaactgtactatcacatatttcattgagaaataaacttaagagtcatacagcaaacactatagtaaagcctaaactacctactttctcttagccatcagtataaataaattggaacagatgaaaagatgtattcttacgagcgatattgtcagtaattctcatttccttggtttgtgggcagacagatgggtagggttttgtgtgtgtgtgtgcatgcacacattccatgtgtgcatgactgtatgtgagtgcaagtgtgtgtttgagattaatatactcatcttttttccatagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggtattttctataaactaccatgcatacatttttcaatttagtaagtaggttctgtattacagtgaagtgattttattcaaagaaagcgatgtttacagtagctaactttatttttgtactttggtaatataacatctatggacaaagttttttaaactgtaaaagtcatttaagatcaggcactataaattacctctccctttcagagacctaggtcaagcctgagatttttgccccaagactctagtgagtcttccttacagctgcctttctcattataagcatcactttggatgaatcccaagaaaattaagggtttttgtttgtttgctataaatatatgatatttctatgctgacttcatatttaccatttataatctgcattataccctactttttgtcacttattgtcaaatacttgcattagagtttattcaaaatttaacacgcagagcaggatcatcatagctgattcccgaatgcatgcagaaaaatggtttcaatttcactgttgttttctacatctgttgtaggaactgcctcatatctctgcatgatttccactggaacatggaaccctaagggccccgatcttagcaactgtacctcacactgggtgaatcagctggctcagaaggttggttggaaccttttaatatgacacattggtgatttagggcattaacttctaacataaataatttagctttgtgtgttaaaaccagctttattgctctttgttcagtataaaagtaaaaaaaaattacgcatagttttgtctgtaaactgtttattgaaagttacatatgtttgggggtatcctgttctctatgttaagctttttagtgagtaatgcttgttaatttcattcatatttagttctgtttcttttgatgttcataagacaaaatgcattcgccgattaaataaaatatcattaagtttacaactgaatccacagaatgcaagcagatgtttatatcacacatgattatggtagaatgagtaaactactttaaaaggcattagtaattttaatattgcagtgtaatgcaatgccattttttctcctccttcatctacctttatgacgaataaacatcagataataaccctcagtatcatgctgattacatactgacttaaattctggatcattggaataaataagactttaaaataacaattttaaatggtagcagtgaaatgagagaactggctgaaatttttgagaaaggattttttttcctttttatttcttttaaatgcctggttcagaattgtgtgtgtgtgtgtgttgataatctaagagccttgaaacttctaagacgaagggaaagtcatcagtctcaattagttggagaatttaacattcgcaaatttttttcaccacaataaagatactcaaggagaactagaagctgtaaacagaaaaaaaaatttaaatgagataatacaaattgttttttcagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggtagagagaactcttctgttattttgaattagacacttggtatggcagctctttcttgtcttatagcagttgagagccaaatctttggccccgggacatatacttagaagcaaaatttctaatttggttcatttttccaaggaagaattacagttgagaaaagagcaatgtgccctgccctcccaaaagagtgtaaatgatgttaattacctgagagagatcttagttggtggcaaactttatctatctgattgtggtcaatactgtaagtttataatgcattatctgcacttggagagattatatgttatacagttgatatactttatatgctaatacatggaactcttatagttgcagcaaaattttgacacatataggaatattagccactgacatatttctttcaatggcagcttttggaagaaggacaagttgccgtctccaggaatatattgttatcagtgccattaatttttcctattatgacaaaagttggattgctacttttcatcacactataagtgtttatattaggttcataggaacccaaaatctgtgcctaatgtggttctacctggttaaaaaattgacttttttttttactgcagtatatattttgtctctttttgtcaacatattttagattagtatacttcataaaatagaataaaaaactgtaaataagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaaggcatgacttcactaattttggttggcaaggtctaggaaaaaatgacgtctcactagttagtattggacattgttgaacttgagaactttacaagaaaaggtagtaggaaagtctgtttttaggtaataatggtctgaaagtccccttttagcctgtttaataggggcagagaaataactgctgaaatctatagaatttttttaaacttcaatgttcagttcacctttaaggtattagttaatgtatgaaatgtaataattggtatgttgcccaggacatacatcgcagttggaaaagaatagctttttttttttcctttggcagaaagagactacttcaggaatatgactaggctaatgatcattttgatcccactagacgagtacaaatagtaataaataaggagtgtttcaaattaataaaagcatgccattagcaagttatgtgtatatggagtaaatttcagcatgaccttaatttctgaccagtgtcattttcagtatgtctcaaatgagcttctctgttcagataagactaataaaactctttaaattacaaatcagaagctgacttacactatgcaaatgaagcaagttcccactttgtgacagaggattcatttgtaacttagattagagagaggctccagtctgtatttcttggtgactaatgaatctggcctctgcagaccaatttctgttccactctagttaatggctgccgcagtatcagtgtgagcatttcgactattctgtctcccattagagggagaaaaaaagcctttaacgccacttggaagtatcttccacctgccaggaaggtcgtggtgtctcacacggcagacagaacgaggatattaagatggattaagctaattaatcttactctgacagtagcttcaaacaactttcccccctgttcatatagtacctcacgctagcaatttttattgttgttctttttgtacagtgtgtgttctttctcttcagtaattaccaatagatcagaactatgtgtttatgggcataatgacacattatgactgggtgaatggaatagagtaaataaacttagtgatttcacctttccaaagcatagtcagtgcgtagctacagagtgtaggagtataagatcctgccttcagttgattaactgagttatattttatttaatgttattttgtgtagcaataaattaagcctacatatgtgcatatttacaacttgggtgtttatgaagacttgattctactttcctgttttctctaacttatcagtagaggctttaatttttattcctttctttatccctttaaaagcagatcattgttgatgaattaaagtatatgctcaagtgttttttagctggacagagaattggaagagtgaaaatgttcacagataaattatgaactttaatgccaccttgttttttttttatttcaaatgattataagtagacagtgtctataaggaataattttggttactattttagttgagatttcaaaaaataatatagtttaattttcaagcatacatattaatctattccaaagacatcagtatttttggtttagaatattcaagttttgagatcataaataggatgactttagtagttttgactctacctgtaagagtaatgtctcagattaagagctgacacaggtggttgtcaactatcaacaattgaggtgtgattaaataaatagaaacaatccaccttctacacttactgtttgtaatcaaatagcagtctgttaatcttcagtcagtcctgttttaaaatggtccagttatattttaaaatggaccagatatatgttgtctaggtgttcttccatcttgaagtaagagtaaatcatcatgacagataaatattacaattgtcactcatcagctactgaaaatcactttggttctaaaagcggtcaaaactaatgatagttttctaatggatacaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattggtaagtgaatctactgtcaagtttaattttgatttaggatattcatatgtaagaggatgatgtttccattctgtatctgttatttcccagtgctgtacttctttttttgtcaaattatttttgtctgttaccaagagaaattattgaccacacttactaaaattcatgcaaaagccaaactctatcctgtgttttacaagttggttttatgtgtgtgtgtttttccagttgaaaaatcattaacaaaaaagtgtaagagtgcctaaataccagaatgtagattttttaagtaatgaaagtacttgctatgaaactgtggcaaatgcttaatcgttttatataatatgttcctaatgaatttaaattattttatggaatgcattctcagtcagatattttagcacacagaacttgagtcagatgtttgtattaaacataactgccttcaggtgaaaatgtggtcagtgaattacatctcccacaatgcagaacatccgtgcttcatagattgcagaatagctacagatagtgttgaagcataatttagaattcaaatgctaccactgagaggtaggaattcacttgtgaaaaatatttgaaagaaatacagtaaaattttattaatttaggtttgaacaatttagaattgttaattattcagtgaggttgaattcagatgaagttaacagtataccttagttagtgaagtaaaaagcttcccaagcatacatgtagaagaactcaaaagggacacagactactcttccaccagaagcagtgctaacttcattagggcagcagatactgaatgaagacttactatctggaatgccatatcttaatgcctaattatgccttattgtgcctgcgtaagtcatgagactttatataaaaaatgcagatcaaaggggtatatggaagaaatggacataaatcaaattagcacctatatttgaattcataatcttaaatttattttatataagtgaatttttaaaaagaaatgaaatattttaaaaataatttgtttttatttactttgaggtttgggaatgaaaaatcagtaattaccgaagtggcatattatgacctcaatttgttttctaaatattctgaaaattattaaaaaaaaaaaaccactaaaattcccttcttatgcctcttcaattgtgcaagaaaatttcatgggctgggttcacatctatgctcccatcagccttacatatatagaacacactgtaattatagatccaagatatttttatcccagtttgagatatattctgaacaattaaatgtccaggaatacattttttctagtacctatgtttttcagagttctaaaggattatttttcgctgggcacagtggctcatgcctataatcccagcactttgggaggccgaggcaggcacattgcttgagctctggagttcgaggccagcctgggcaacatggtgaaacccaatctttacaaaaaatacgccaagaaaaaaaaatagctggacatggtggcgcatgcctgtagtcccagctactggggaggctgaggcgggaggatcacctgagcccagggagggagaggttgcagtgagctgagatcatgccactgcactccaccctggatgatagagtgagaccccatctcaaaaaaataaataaaatttaattaaatgaaactaaaggattatttttaatgttgatcttttttcatttttaattaaaaaacactatggagagactggcatctctaaaataatgcttggtatttactagtctaaatgctgattacccaagaattatcaatatgaaagtcattttacggccgggcatggtggctcatgcctgcaatcacagcactttgggaggccgaggcaggcggatgaggtcaggagttcaggactatcctggccaacatggtgaaaactcgtctctactaaaaaatacaaaaaaaaatgggaggccgaggtggatggatcacctgaggtcaggagttcccagcctgcccaacatagccaaacccagtctctactaaatgtacaaaaaattagccaggcgtggtggggggtgcctgtaatcccagctactcaagaggctgaggcaggagaatccctcgaacctgggaggcagagcttgcagtgagccgtgatcacgccattgcactccagcctgggcgacaagagcaagactttgtctcaaaaaaaaaaggtcattttacatattgtaataatagttgtgtcttttttatttccaaggtataaacaattttgggggtggggggaagggccctgatttactgtgagggaaacgttcacctttttcctaggacttgtcttgttctcttttcagacatgaggactaaaatagcctattatttctctatgttcccactcccttgaggacatggctataatgtcttaggttattaaaacaatttgattttcctccttagtgatttcttcttaaattcttggtttaacttcatagcatgatttacccttaataatacatgactccataaaatgatataattttatctattataattatatctaattgtgacatttaaaaacttggaggtataatttaaaatatgcaataagagcacctgttttaagtgtatagtttgatggagtatggcagttgtacactcttatgatcatcagcatggtgatatttctgtgtcctcagatgggcccttcatgctcctttgcagtcattctcctctgaccctagccctaaaaacatcagaaaccactgatgtgcttttcgtccatgtagattagttttgctttttctagatcttcagttgaatggaatcatatagtatgtagtactccttttgatcttgctgcttttatgcagaggaatattttttgaaatttatccatatacatgggagtgtccataatttaatcctttttattgctgagtattatccattgtgaagacataccacaatttgtatatctactcacttagacatattgaatttttttccactttttggctgccatttttggctgccatttttccaagtggttgtaccatattaaacttgaactgtagcatatgagagttccagttgctccacatcctcaccaatatttaggattggcagtcattttatttttagtggttcttggaggcatctcattgtggatttatcttgcatttctgtgattgctaagtaacattttgctgataacctcctttcatgtgtttattgtccattcaaatatacttttatgaagtgtttgttcatatcttttgcctatttttaattgggttgtttgtctcattaaatgaattctaaagattctttttatattattgttgtaagtctttttgtcagaaatatgcattctgagtatttttcctccagtatgtgactttattttctttatatcttgggaagagcagaagtttttaattttgattttaaaaattcaccttactgagctttagcagcatctggctaatcctgttccacttaactcctctcactcttgtaatattttaaagcaaattgtaaaatcctatcatgattactgtaagaaactttatatggatatatcccatactctttaaaaaaccacaataccattatcacactttaaaaaaataacaaaacgtttcaaaagataacaaagtgtgttcacattttcataaatttattaatactttgttgaaaccaggatacaagtccaagtaataaatctgatagatatgtcagttgagttttgtttttttttttgagatggagttccactcttgttgcccaggctggagtgcaatggcgcgatcttggctcattgcagcctccgcctcctgggttcaagtgattctcctgcttcagcctcccgagtaactgggattacatgtgctcaccaccatgcctggctaattttgtatttttagttaagacgggatttcaccatgttggtcaggctggtctcacactcctgacctaaggtgatccacccaccttggcctcccaaagcgctgggattacaggcatgaaccaccattcctggccaagtattttttcattaaaagttatttctctttgcatactaaaaaaaatattttttaaacattttttgtttttcttgaggaagtcaggtgggtaatttgtcttgtagactttgttacattcttggtttggcttatttcatccacagtgcatcatttaactctgcctggtatgctgatggttagatttagaggcatgatcatgctaggtttaactttctgtttctttaatttaacaagaactttctgttgcatcttatcaacaagcacataatctttggttttatttccttgtgattttcagatcggttccatggtttagatgttatcagcctgatccatccattgtaaaattcccttttatttattgtcttttttttttcttttttctttttttgagccagaatcttcctctgttgcccaggctggagtgcagtggcatgatctcggctcactgcaaccttcgcttcctgggttcaagtgattctcctacctcggcctcccgagtagctgggattataggtgcctgccatgatgccctgctaatttttgtatttttagtagagacagagtttcactatgatggccaggctggtcttgaattcctgatcaggtgatccacctaccttagcctcccaaagtgctgggattaaaggtgtgagccaccgcccctggccttatttattgttttaatgagctgagtggccagcatgatttttatcatcactttagacttagactgtggtaacaaaaaccccaaagtcacagctgcttacaacaacaaaggtttactactccttcctgctgcataattgttgaggctggacttcagctctgcttcctgtcatcttcagttctgctccgtgttgtttttattctgggacctaggctgatgccagctccttcccataaaggtgcaagtctcctggcagaggtcatagttcttcctctttcctctcattacagccactacttgctgaggaatttgcaaaatagtaagataaatatattaaaattctgtttacagtattggctgagtgaggctctgaatggctctccagtgaaccaagtgtattcatgttcagaaaatctattgaataaggcatatattatttcaagcatacagaaagtagaggatagcataacatctgtgtaccacttactcagctgagccacatattggtattttaccatatttgcttcagatttttttggaaaaagaaaatcatagataatgtcgaagttcccaggattgcctccttcctgattcatatcatgaatgaggtagctgtcatctttattacttagcattaataagcttaaaaaattttgctttgtaagtatgtacagtgaatacttttcaggtttttaacattaatttcacactgtaaatgtaattgtataattttctttctttttttttttttttgagacggagttttgctcttgtcgtccaggctagagtgcaatggcatgatctcggctcactgcaaccttcacctcctgggttcaagagattcacctgcctcagcctcctgagtagctgagactacaggcatgcatcactacgcccagctaatttttttgtatttttagtagagagggggtttcaccattttggccaggcaagtctcgaactcctgacctcaggtgatccgcctgcctcagcctcccaaagtgctgggattacaggcatgagccactgcacatggccataattgtataatttacccttagcattttattttttatatttacatatgctgatatgtgtatctgtagttcatttgatctgtttctaagaatgtaccagaattaactgctgatagacattttagtggcttctgcttttttcctgacagaaggaaaactgtaatgaaagtttctgtatgccttcttgctccaatgtgtgcctttctagacatacatgcgcacatacctgtgtgtgcctacacacacatactccctagaaatagaatttttgagtggtagagcatacccaccttcagctttactaaatactgccaaattgctctctaccttcttttaccaatttaatttttcaccagtaataccattactagttttgcagacactttattattgacataactgttgtcaatctaatgagtttgaattggttacgttattgttttaatttacaatttccgtgattgcttcatgttgatttttttaacagatttattacctatgttagttttctctcctatgaatttattgtttacaactttctcctgtttgattttttctttatacttctatgtatactggacactaatcctgtaaagattatatagtttacagatacttattctgtctgggctttctctttttatctttttaaaaggaatctgttgttttacataatgagtcagatatatcagtttattctttttagggttggtactcttggtatcttgtttaagaaatattttccttttggctttctacttaggaaaattttctctacattgagtttataaggatcttatacttcccttgtaaatgataaacctctgccttttacagttatgtcttgaatctacctgaaatttatttttaattatgatatcatatgagagaggcagctgatttgatttttccccatatgaataaccagttccttgtttacgtttagtgcgtaatccatttctccccctaatgatttgtaatgatatcttacatgttagccatgtctattatttgctgctttggttttttcagtaatgttaatatctgttgagtctttcagccttgctccttaaggaactgctttggctgctttttggcatgtctcttctatataaatttttaaatcaatggatccagttccagacacaaaaatcttgttggaatttttattagaattggactgaatttgtagattgattttgaaagaggtgccagggtgaactgttgcattctcccaaataacagcattatgtaattcttcatttttttcttaggtcttcttataaagttatatatttttcttatttttagtgtcttgcactttttaaaaatcagatttgttcctagacaacttatacttcttttttttattataaataatatcacttttaaaattacatattttaattgtttgttgtgtggtgtatagaaacacgattgatgttgctcatagcagccttgctaaattcttagtatttctgatagtttatcgttaacgtccctcgttattactatgtagttaattgtgtttactgtgaataatacttgttttttcctttataccttttatttgcttttcttgaattactgcattaagctaggtcttctagtacaatgctaaataaaacctgtgacagagatcattttgactttaaatggaatgcttctagagtttttcactattgtttgctatatatgttttggatacataaaggtttagcctttatctgataagaaaacttctatctggtcaaagaatttttctttaattcacattttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaagattaaaaaaattagtatccaagaattactgtacaatggtatgagatgatttttgtaaaaataaaaaggggattgtaggtgaatagctgatagatgatacagacattagagacattaaagagagtgacattcagaaaaaaagtgtggactgtattttttgaacttttttaagaatacagattatttttaaaatttcaatatcagaaattaatgaatttttcatataattccttagatttcatcaataaaatgttaatattgtaattattaatataagatagttaactcctgtaaaggcaatgtacttttccattccttttaaaatctaaatgaatgttaatgtaaaataattacaatctgtattgtgattcccagcagacagtaaacatttatattgttagtggttactattaagtatatttttgaaatgaagttagcattggcatgttgatcaggtagatgttctcagtgttttgtattgacgtgttttccttaagtgtttgtcaatttcgatacttggtttgaatttttgaaatttggtttagattgcagtggttgtcacacttctgctgtaaaggtccagatagtatatattttaggctttgcaagccatggtggtctctctcgcaaatatttaactggcattgtagcactgaagaagccataggcaatatacaaatgaataagcatgattgtgttccaataaaactttatttacaaaaacaaatggcatgccaggcttggcctgcaggttctattttgcccaatttgaatatgtaaagactgatggttactagtgagaattaatgggaagttttaacataatgacattttcatcataaatatattcttggctgggctcactatttttagaaattagaaaaaaaaagtattactgcaaacttgacctgtgtaatttttcatattaaagtggatcatagatagaaagagttgtatagatgccataaagtcattcaaatttgtacttcatattagttttaccactgccaagtaatggtcattgaaaagttacttaatataaagagccaaaaaatatcagtttgaaatatttttgtttagcttcatgatttaaatataaaaccttgaaagttatgtactattaattcatacactgttcatacttacaggctaacagattggtattagttcatgacaaaagagataaaaatatgaagaaggtgttagaatgacaatacaaaatttttttgagaagtgaatatttaagacttaaatcatttggagtaatttggtttttagtccatgatttttgttgaaacctaacagtaaaattttttaagtaggcaaaaagaaaacagtagtttccatacagttatcatttgcctccttagttaactcttaaagaatccttttttccccacctcctttatcttttccctcatccagtcctggaagttgccgtactcagtacagaaggacagatccaagactttaaatttcctctgggcatcaaaggagcaggcagctcaatccaactgtccgcaaataccgtcaaacagaacagcaggaatggtaaggtggaagtcttttaaaaattgacagtttttgttgttgttcaaaaacctattaattctaaaatgtatttgagtccttatataacaaaaaaacggcttaccatttaaaagcagatataaaacagtgccttaggacttcatcattttattcttattttatcttagtttattaacaagcatgttttttgtacatcatgtgactatttttaccttcctagggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtactaacaatatgatttacattgctgctagtgtatctcttagaactaaccaaaaatgggcccaaaatagaacatggatttttaaaacatttggtccgtatagaattttctcagaacaaatttatggctctaattttatcagaaaggaaaaaagattctaatgtaccatcaattgtaaaatcataaaatggaaattgtaattgtgtaaaatgggtcttggtaatttaaagtacactttagagtctttcggactataaagccccttttaagctagatatctgccttgtataacatagtccacaattttgctgatgaaaaactttatagtctgaaacatgcaaagtttaatctaaattaccttttatacatattaaacaattgctgttgccatcttagaatataaaatcctaattttatcttgtcattttatttcccagcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcagtaagtatttgcacttctaattagtagcagagaaaaacctcagagattcaaaacagcttgtataatagtcccattctttgggtgcttaccgtaactaaaaagcaaacaaagtaatgttgatttctaattgtttctacactgtccataaattttaagaagtcttggcactgttattgttacttctcaaaatcatatgctatgactttatagacttgtaagttttcctccttggggcaggtgcttggtagagacaacagaagatttaaataatgagcagcaataggtcatacaaaagagacagaaggctctcgagtttaacatgcccttcccatcttgaatgttcgaatctaattttacaactttccctttaagtttcctaaccactttgcacattgtgcaaagctgcatcttttgaaaagtcaaaatggcttctggaatatgtctcagtattctttcttgtgattaagacaatgacagccagaagacagaaatattttaagaagtgtagcatttccgtctcagatccgtagtatgtgtcaactctcaatatgtaagcatacaaaaccccaaggagaaaataaaaacttaaaacttggcttatgtgttagcttggaaaaatcattaaaatgtcagttgtttttaatcatgaataagtattctttattctgtcatgtaaatagtttccatgtgtttatgtagttaattcagtcatactttgaaatcattaggctcctttattgttttctaggtaaaatcttcctctctcatagatcattttttaagtataaaagacaataatattgaacgctattatgtgatcaaaatttatttttggtattgagccttttttgaacacatatgaatagtattcttcaaagagttcagtagtaaaagatgagctgtacatgtgaaagctgtctttcttctagttgatgtaatgcaggaatactaatgttcctcatatctttttattttcagtataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcggtaagcaccagttgagttcattgaccttagatctctgaaaattattttagtaggtgtgaggtgacatatgatactgatattaatgtttgaccttgtaacttgatagaattgatacggcaatattgaaagacaatttgtagtaaattaaaagactgtccaattattaagtaatattatgaactaattcattttatatattaagatacagtcgaatttttctgtgtttttattaagacataattttaatagaagaatgctgaggatacagtaatataaagatcctattttaaaaattcttattttgtttacatagtcattctgaccagtgatcctttctttgtattcatagcaattgattcatcatcatgaggtcttaatatcagaaacagaacttagttagttaatgcttcaccctatattcatctgcccttggataattttaagaatgttccagatatgacaggaactgggtaattagagctaggattttgtcattaaagcaaaattttaaaattccattatagaaaaaaatagaaataatatatttgcaaacaacacttttaaagacttgtgaagcaaatcatctacaagtggaatatttagatttcataacagataattcacaaattatgaagttttcttatttgatatttaatttcactaaaaaatgttatagtaatgttcttccttgatgaaacctagcacacttggcattatactctgtgaacatgataatcttcagatttgtcagggtttttagcttgtttccagttacgaaaaaaatattttcaggaagcattagtttactctgaataatgtatttttgaaataatagtgatttctcttagtgagtattttataattttggagtgggctatttttattcatgagttttcttttgtgttttttgttcttttcccccgtagattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcgtaagtaattgcaagcgacctgagtgtttttcaagtgaataattttttaaagcctgttagctgtcagtgagggtccctgacagattaaaatagcatctgaaagctttattggtaagagaatgggcataccgtgcacaaattacaatcaagtcttttgcaattttctgggttcagaggatttgtactctggcaaggcagattccaaattatggactttctttttaacacaaaagattgacctgaaacaaattgaaaaagtaaataactttttggccttagaaagatattaagtaaaaattcttctgaacttaaagcttctgacaggtttaactactcagtgttaagctaatgcttcattagctctctttgtgcagctgaccctctatagctaactctcattctgaattgtgacagtagcacattccatcccatatgttttactttgataatattgtatcaggcagtttgaaaggattaaaataagtcactgtctttcgttcataaaagtatagatatttacagaaagtgacagaaggtagacatagtcatgtttctaaggattttatttgctagaggcatgaatttgccttccaattctgtttatttttttcctttgataaaattagttatataaagattctttggactaaagaaagctttttgactgtacagatgatgaaagacaaaagaaattcagtggggattccatgttatatgaaaaatgaaccactaagtaaaatctgtcttaataagtttatgcatcatttactctaatactgtgtgagttctgtgctttgatatccttttctagcatttatccattcctagtggaggtattatatttctgctacactgttttgcaacaaacataacatctgaacagtttttgggggttctgttaggttccatagggttaagcacttcagctcagacagatctgaaaggcaaattttgaaaattatatgtaggactttaaaatgatgagacaatttgcaatattgagtttcaagtctgtcttagggaagtcagaagtcttaaggattcagtggtggagtggtgtttattgtcttccccatacaagcacgattttgtatgcttttatcaaatataaaaccagcagtttgaagtaaataaattattttcctttgttaagtcaaagccaactcagaattattagaggtcttgcacatgataaatgaatcttcaaaggcaaatgtaaagatagttttgtctgttaggtttttaaaatcctattttccttgtgatgttgaggttccatagaaactactaatgcatattcttctcttttcataatagttgctggcttcatgttgataactactttatatggagcttcattggacctgttaccttcattattctggtaagcaggttctgttttcccttgctttttagcttgctgctttagcagtgctattcaaacaaggataatttgttttattgtttgtttatctatctatacaaagatttataaatatgcctgtctcacaggataatagtatattttaaatattttttataaacttgctaattaatatttctgaaaatctttactctaaaaagtactttttctcatttctaatttaataagctgacatatcacatcataatctaaaaaacatgcttacatataggccatgttataaattaaatgaatatgtcagaaaagtgaaagaatattaccttaatttttattatcttagtttccacatagtaatttaatgaattactatgtaattctaatgaattaattttaagtgaattttaaatgaatatccacatcctcaatgctttttagtatataaaaagttgtttaagcttgcattaacgaatgactattaaatcaacttaaaatttattagaaataaaattacttctataagactgaagataccaaatgaatatactagtttaagaaatgctatttttaaatgaatttgatgcaagtcaaggataacgacattaagatatttttaaacatcttatattacccttagtcacatttgagatatagttgaaataaaggagtgtagctacagtatctagactttggtatttaaaactttcactcaggcctggacatggtggctcacacctataatcccagtattttgggaggctgaggcaggaggatcacttgaggcaaggagttagaggctagcctggacttcatagcaagacctcccctctacaataatatttttaaattagttcggtgttgaggcacattcctgtagtcccagatactcaggaggcagaggcagaaggatctcttgtgcccaggagcacaaggctgcggtgagctatgattgcaccactgcaccccagcctgggcaacagagcgagaccctgtcttaaaaaaaaaaaaaaaacttgctcagttgtagcactatggtgagaaatggtgttattaactctgaaaaggaaacataaatacttcctattttaagaagtttttcttacttttttttcaaaaacgtaacacaaatgagctcgtttggatcttttcatggttaagcagtgtttcatgaaattgagaaaaacttctagtacttgaaggaaacttaaaaccacttcaagtgtatatttgtttgtcattaaaattaattattttacacaattacttatacaaagtgaaatgaaaatttgagatgaatgcctgtatgaattaaaccagtaaaacattctcaagtattcctgggaaaactgatttctcatcagaattattaaatctgatgattgcccaagtttttgttcttggtgttcatatgttaacacagcctaagcctgtctagagttcaatggctgacatgaagaggcatgatccttgaagacataaccttccattttcctctaagaccttcgtcaaacacataagttgcaaaaatgtaaagactgctttagggatatttggccaatgaggctatcatgtgtttactccttttatactgtagttttatttatttgatatctgtgaagataagtactgactttagatcattaaaaaacatttcaattagcaaaagaagttaattttcaacatactcagcttttagtaagaaaaaagggtaaaggacattttattatgttgttcatttatagtagagcacactattactttataagtcttgtcattattgtcctctaccaaatccttcaggttgagatgtgaatggctttttcaacagcattctcaaacacaaaccccagtaggtagcaatcccagtacagatcttgttggaattctcctgcgattgctttgctttctaattttcccaacagagagaaattaagagtggtataggagtacaaaacagcgtcttgcaaaagaatatctaacttaaattgagatatgatatgatgatacagtgtgtgtggggaaaaaatatatatatatatcttccctctggtgatgataagacatgtaaactcaattcaggcacaaatcttaataatatagattgtattgtatactatccttttaaggaatattcccataacaacaattacctattgctattcctaggaaagtatagctttgcattttcagtttttctgaattgaaactgtttcacttagttgtattaaataggtgtacattctaaataataatctatgaagaaaaataatatgctaaggaagataaaacttcctacttctgcatttctataggatgtcttgcctacaggcactagagttattatatctatgagaaaagtgctggtaagtaatgagcagtgggaaaccattagtatgcctgaaatggtttaatgaaagcttggatcatgacacgtcaggagctgttcttatcatttggacagctccatctgcatcgttaataattaattcagttcagtaagagttcagctcacacactcatttagaagtcttcttcagagaacacctctctggctgctagtcccagggagaaataggtttctgcttggctaacagcaaagatctggagatacaagtatagctttagagttgcatttgccaggtagcaaaagctccagggaggacaaaaagggtcagaacgtgcacagttcagctaggttacttcagagtgatgtttctgttcttctgtcttatcatatccatgtcagcactgcaagctgtggaatgaattttaagctgctaagctcagacggatgtgattcaattgagcaggttgatgaccataaaacaaactgtgcactcctataatctgtggtacctttttctttcttaaaatttctttgtatttttatgttcatcaatatgggtgatgtttagctgtgtcatatcattaagcagtttgaattttatcagcaaattatattggtgggttattataaataataatttatgaaattattgtttggggataggtaaaagaatgatctttgtcagtgggagagaaaaaaaaatgtcccagtttgatgacttactctttttggctgaataaggattttttttttcttgatttgttctcactcaacagacttatcttaaaagatagccatctatttacctgtacacacacacctgcacacagacacacacacgcccagagctaagctaaaatctgattcttgaatgagttgtttcatccccagaattaattattagcatggacatttagcctggtgggttgtcatatgtatgtaccacaatcctaatagcctatacttactagtagtggcttctgtgtggataattgagtaactgcatgtacttaccaagtttagacaaatgtttgtgtgcgcagctgtaactccacctttttcctttctcactgatgcatgcagcctttcaacctatgccaaaatattatgtttaaacttcgtagtatttacactgaaaagaaaaaacaaagagcaagagggtcaaagagtggctgcattggaattcaagggagaagagcagcaattggatggtagagacattgttctctccctgcctctttgcctgccttccattgagaaataggggaaataccatgttggatggttgtgatttattttgtaaatgcgtatcaaaggcagaaaaataaattgggcaaaagtaaaagtaaggaggagaaagaaatcacttattataattggtgggggcgggggagaaggggaaagcacagaagtatatggatggaaagagccatttatgtcatgagaaaaatgcaaagaagaaaggaactcagacttgcagccagtagtttatttgaaacctaccttttttgtcttaaaatgactacagatttttatcaaagatgtgtttatttgcccctctgcctcttgttctcatttccacggttgtattttaagaaaacaagaaagaagtaagaaaggggaaaaaatttttggaatattttcccctgcaaaattataattatcagaatgtattgcctcctgaaaaagattgcagcaacaatatttattctatcaaactaaaatttagcattacatttttttaacattggagaaaataagataactgtaaaaccacatttttaaaaatgtatctgtgcttcagtatatgttctatttaattccagaagatattttattgtcatatatgttggtggtaacataaattgttgagcatcaaagtgatataaaaatttttgtatttctctaataagactagtaaataatatgtattggtgaaatttttttctttagttgggaaaaagaaaaatcttattcagtattattttgccatcttacgatttatgtcatatgctttatttcataattaattagtcttgaaatgatgatattttgtcctcttccacataccattgcctcattatttgtatgctttcaagtcatgtttcagaggctaagttagtgttgggtttaactataaatttctttacatctagatattagtgcattagctaaaagttttattttcagtttcttcaagttggagaattcagacacttgtaatttgagcgcaaagatccctcaaagttatgattatttttccaatacttttagttgtctttaaaggaactcactttcaaatcttttaaaacattccattttaagtatgttagaaacagctttaaaaaattttgttcttacatttgcacttggatttatgagcttatgtgatatttagcaatgtaaaagtataaatgacataaacaggtttagaaaaaatacaactaactgttgttaagcatgtgacttgactagtgggagtagaagcgtggccaattgctgattgtgggatgctagtgttttacaaaggaaatggagaattagttaattctggcaaatccgtcaggcagaagtcatttgatgagcatacctattatgtaaataacataaataggatttctttgaggcagtattttatatgttaatttatttatcttcaattcattcatctctgagtgatttttaagttggattactttttatagaaatggaaacttttaaatatagacttagtatatctttgttaggagacttctaatcttttcacccagaataaattggttaattttatatgggaagtctgtgggctgtagagcccagaccacagtatattgaatcccagccctgaaatatagtatctaagtaatctttggaaggacacatctcaattatttgtaaaacgggtatacaagtgctgcctgctaccactgtatataggattgtagctgtatttttcctctgtaattttctttattttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaactagaatgttatggaaaataaagccagataatgtttctacaattgtatttactttttctctagatgtattttaagacattattaaattttttttaaacaaagcactgtttttgtccttaagtaattaacatcaaaggacagaatgttacctgccaacacttgtaaaattttgcccattgacctcatttatcccttaagagggaattctccatctaagagaaatcatagggcacagtggacaaaatgactggatagatacacagcctacattaaagctttccttagctctgctcctaaactcatcattaggaaggacttggaaatttttatttattgccctatatcacttttcctaattataaagtcagaagtagtgaaagatgaataaaatagtgttaccatttgatcatgtgatattgtgactcagtaaaaatgatcatgttactgtaacactgttatgctgattatctgcaacaaggaattaaattcatccttacctataataggtgaaatgggtctttttctgaatatactatttctggtattctcttaagtaacgtacagctcacaaaatgacttttttttccttttaaaaagtaatctaaaaataaaatggcaaaaaaaaattcaggaacaatgtagcttagttctatttttggagcataaaaatggaactgcctcctcttcttccaacattctgccaggtgtctgtagaaacaaatgcaaattaccaacctttgtctctcagtcaaaacacagctccttttcctctgagcaagctcatgttgacctcttggaatccactcactttccttcttgtcagattccatcttcctcattttgcttttgtttgcacctagattctttgcatagctgaatgtttagaaagactcaaaacagcattttgtcagaatgtatctacttccttacaatacagagacatagaaaaaaaagactgatgatggcttttaacagttaaatggcaaaacatacctatataaactttatcttactttatataacaaacgtttatcatgttacttcatttgatccccacaattgccttatgaatagattggacagatgttattatcctcatttaatcagtcaaaatcaagagctagactcacagccaagacttatggtttcaaacccagcaattttgtagattacatgatgtacattatgtaaatgctccttctaaggaattcactttagtgtttccatcagatggtttttaggccctgaagtacatctagctaaagaaactaatttaggttttctaatttatttaatcattaccacataatactgacttaatgaggttgcaatttgatgtcaaatgatctattaaagaattgatcatacatagccagagtattttttatgtagactcaacttgatcattgcatacataaaaaaaattatatcagtatcttccatataaacatggatcgatacatttgcaagaactattcatttttcagctctttgttcattgtggtctaattctttatttgttacaacagctaaatattatcttcttggtgatcacattgtgcaaaatggtgaagcattcaaacactttgaaaccagattctagcaggttggaaaacattaagtaagtattttgtattttaattttaatacttgacaaactaagtaaaagatactctccacagggaacacagggatttctaccttctatcaactgtagaaattattcagaatgaagttttactgccctcaagttgaatctcagtgttactatatcactgatactggtcaaaaattagataataattgctgtcttgatctagagccaataaattgtttcagtggctttgtggaaattccatatcactgtagcaatttcatttgaatttaaaatgcagttcaaaatgattttcgtatttgcatggctgatatgattatattaagtttgttttgttaaatgactttttgctttaaggattctgagcagtttccactcctaatcctgttttcctaagagaatttactctattactattgttaacttgaagattatctgttgttttcatgctaaacaaatatttactttttcttaatgttgaataaaagctgcaatattctgtcaatggagaaaatgctatctaattaacaacaaatgatagctgttgttcattaaatcatcttatggaaacattttcagagttacctttaaaatatgtgagccttgtaatttagaatttgagaaggtattattcaagttggttataatgtgattgtaaaaaatactatttttaatgtcaaaaatggcagatctatagtaagggtaaatttttttttaattagatgttttagataggttagtgccagcttcattgcatgttgcatggtaagagagagagctaatctttagcatctctctcttttcttccttttcctctttctgtcttctcatctacaccagtaattaccgtgtttgtgatggctactataatacggacttacctgggtaaggtagaaccctacattaacaaatttatggcatgatttgtattttttacaaattcgtcagtatcatgaattgcccttaatttttataattattttgaaatatctaatttgctatagtatttttaaactataatatgcctttattttttaattgcttgcctctgcattttgactttcttaattttgactaatttataaaatatataaatgctttcttattactttctattttaattctgtctaataattttgtttctcttttctgcttataatgctttctagctatgaagataataagccatttatcaagtaagatcattagttagacatggaatgcactgactttaaatccttctcattccgtcctattttctacagttcttttcttcttaagctgttcatgacgaaatctctccaaaattattttattttgaagttgttctcatgtttttgtctcatttcagctaggcttcttcatgctttagttataaaaccttaggttcacctaagactagtttattagaatctgaagtttaggtgttaagtgattatctgccatttaacctttctgtatgtgtcacattatttagtgtcatgtgagtacaccataggaataaaaatacaggagtaaattaattaagcactccttaatttcttttatcaaaatgcacataaaagacaaagtcataggggatatgttacacgttgtattttaatatagttttgatactttgtttattctggaataagaaaaggtcatacctgctgttgctgttttcactggaggctgcagtactaaatgctattgttctttcttaatcagagaaaggttaaaaccaaaatgctgttgaatatgaatgtgaacatagagaaagtcaactgctactactgatatgttaacatttaagcgtgatgtgtgttttttgctcattgaacctgttaaaaaagttcactttatttttccaggtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtaagtaattgaaaacacctaggggctcaggttactcattctttgatttgaatataatagatataataaagaatattttaagtcacatctggcatattgttaaagagcattatatttttaattataagttaattttcatacctgtctgaaaatttaggtttcacctataaaataataccagtcatcttttgtatctcagtttgggaatgttataaactagatacttaggttaagatttcttccttgctcgtagggtctataaaatgctaggtacaaaggatatacaaggtaaaagaaaaggttaaataaaactcattctttgctcactaaaggcattacagtgattcacagtgaaatggagtataaggataaatgatgttaatttttaaagcaccagacatacaaaaaattaatgttaccttttgagtaattttgaaggatctaaaaatcaataattagtaccttacatcttacttactgttttttcctgattttatgttaagtggagtcagatgaaacttacagatgaaaagctttaatctgtagcaagaagatgtaaacctaagggaattgcttaggtgctatttaagtataaaatttccatacctttcactgggtatcatcctttctctgcctacatatctaatgtagtcgttttattctgttattactagttggtcactaaattgaacagagaaatagaattgtggaagtgaaagctattatgttttcagtcctgacaagacgatagtgttgttacttccatcagttttgaataagctataattttgagataatgacagtggaatgtgcaatactgacagataatgtatattcacagcaatataggcattaggcaaaaccaacactggaaggtattatttggataaaataccattttgattgccattgtcttggttatacagcatttcatagcagttaacacccattaaatgtgttgaaatcttttgtgaggtatgatgtgttatttaataacaatgaactttaacttctaaacattgtacaggggtaacattagtaattactttggcttttatatatttcctacataagtgagcattttattattgtatgttcataatttttgtgctgttgtgccaaacatctttgacacaaatcatagacatagcagaaaaggagtgaggtagtcattatttcctcatatagttatgtgtattaaatggaacaggagagtctcttatgctttttagatttaacaattacattttaaatgcatcatgttatacttcaaaagaagtataacttagtcttggatacatccagttgggtgcgccaggatgagttgttaagaatatgatataaaatggttaagttaaaatcatggttttaactgcttgaatgagcatacttaggccaagaaaatgctttgaagactcaaccacattgttatttgttctaataggtataactaaataaagctaaaaagatgaaaatgtaagtgcgcttagatttaaaaggccatctactgatttttaattttctaattttgcaaggaataagtgtcaaagtcatggtctttacaggcagttactgcacacagacttctgagttgagggaaagcctttgagtgtttttgtaacctattagaaaaaatattttcttatgcagtttcttcttgtctgtcttgtaatttcacagtctggctctaacccacaagaaaacatgtatatgccagtatagctgcaacagtccagcagcaccctctccctcttaattctgtaccactgctttagatggggccctattatttagcagttgttcggacttcactttttaaagtttagttgaaactttttttagacctaacaactttttttttgcattcatatattcaagcttcaggggaaaagggaaattacatgggtaactcattaatgtgaatgaaaattgcataaatagttcccttgtgtgctaatgaagtgaatagacatcttagactctctacactaaatgttaaagctagacacatcagaaaatgaagaaaacattccttcctaattagaggcaaatgtatcaaagtacttgttttctttattcttgtgccaaagtagtcttgtcattatacagaggttacccgcagaactatgcaatccagcaaaagaggtttctgtattgacctacctaagaggacatgaagcatataaaactcaaatgactgaattacagagcggttaaatgtaattaagcaaggaaaatactaaattttttgtcctgttttcttagcataaaaaattggagttactaaatatatgagaataaaactataaatatattgctattatttaataactaacatttatataataacaggatatagagtatgtctacatgttatatcacattttaaagactctactagccagtctagtggacagagatacttttctgattactatttcagtaattttaattgaacttgattttgcaagttcaatttattttctccacggataagttttagtggaactttaattcttttcggttgtcttcactgttcatttaattagagagagagaagcaagtgtgttatattaatcccttggtcttgtgattattcaatgcaggtacgaaaagaatatggcaagtgcttcagacactcatactgctgtggaggcctcccaactgagagtccccacagttcagtgaaggcatcaaccaccagaaccagtgctcgctattcctctggcacacaggtaacaaagagtttgacagcatctttaattaaccttatttatagaaaacctactgagacatgttctgttcagatgcactaattgtcttctcattataatgatctagatagcaaatacttgcttttttagtattttggtttcaatgtcttcttaaacatttcttcagtgtttctttatatgtgaacgtccttttttgtggagagttatttaagaagtgtgtcataatcgtcttatagcctaaggccatatagcacaatgctcatagcaggcactcaataaacatatattgaataatcagtgatctccactctttaaagaaagacaataaagtaacatgtttttaagagtggaggattaaatgccccttagttgcttagtaaataaacaatagatattgttagttttagaccagaaaaaacacacattctttaaaaggccaccagataatcctacataggttgtttagggtaaatccttgtatgtctttaataaggtaagtttggggaaactaacaaaacatatttgtcttgctgttttgtattaatagagtcgtataagaagaatgtggaatgatactgtgagaaaacaatcagaatcttcttttatctcaggtgacatcaatagcacttcaacacttaatcaaggtcagttatcaggaaaatttgagttactaccatttattaaagtacatataagttccttttattcaataatgtaatgtaagaaatataattttaaactgcattaacaggatgcggctcgaaggtaattattgaaaatataccttgccacagattaaaaatattatcctagggagtacagatttatcctttctgaccaagacatttatgaaggttttcttcataaaacattaataaaattagaatagttactattcacatgaaacagtaccatggaaattatgaacttttttaacctttctttcaaaaagtaaaaaataaatgctaaaaacatgtgtagtaaatcttcataaacaaaaatacatgaaagtttataaagtaattatttctatattgtttgatgtgtctacagtggcatctttaaatttatcagataaatcagtatagttcttaaaatatgctaggaaatgaagtaatttagaaaagagtatatgcacacacatgtattcttgaataaaagcttaatacattccaatttagtatgaaaaattatatggtattgtatatatccttggaaaggtaatttattacactattttcagtttgatatgtactgatttgtaatacaagttagaatttattacaatgaaatataatgacattttaaactgttgacattgttctagtgagattctcatttaaaatggaaaaaggtgtatgtgtggtagcaatactaacctgaattttaagatatttttatccaaattacattagctatgcaaaacataatcagtaagtatttaaaagtttgtaatttgtcagttagaatgaaagacgtgcatttcttctgttgctttggtattttacttcattctgttggcgatcaaaaagtaaatgcattattcaatgattcatttttgaaacctggcaaataacattacataatgaaaattcttgttatatagaatttgtgaatgatctaataattcattttatagtcttttttttctcagcatgtgtgcttttgcatttactaagagaagctttttgcaatgtgtcatactttctacctgtctgtgaaagttgttttcctcctgctcagttggtattaacacagatgttttcatgagggataatcccacacctgtaaattctgaaagtttgagattccctcttctgggcctcagtggttacgtttttaatattaagcagtaacatcttgaaacataatgttgatctctatgcatttaattgccatttttgtttaacagtgcttttgtataaattagtaaatgtcatcctcagcaggtgtttacttgggggatttagaaagcacctgtgaattactgaaatttaacttccctctcccttctctcctgcaaattagtagttcaaatacagtcagaacatttcaacagattttccattgccaacttgtccactacccttgatgaatataaaaaaaatagttgactacaactgtaacactaaaataagaaactgatgtacttttctctgtttttttgttgttttttttttttactttaggaatgactggcaattacctactaacaaaccctcttcttcgaccccacggcactaacaacccctataacacattgctcgctgaaacagttgtatgtaatgccccttcagctcctgtatttaactcaccaggtgtgctttacttacaaataaaactacctttctttgctgctaaacagagctatgatctttgccctgtttctaaaatattcaagttgtcatatatttattgttacattcttaatttctcagttaaaaaaaattacggtattgtctatgccaggcttctaaaactgcactatattatagtaaaagctcagtcatgatagtatttacaataatgatccatgtttttaacacaggtggcataaatcttaatatattattacaggactgacatcacatggtctgagagcccatcttcaagatttatatcatttagaggtatcctatctatataatatactgttcagttaattctaaagcttgctgacaaaatttgcttctggaatgaattagctaatgaagataatttggatgcctagctatagaaaaccacattcagcctatcaatatatccaaactatagtatagtgcagctttatggtagttttcttttttcttaagaaaaatttcagaataaagttaatattagttagcttatacctatagtttttaattgggggagggggaaagattgtcactaacccatccatatattactatgttgtttaatagcttattttaaataaaagtatatatatatttaatattaacagaattttcaagattttggtaaagttttcacataattactgctagcatataatctttatttgtgatgaatatttgccactaaattaaacacagaacttggtttccatttttttcttaaaattattttttaatgtaactgcagcttctcttttcattctcttgttttttttcactttccttatgctttcctctagcaacctacagagagacaagtatgggagtaaaacttaactttgcctatcaaatgtaaattttttcagcatgatttttaacgggcacaattaaaacataactagcagtcatgaagtagactcagcgggcaagtggttcacaatttgcaactaaaatattaacaaattcaaacagtacatccatctgtactgccttttgtcagtaatggaggtctgtagcaaatgctgtccatacttaagtatacgcaatgctgaaataatttgctctataaagcctgaagtactgtcaaccaaaatgcttaataattgacttatcatttctgcattcccacagtaatcttgctacaggctgtggaaaatcttcaagtgaattacctgaacttgggcagaaaaagataacctcttcaaaaccagtcaaagatggcttaaatctgcagtatatcatagaaaagaccttttggattatatccagtgtatagtgttgtatttaccaagcaatgataaaacaaaagaaaatctttgaaaacagtgaacctctacagaggaaacaaatgctagcaagtgagccatgtgtcactcatacctttaagtgcgaaatggttttttttttaataatcttataaagattatagcacataacatgaatttatgaagctagagaattgtgtctaccaagttaaaggaagccttacaaataactatcacaatttcattttgttgcacatggaacatgatacaaatttgtcagtttttcagatgtagaagttgggacagtctttaagacaatacaaatcactaacaaatataatctctcattttctcatttttttgctaatgataatttgcccaacaatgatcacatatttattggtcatgaagtttgtgtcaggtgatacagatattttttttttctgaaggaaactgcattttctaggatatctgcagctttaagagtggagtgagcactaaaacgggaaatttcgtatttttttccaagaattaaattttttcctaaactcctccaagccttgcatacaatgcagcagcctcacagtggtcagcttcatttcaataacatcatttcattctttttttttacagacctatctgtagactgtgatttttttttttctctaggattttgagaatgaataacctaactttccatggtgcagaccatttaattttctcttgactttttttttcatttgcttgagaagcactgtgatgtcttagtttacatgtttatgtgtctgtagaaaatacaactctgattcaaatagagcatgttaccatgttttatttccccctcctaaacctcttttcctatcttcagcagacttatccagtctttcattcctttagagataaaaatatattagccaaggctgccacccttctcccattccatagttaatatttattcttggtttaatttctgtgacccatacttaagaaatctctaacatttctgcgtttgacctccatggccatggtgtctgtgggcctatcttgtacagtggactctgctggttcattcggtgctgtcactgtgactgatgcagactgcagggctgcaggcaaactttgaccactagaagcctggggccattgctattagagagattattagtaccaaatactcaaaataataaatattaaatgaaaaataaaaggctgctattgctggtaatctaatttgttgaacccttgctctgactaagttgctgagaagcttagaaattcttcatcatgttacaataaatcattttactttcttttatatatcagctactcttaggccagatagcctgagcagacagacatgatgtgagttgtccaaagtgagtcattccacctgctgtctatcgtgatgttggatggtgcttgtgggcccctggtccagtcagtatgagagatggctgtctttgtttaacatgacttctttgtatctgtccatgttttcattcttttttttacttcatctccagaaaaaggaaatgttagaatgttgtttaaaaagttgcttgccagttatgtgggtttatgttgtacatttgcctttcagttttgtattgtgacttactcctttttaatttagtgttgtttaggacaaattctgttaattttatttttataaaccatagtcttgtactttaaaatgtaaatgtcactaatgaattgctttgcattaactatgcaagggcatggagtgaagtcttctttgtgtcagagatttgaccaaaatcaattaatcagtactgtctcctgaaattgataaagtattactctgtatgccattttctctccctggaaaacagtattatttttaacactttttcctgttatctaaggggttgcaactatttacagttgggaatgcaggaaagcctggcacttttcaagtgttagctttcaaatacaactttgtcctgaacgacattaaaaagttttgtacaaaagaaatagagtttctgtggaaaggaacagagacagtaatgataactccccctcttctgtttcaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagta

SEQ ID NO: 2319 - DNA, 12382 bp, Homo sapiens
  source 1..12382: mol_type = genomic DNA
cgcgggggtataacagcggcgcgcgtggctcgcagaccggggagacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccagggatagtccccggggaagttccaggaggaccccgcccctccagatccccaagcccctccagccttccccaactccctccccacaaggagccaggggcgtccctgatgacaagttagaagttggtccccttcccccagccgtccccacacctcacccccaagccaagggaatggcctccaggttcccccagccccaccctcaacacccctacaccaccacctgactccaccacaagccgaggagatgggcgtggagctgtccaggtcgccagcgcctctgcctgggagctccaccctctagtcatgatggagatgggcaggccgcagggtgtgggggaccatggcagggaccctcatgccaccccactgcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaaggtgggtcctggtggactcagccatgctgggggcctggggcagctgctgtcacctgctcagcccagctggactggaaccggagtggtgtttgaggagcccgtgggtgatgttccaggaccgtcttggatcctaagaggcaaaggggccaggcctcacctgtctggccaaggtgtccagttctggggcccaccctacccctggagaaaaccctgaggttgggaccctgctcctgcccctgagctgcagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggtaccctccctgcaggggaagccagccagggtctccagtcttcccgggcttccccgggagcccacgccccctccccacccgggctcccacccactgggtgtggggccagcctgcctggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagccggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 2320 - DNA, 32736 bp, Homo sapiens
  source 1..32736: mol_type = genomic DNA
cggccgccgagccgagcagcgccgcgcggggccgagtggagccgagcagctgccgcgccgcgtcgccggtttaagcgcagtgcaggccgcggccgggggcggcggtagtgagcccagcgctgcgctccagcccccttttccctccatggtttctctccgctcccgtgagtaacttggctccgggggctccgctcgcctgcccgcacgccgcccgccacccaggaccgcgccgccggcctccgccgctagcaaacccttccgacggccctcgctgcgcaagccgggacgcctctcccccctccgcccccgccgcggaaagttaagtttgaagaggggggaagaggggaacatggacatgaagaggaggatccacctggagctgaggaaccggaccccggcagctgtaagcagagacccctctgggtgccctctcccccgatgacttgcatgtaatggtggccacctgcggggcccgggctgagggttcgccggccccggcgcggggaagagcgcagctcgtgggctcggacggggaaggcgggcgggcgcggaggggggagcgagcgcgcgaggattaactctttgccgcccgcgggcccctggggcggccggggggaggcagcggtgtgggggaaagcaaactttgagcgcttcgcccgccggggtctttcccctgagggagcgcgtgtgcaagtggccggcggcgagagagggaggcgggggttgtgtaacgctgggagccatgtttgcagcctcccgggatgcgcggccgggcggaggcccggcctgccgaggagctgcgcggccatccccgcctgggccaggccgggctccgcgcgccccgggccggccggggaaggggcgcgggtggggcgggacgggggctcttgtggccggagctcgccgtgggcgccggcccggccgaggtcagcagtcgtggggcgaggagggggcttttttcttttgaagggagcgagaagccccctcgggcgcctggaggcctgggcgggcgcggcccggcgcgcggagcgggggaggggcgggccagggcggcggaggtggcgcaaccgccgcccctcccgaggccaagtttgaaaaaaggacgtggttcccgccatttttcaagcccaaaaataaaactttctcccccgttctctcgctccctcttcgccctcggccttgcccactcctgcctcccaggggcagcccgggtcgaccaaggccaaccgttgtggcgacggcctcgcccttccccctgtgccgcggcggcggcgcccggggcccctgcccttgccccgggaggctggcccctccgtgtgggcgggcggcggctcttcacgccagccggggcgcgccacaggccgccgcagcgccatgttggcgggtgcccgtctccctgcgcctggtgagccggcccacgagcttggccttgcccgcccgccctcggcgctggctggcggccgcctcttcccgcgccgagccctcggtctgtttccccccgccccgccggggcttggctcccactggcgggagccgcgcgccgcggccgccgccgactcatcccgtcgcgggcgcgctgccgaccccctcccccttcttaaaagggcaacggcaggcggccgcccccgccccgcgccgggcgcgcgggattttgggcgggcttcggctcggctcgtgggccgggcggcctctggcctcccacgtgcttgagagcggcctggtgcggtcggccgcgcgccttgcgggctgtaggggcctgagggcggccctcttgcggcgcggctgcgtgggcgtgggtccgacctgtgggaattgccccattcgtctcccgggtttagcgcggctgcccgccgtcgcgagccccccccccgccgcggaccggcgcgggccagttagcgccgcggccgggtgccccagcgggccagtggctttcccgcggagggcggccccgcggggcctcccgacccgctctgggctaagcgagcggccaggtttcgtgccctcaggtggctgtggttaacaagtcgcgaacttgtgggaattcgtcgaccagggtttacctggtgtgctcgacattttaaatccttgctctctagtctttgaggtcaccactaacgcggggcgggccgggctccaccgcacggcgctgtccttcccggagggcccgcgagggtgggccgctccgggggttgcgagatggagggtcgcgggcgtgcgttcttccgaccttccgtcagacattttgtgcccgccacgtgctagcctatcgcccagctcgcgcctcaaaacttgagaggctttcttggcttgagaaggtgtttattccagacttttccattgcggcgtaattgcaaatccgtagaatatggagtagctaaaattagccaaagtgcccgcaagagaagtacacacgtgggtcttcagaaatgcgttaaaatctagaatttgaattctttaggatatgctcaaactaaaggtcttttaaaattctcaagagtagtgttccctctgggaaacacagttggtctgctgttccccttagaggatgttttcatatatgaagtaatattgctttaaaaacacatgtatatctacaggtgttcatttttcttttttctgtttttcttttttttttgagactgagtctctctcttgcccaggctggagtgcaatggcactatctcggctcacctcagcctccgcttaccgggttcaagcgattctcctgcctcaacctcccgcgtagctgggattacaggcatgcgccaccatgctcggctaattttgtatttttagtagaggcggggtttctccctgttgttcaggctggtctccaactcctgacctcgggtgatccacccgcctcggcctcccaaagtgctgggattacaggcgtgagccaccgcccccggccaccagttcatttttcaagtaatcagcttaaccttcttgccagtcaggccagagccatttaattcagttaaattaaaacattttctctgtaatactatccacatttcaagtgctcagacgtgacaagtggctcgtgggtgctgcgttaggcagcactggcctgcagaatccactggtttattaagtaaacattttaagcctgagaaaccattgaggtggtgtggtgctttttgcacttgggagagttgatgaggccttgagagagtgttgtgggagccagctaagattgtgggggtagaggaaggttcccttagggagactgagaccagtgggagttaggtacccagttgggcgaataaaactttgacctaaaagtgaagggtttttcaggaaaaaatgctgtagattttgaaggaaattctaaaagagagtttaaagtgttttcgcacagaggcgtcatccttaaggcaaatgaaaagtttggagatcactctcttaaaatcacattcagctagtcacatgataccttatgtgtgatgtgctggaacatgccataaacaccacagaaattgatggcattgtcagctgttacacagtaggcttggcctctgggatcctgcagacttgtcgtgtggggtaacatgaagaatcgtttcccttgttgaaggtatactgttgttgtatgaacaggatgccctgaaatatacagcagtgtcccatggttgaccttaatgattttaaagtcaagtgagatttaagggtgtttgaagagggcgaataggggtttaattgtaaatatgttcttacgtttaagaccagatgggcttttattgtgtatatggcttttttttaattactggggtttgaagaagaccctagtaacacttttgttcagttgggctcttgtgtgttctgaccaaggaagacaagaaggtaaacacaaaagtgttactagggtcttcttcagttcacctgttactatatccctattccttataaacacaagtatgcccatttccctaagggatgggggcgagggattgtaaagaaatacagaattttatttatttttttctaagtccaaaagagctcttatggcagggtatattctcatagtggaacaaaatggcctaagatggcattttaaagtaatcttcatgaagaatggtggttaccatttaaaaacattttatagacaaggataggagatagtttgtatgacaaggaaatattttatataaaatattggcagttcactgagagtaaattgaacagtgctagaatacaccatatatacaccatggaaattggaggtcttgtcagtaaaatgagaagacactgacatgcagtagctagatataaaccacatttagttgtattctaaaattggaaaagaatacctgttctttatgtgagattcttatccttccagtaaactgaacatgtcgctctgttagaagcacctcattaaccacgcatctggggacagtcagccttcctatcagctctgagtttttcattcaaagttagaaagccaagcagttccttactgtggcttgcagtctatgcacctgcgaaatgctggtgtgctatatgctggactgtgacatttcatataccaaaataaaagtctttacgtagtcccaatttactgagaaaaaatgtagattgtctttaacttccatctttttttgatccgcaccccctccccagcttttgacctcttttgttgtgtctactgtgatgtaattttgagctcaattggatattctagttggttgcatagcaactaattggggtttttttccttgtataagtaatacatcttcgtttaagaaaaattagatatagataggccaaaaaattgtaggtatagacaagcaaaaagaagatagacatcatacatgcctaacgtaccatctagacactttagtgtattatagtctaccagaatgtttaaattttttctaaacttggttcatgcaaataatccaaatgctagctagcttgttgcttttttttttagaaaaaaaatacagtcaacatctttgtgtgtgtccttattttatagactcattattaatgtctgcatagatcataatttaaacatccctctcaggttgttcacagggattttggctgttttaaatactgctgaaatgagcatcttataatgtgatttttttttccatctgccagattgcttttcagaatggttcccgtctttaaatacccaccagtagaatattggtgtttccttccttaatgccagcagtcgtgctacctaaacacattggagaaccactaatagagatccgttccaggctgggcacagtggctcgtgcctataatcctagcactttgggtggcagaggagggtgggtcacctgaggtcagggattcaagaccagaccgggcaacatggcgaaaccccgtctctactaaaaatacaaaaattagccaggtgtggtggcaggcacctgtcatcccagttattctggaggctgaggcaggagaattgcttgaaccccggggacagagtttgcagtgagccaagataacaccacttcactccagcataggcaaaagagcgagactccatctcaaaaataaaaataaaataataaaaagttctattaatttagaaacattattttaaaataatgggtagaagatttgaatactggttaactcagaagaatggaaattgcaaggatggcaggaattactttctatattttgggattatttcacttaccataataaccagtattgttctaattaaaagaattgacaactcagaaagatctttaattcctccataccctttcctccttttatggcagagacagctggtataattggagagcatcgccccaccagttaggtaaagttgatcttttttcataatagctaggggagtggcaaatgagcaaattgaagagaatgaaaggaaaaaaaatgtttccatctcctgtggcccccagctccaatccccagggatattcccatgacctagactcatcataacttaaagaaggacctcataggcattttgccatttagaacttaaaatgtgttttgtttttcatagaggtagtgttataaatcattgttatatcctccagtcagatctgaaaaggtatttggctgcaatatagttcaaatttttcaatgaaaaagtagtaggaaactactgtttgctggtaactgtagaaaacaaatatgagttaagtaggaggtagtatggatttttcatttttaagtgtttaccttaaatttgtgtttgagaaaaggcaagtttaattggagcatgagggaagaagaggagtgaatttggccccaaaagttaaactgtccatcttcaagcagaaggccagttaactcttggatcaaatagatccctcagatttaagcacaaatgaacaagtgcctgcctaactttcttcattagatagcagctctgggaggatttgagatataagaagaaactagggccttttctcctttgattaggacctctggtttattctgaatctagattgggaagctgtgggatcatcttgaccccagctccactcactgtctcaactacactcttccaaagctgttatctcctttgcaaggcagtctagatctctatacccaggaaggaatgaaaagagatgaggcttagttacctctgtggagatccactgagaaccccagagttgatataaagattgttttaaactgaagagatttgagattcaacagatgcagagagaagcctacttggagtttatctggctaaaagcaaatacatgtcacaaacgagggctgacataaattctccctttggagtgagtctgttcccaggagagaggccaagagtaaacctctggtaggggttggaggggtagtcttttggccctaagaaaagaaagaccactcatacctatgtagacagacattgtaaacttgatctctcatttgttctgaaaataccatttgtgttccctaaagaaatctgttcttcccaaaaggtttttctcctgctgtcctttcctcttctaagttaggtatataagccctaaattctaactactcagttatcactgagtgtgagtgcacctgtgtatgtgtgttgcacatgtaaatacactttttctgcacctcaaatgccacttttctgccattgaaacaatatccgagctcagaatacctttcatcaaggtcctgttaagaactttcaacaaccttgaagttggctgatggaacatttagacctgctatccttgggtacagccctaagtggggccctccagtggtctctgctttatgcagtaattcccattctcctctgtgcttattccccagtgactcatcttctcagtatgcttctggcgttctgttcttggggtggcatgtttctttacattctcagcctttctggaaaagtcaagggacttgccttttctgcctagcccaacaactctctgccctatttatcccagtatatcttattgcctcttactggtagaggcaattaaaggtctcaggtattcatttcctgaacttctcattctcacttaacaaactcacctacatctgtgtccatcctagccatctctcttgaaggagctgtccctcctccaacaagagtagaatgatacctcatttttaatatgcacttttactgcttacagttgaacctttttttttttttttttttttttgagacataatcttgctctggtgcccaggctggagtgcggtggcgcaatcttggctcactgcaaccctccgcctcgcgggttcaagcattctcctgcctcatcctcccgagtagctgggactacaggtgcacaccaccatgcccggcacatttttttgtatttttagtagagatggggtttcgccaggttggccaggctggtctcaaactcctgacctcaggtgatctgcccgcctcagcctcccaaagtggttgggattatagacgtgagccaccgtgcccagccaaactttttttttttttaactgggtctctgtggcccaagctggagcatagtggcatgataatggctcactgcaacctggacctcctgggctcaagtgatcctcctgcatcagcctctcaagtagctcggaccacaggcatgcaccaccatgcccagataattatttattttttgtagagacagggtctccctatgttgcccaggtgactcttggactcctgggctcaggtggtcctcccacttctgcctcccaaaatactgggattgtaggcactagccactgcacctggccttgaacagttttttttagtgttggctatttgtgtcttttagagcttgtctgtccttcgttagtgtttctgctggggtatttattttttcctcacttagggtaaaaaaaatagaagatatcctcaagaacaagataaatgcaaatagccagaatttccgtaatcgagaggttacaaaaagtaacagtcaaataaatcagaaaataattttgtggcagttaaaatgaactactcatttaaaagagaagttgacattttaaataaagaactcttaactaataacacactcagatgtttgtattctttcacttagcaatggattctgaaaacacagtcctaaatacagaagacattttaagtaaagatatggcattatttatagtagggaaaattgagcacaaatgttcaacacgaaggattgtaaagtgatttataatatatccacacactgtgctttcttaaaaaatactctgtgatcagaaagttggtcccttttatgtccaggttttcatcttagtcccccacaattgtgacacaaacctctgtacaatattgctgacaaacctgtgaccgtttttttcctcattccgcagttatgtaggctcttacacagtgatatagtggtaaccagaatatacatgatcctgtcatcatgaagcttagtctagcggtgactttttttttctttttctttttgagatggagtctcctttttcaccgaggctggggtgcagtggcacattctcagctcactgcaacttctgcctcccaggttcaagcaattctcctgcctcagcctcccaagttgctgggattacaggcacacgccaccatgcctggcttatttttgtatttttagtagagatggggtttcactgtgttggccaggctgtcttgaactcctgaccttagatgatccgcccgccttgacctcccaggagtgttgggattacaggcatgagccaccacgcccagccagcaaaaacattttttaacctgcatttgagtcctgtgatactttctgatgacgccttgcagtggttcaagtggaattttgcaagttgaaagaaatgtctttaagaggtgatttcactctgtgagctgagaggcagtgtggctaactcttaattcttcttcacttcacttttggcatattggtgtattttgtataacgtttttggattattttggataaaattatagaaactctcccaagctaaatgggaacattttaattgtattgcagtatactgtttacattggtgggtgatgacagtcgacctttttaaaattttaatggttcgttggttttatgtttagttgctttttaatacagaataaatacatggttgtaaaaaacttagtacagatataagtaaagtaaacagcaaaggtcactgacatttcccattccctttacccagaggttactttctgggcatttataatgttccaagccctagtctctacaacttcatgaggtaggtactattatctccactttatgggaaactgaggcacagagaagttaagtgactcgcacaaggtcgcacaagttctgagtggcagaggtgaaccaggattcaacccccggcatatgtctccagagcccagcttttgtcagagttgacctattaagttttcagatgtgcccatttcttatcagaaaagggaagaatggcagagatacctaaagaaaagtggaaggaaggaagaagtaagtggatgtaaagagtaaaaaggatgcctggcttctgaagaggaagtagacagggtagtgagaagcggttaggcacttactatgttgtgggcattgctgacttgaaatctgtttccttctctgtaaatgggggaaggagagtggtggtaaaaagaataaatgattaagtactctataattgatagcaattactagagtagcatcattggattttgtatgagaggatgaggacactgttaatagctcctcttctcttttcagactgtcagcatctccctactgtatacatgcttgattaatgctattaaatatggtaggttcactaaaagaatgcctttgttggtgcagttaaaatggtaatttgcatcactgtgagtagatcaaagtgagctaaaaagttgcaagtttcaggatgatcatagagcaagaatggcaatatggattattgtggtggatctgcatgtagactattaaataatcaatattcaaaagttcaaatcatcagatgtgatactgtttttgagatggagtctcactctgttgcccaggctggagtgcaatggcgaaatctcggctaactgccacctccacctcccaggttcaagcgactctccagccttagcctcccaagtagctgggattacaggcactcgccatcttgcctggctaatttttgtatttttgtagagggggtttcaccttgttggccagactggtcttgaaccccagacctcaggtgatctgcccacttcagcctcccaaagtgctgggattacaggcgtcagccactgcgcccggccagatgtgatactcttggatggacttaaattctgaaaaagagactgtgtagcctgaaaatgcaatttaatttattatgtagcagttctctgctagaaacatctttctcaagtgcaatccagattgatctttgttttgaattaaggactcttgcatcctgattttttttcccagtgtcaagataatcttggcaaagattactaaaaccagagttggaaagtgcgttggtgcagaaacctctagccagaatctcttagtggtcttgataggaaacataaagctttcctcttttccaggggtcatcttctgggccttaaggtagacccagcctaaagagtgtcttcattctgcatttgcatttagataaaagctgccctttggggaacaggctggagaaaagaaataaggggaatacgcttacttcacttatatcttaaaaagtatagtttctgtttctggaaaaacaaagagcgtaagtgtttatacccatggaataatattccatctttgaacctgtcagtatattgttactgaaggcttaatcagtttttatctttttataactatgatctaggtctaagtaagaggctgcctgtatatatgggtgtttttgcaggatatttatggtagaagtttctgcattgttgtttgttttcaatgtgtttttgagagcttatccttttttctttgtcatccacaggttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaaggtaagtgctttttctttaacagtaaaagagaacgatcctgggaagggaaaatgtatgattttacctgtaaggaagcacttagtgtagcagaaagcacatggcctttggaactgggcagatatgggattgaattctagccctagcatttccttgatgggcaaacttctgcaggttacttaatctctctaaggcccaatttcctcacctgtaaactggtggtattacttgaccttgcagaattgctgtgaagtttggaaataatgcatgttgggtgctcaataagtagtagttaggaagaataattactgtgttgagtaatttatttgttaattgttataaaaacaattctctatcctttcggaaaaagggaccaaatgcaacataaaaatgttttctcttgtcactgcacatttaactgtcacagagtcccagaatgtcagaactggaagaaactttgctcctctaacccaaccccttattttataggcacagcaatagtcccaggaaagtgtagtaatttgcctaaagccacccacagaagtggttagtactagagccaaaactagaacccgtatctcctaaccccatacccttcccattatataggaaaagatatgtggttatataagtcttgcagaattctctgccatttcaatattcgctttactaggaaagttaagttgtacctttatttaaactaaggcacacgtagaaggaaactaatcaaacttgggcaaaggtaggttgtgcctagagcttgcttgagttctgagtgggacagttagttttttggtattggggtttgtttgtttgtttgtggttttacagcaggtggagtgggttaagtataatacatgaggccagtcatggtggctcacgtctgtaatcccaacactttgggaggccaaggtgggaggatcacgtgaggtcaggagttcgagaccagcctggccaacatggcaaaaccccatctctactaaaaatacaaaaaaatcagctgggcacggtggcacgcacctgtagtcccagctagtccggaggctgaggcacaagaattgcttgaacccaggcggtggctgaggttgtagtgagccaaaatcacaccgctgcattccagcctgggcgacagagcaagactctgtctcgatttaaaaaaaaaaaaaaaaaaaaagtataatacatgaattaaaaactggaagtattttttgttttgctttctttatttgccttgtttaggtaatattaaatgctcaagcagtcttcgtgagtttcaggtgaccgtttctgatgagaaagaaatttccccttctaagtatactagaggttcaagtataattcttttatatttgcatgggttatcagtgacattggaagctctgattagcccagttaaacatagtatagctttttagcatctatttacataaacttgatgctagcagatccttagtgtgtgttttgtgttgttttcctagcattctgatttattttcccaaattactgttggtctctgtactctcagacttattcagaaattcagcctatcagtgaccgtttttatagggactttaataaacctttcagaattctgaatagagcttgtttgagttctgagaaggacagggtttttgtttttgttggttttgggtgggagggcacgttaagtacacaaattaaaaacttttaacatttaaaacattaatcacttcccttatagggctaatgagagggaatcatacttaaaggcaggttgagtgtactcatgattgataagaactttattttcttcctattccagaacacaaattggttttgttttgttttgtttttgagatggagtttaactcttgttgcccaggttggagtgcagtggtgccatctcggctcactgcaacctccgcctcccaggttcaagcgattctcctgccacagcctcctgagtagctgggattacagacatgcaccaccacgcctggctactttttgtatttttttttttgtagagatgggggtttcaccatattggtcaggctggtttcgaactcctgacctcaggtgatcagcccacctcggcctctcaaagtactgggattacaggtgtgagccaccgtgcccggcccacaaattgtttttaacaagaaataagtactgaaaaaaaattgatgtgtaaatgtcacaaattttctaaatttacacatctatttcatttcaaaataaatatgctaataaatgttttggtagactgccttgttttggtagattgccttgttattcctactccctaagatacacatgttgaaaggatgtggatgttacatgtgtatgtgatattctaaccacagggtctaaaacatgggttaagaaaagttatctctgtttttattttgatttactaaaatcaccaataaagctaacacttgactctattgattatgggcttatgtttttaaacctagaccatgactatttcactgaaatatcccattgaaaggaaaaaatgttttgaaatgttacattttcttcttctgaaatatttaataacaccttaagcagctgacctgtttttttaactgtttttcagcagatatttacatttttaaaagttactctactctgcatcatatagtacatttcattgcatggcaaaaacttcattacatgaagctttcatgctattctaggtacgtagcataataatgaggacatggatatttatgaagccagcctgcctggcttcaaatcataggcccactacagtaacagctgggcgatgttgggcaagtttattttcctcatctgtaaacaggagtggtaattctgcctaccccatagagttcttgtgagatcagatgagttaaggtatttctagtgctttgagcagtgcctggcatttaaatactatgtaagggttaaagttactattgttgttggcactttaaaatagagaatcagaaccagctgtgtagctgagttttcttgtttgcaaaaggaagagcttgaattagatgttcttcacaatgctttccaggctccaattccttctactctaagattctaatattccttggtgaaggctcattccctcattggcacattacttgcctgtgctacttgacctgcagcttagaaattagagtaggttctaataaaggctagtgccaggtttatgcaagatgtggcctccagggagctggtttcataaacctgaggctgttgacctactccctttcctgaggttatgaagcttctttatgggcttacttgtagggcccgttcctctcttgtagctttcagagcaacattccctggtggcttccaggtgtagaactctacagtgtatgtcagtattgtccagaaattaggtttcaagtgggcattgcaagctttgaaggcacacaaaatatgctgctcagaatgcacagactattaaaccatttaccctttctggcaggtatagggtattacaacttgtcaaaggattctaattggttttgacccactttttaagttagaaaatttatttgctgatgttagagaccagttcttgagtaagctgttattagcagctgattaggaaaacacaatacttctgaccttaccttctcctgttaattatttggatttaaacaaaatgaacatgcatgccctaatagaaatagggatcatttgatcttgataaatctttgagaactgtatttgttacttacaataccttaaatgatttctgtttctctgtgtgtatttgtgtttgtgttgtgtccattttctcttgcagcttgaactcagtgaaaatagaatctttggaggtctggacatgttagctgaaaaacttccaaatctcacacatctaaacttaagtggaaataaactgaaagatatcagcaccttggaacctttggtaagtaactgagaatttggaaactggaacttactggtcattttcattttcatatttctttatagtgggggaaattactggcaataataattggttgagaaagtggtggctttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccgaaagtggtggctttttactttttatgtaagtcccaattttaaagatcagggcctctctaattagatgtatttctgtggctttgctctctccctgcctgatattgtggtggcatccttcagaagagaatttttgggggtattttgttttggatccacttttgaaattcatgtattgactatatagccttaaacatgttcttaacaatttttttcttcagactggccaagccattatgtacttttacactttaacagaaaaggctatttatgttgtgtggcatacctgaattgtagatggaacaaagacagctctattttaagctttgggtcgtgtaattcatgatcttgtgttctagctggattacagttgcctagagttttgcatggaaacgccaagatcctcctcagtcttacatattgggataagatatgaaaagctgagtttcagtgccacttgggttgtagacttgatgtgtgaccttgggcaaactgcttcttctctctgggcctcagtttcctcacttatagcagggaggataataatccctgccttacttacctcacttaggagttctgagaataagataatgtacttactttgctttgtaagttaatgtacttattttgctttttgtccagtttgtgtaagttgtagtggccagaaaagggcttccagaggcaggactggaggcagggggcttaatgcagtttgtagggcagccccacaggctgtgctatttggaagagggttatttagcatataggaggtgtctttgagaatccagaacagacactagagggtaagacatttcttctctgttgtctctattctgatgtcagagtatattaaaataagtggatttcacatcacttgtatagaatgctctgttgatacttgaggggaagacagttaaattgtagcttcttttaatgaagaggacttcctgtcaagagttagaagatcttttccttcctaaacaattattgagactgctgcaatacagatttaattaccttttactgaatctctttgtgcatgtgtatatgtattcttttagagaggtctcactatgttaggccaggctggtcttgaactcctgccctcaagtgatccttccatctcgacctcccaaagtgtttgggactacaggcctgagccaccatgtccggctgagtctctttatttttacatttctttaagttgtccatatttaagagcttatttctcataaatgtgatgcctcaccagtgctccatgcattttgccctttttcctattacaggtatacccagatactcgggctcttactagttttattcgtttccttcaaaccaacccccatttccagtatttaagccgacatttactgacttttgctgcatccaaggacatgaacatttgcccattgtatccttaagtaacccagagaagagagaatgactgtcctctttttagagatgaggaagctgagtttagagaatgtagataattgctcaggagaaatggcagagtagggattcaaatctaagtctaggctgggcacggtggttcacgcctgtaatcccagcactttgggaggccgaggcgggcagatcacttgaggtcaggagtttgagaccagcctggccaacgtgaaaccccatctctactaaaaatacaaaaaagtacccaggcgtggtggcaggcgcctataattccagctacttgggaggctgaggcaggagaatcacttgaacccaggaggcgaaggttgcagtgagctgagatcatgcctctgcactccagcctgggtgacagaacaagactccatctcaaaaaaaaaaaaaaaaaaattcgaagtctgctgtgttttccatagcccttgggacctcttcttctctttccacctgtaaatttatttcatgcccaaatttccttaagctgggaattccaacaggagcaccaaattttaactgctgatgctttcccgttcacatgggctacactaagcctttgtttattggttagtgacagacatactaatcctaggttgtgagcataagaaacccttctccccgccacccccctttttttttctggtttaattttttttttttttttttagacggagtctcgctctgtcacccaggctggagtgcagtggcgccatctcggctcattgcaagctccgccttctgggttcacgccattctcctgcctcagcctcccaagtagctgggactacaggcacctgccaccatgcctggctaagttttttgtatttttagtagagatggggtttcactgtgtttgccaggatggtctcgatctcctgagctcgtgatccgcctgcctcagcctcccaaagcgctgggattacaggcgtgagccaccatgcctggccttctcttttaatttttaaagaacagagtagcaggcagtaccttttcactgttggccagttgatgactggccattacctagttctcgtggcagcctgaatcctctgattatcagaagcctttttcagtgttgtagcacacagcaatggagcagaagcaaatactgtgtgggagttgtttgcttgagttttttcctgatctggtcagtaatgtatgagaggaccctctggtggctgtgaaagtctcagtcccccaggatagtgaaggataaaaagtaatcttcgttgtgttcaccatttttagaggatctgctatacccatacatttactgggtgctttatgcatgttttattagtaattgtaaaaaaaaaaaccttcgatacaaagtggatagaaatagcatggcccttgttttatattgaggaagctaaggcttgggtgaggctgaatcccttgtccagagtcacacaccctgtggcagagccacagggctacacaccagagctatttcgaaaagcctggggtcccgccattctgctatacttggcactcagattcctggcggtgctaggttggtctcctgaagttctaacttggaattaagtaaatctgtaggagaaggtgaaggggggaagagttgggtccattttgacttctggcagtattcttcagtggggaaaaacaccatcctcatcctcattaaccacatacattttgaacaccgtctactttgagcccagttcttatagtcaatgcaatgattgtgaatgcctctgcttgctacagggacattaatcgagagacaaagaaggcatcaattcaaacttccttggacaccttttttaagagacctgggccatccaaaccatcccccaaagcccttctaaattctaagaaggcaagcaaaattattgttaataaaatgtttaatgtttattatggctagcctattagcttacatcaaatttctggtatggtagagttgtaattttttttaatcagtatttacacattacattgggatcctgaataatctgtgtgtagtgtattttgtgcctattgggccttaaagcacaattttactactttcagcagttccagagtactacagttatttgggatttttgttgttttcttgctttcatttcatttttcaaactactgattggcatgtccaaattgtttgagaaggggtgctttgccaggaagtagccaaaaatctcacataattgtacagtttcagaaacaggagagccttggaggccctgtgtactggaagagtcaatgaaactagatagagaaagggcttttggtattaaaaagcattagataaatatcagaggttgtatgtgtttttgtgcacctatttctaggaaataattctgaaatataaatggctcattcctttaagtggagaatttttagagtgaacctttttggaaaagctgcctaaagctgactctagctggcatcgagtcagcctttgtgaagagaaagccagtatgctagctagccatctggggtggcattgcagcatttttttcctctttggcaagaagtcatacctgggcttctggaagtcagggcctgactggaagggaagctaatctgaaaattacatgatacaaaagcagctctatgaccagaagggctggggacagctttcttaaaacgtcaaggaactgactatataagcacattgtttgatccacagactcttggatcattgtacaatttgtgttttgaggggtgcaacgttttcctgttgctgtaaccctgctgtgtgttccctgcatgaataaaacaagtgtgggagcctctttcttcatcaagaagatgaagttcttcatgtgcaggggtcagtagcccttttctctaagggccaaatagtaggttcatttggctttgtagcctgtttatatagtctctgtcacaactagtctgcttggccattttagtacataaggagccatacataaataaatgagtgtgactgtgttccaatggagcttattttacaaaaacaagtggtgggccagaattggccactggaccaccggttcccaacccctgctctagagccttgaggcagattttcacaccattttatatctcctcagaactacatagataccttgagttctgaaaataaggttttgttttgtctgcatttcttctcaggtccttgtgagtgttgtaacagctttcctaataaagcagcaaaacctgttaagcatcaacatttatttttttagaaattattttatgtggaggtcctcttaaagtttgtttgggtgtttttagtactatcttcttagagaataccgaagtttttctcttgattcagaaccattaaaggttgtgtttatgaagctatccagatatatgtagttattgcccctattctgaaaggcaccaggctatgtgctacttcacattggatttgcctttcataggctgctccctcttctatctacaagggtctgctgtcacttcctgttgctgtctcctgacttgcctatagtgtagtacctctgccctctcaatctcttaatttacccttaatcaaaacttaatagacctgggattgaaatactagtacactgatataataacaaatgaagatctgagtaaatacatagacattttccagtgcactttgactactcagaaaacttgacttgggccaactttttatagcttaactgtttttagatagatgaaactgatggttccaaagaaatgaggtattgcaacaaaatttcaaggtatggtaaataaaatcagaagaactttacatcataaaagtctggtaacatgtcagtcttttccccaaatactaaaaaagaagagtgcaatgtttctccgtatttccgaagtttcaactctgcgcccctctgctttttcctcagcccatattgactcctgtcttccctgaaagtagctgcattgccacactttatattttattatatttcatcctctagtgtttcatgtctgtgccctaactaaaattgtaagcaccctaagattgtgttataaatctctgaatttttccctatactgccaccctagaacattaaagaccgcttgatacccaggaagttcttaatggccatttgattactcaaatgttaacatttgtttcagctaaatttattaaactgtttgattgtctcatactgtgaaaatacctggatttaataaaaattattttcaatttatatttctttagactactatgctgccagaaaaacacatagttctctgggagagtagataaaggaagagagggactaaagtctagtaacctaatataaaggttgcaaaagacttgatgtatttttctatatatgaggctgagtgggtagtggaaattgaatatagagcctagaattttacctcttcaagagatggatttgttacttatattcctttggtttaggagttgtggtttttgatccttttcttcagaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaaggtgagtaggctcagcatctggtgaacctgatgtctgcctttcaaagcctctgataaaagctattggatgttggccgggcgcagtggcacacaaccgtaatcccagcactttgggtggccgaggcagggggcattgcttgagcccaggagtttgagactagcctgggcaacatggcaataccttgtttctacagaaaatagaaaaaaaaaaaattagccaggtgtggtggcgcacacctggagtcttagctactcagaagactggaggccgaggtgggaggatcacttgaacctaggagtttgaggctacagtgagccatgattgttccccactgcactccgtctcagaagacagacagggtgtctcaaaaaaaaaagctactagatgttcttactattgaggaaaatagtgtgtgtttgtgtgcgtgcgcacgcgtgtattttttgaatgtaggcattccattaaatttatagctaaggcctatttcataagcacctggcctcaagggatcctcccacctcagcctccccaagtggtgggattacagggatgagacactgaacctggcccgggaagcatttcctgaagtctacaagctaagttaggatgctgtgcgtttaaactgtaaaccgcttgctcttacaggcttgccactctgctgttcttaagtcttcctacttcaggggtcttcaacccacaggccacagactggtactactccatgacctgttagaaaccaggccgcatgagcagtgaggaagcctcatctgtatttacagccactccccattgctcacattactgtctgggctccacctcctgtcagatcaatggtggtattagattctcataggaacgagaatcctattgtgaactgcacatgtgagggggctaggttgtgtgctccttagaagaatctaatgcctgatgatccgaggtggagctgaggtggtgatgctagagctgaggtggtgatgctagcactggggagtggctgcaaatacagattaacattagcaaagaggtttgactttacagagatgataataaatcaattgcttgcagactcatcaacccctatctgtgagtggcaagtgacaagctgcatctggtggcaggctttatagtggcaagtgagttggtgtacttcagttgtacagctgtatctggtgacaggctttaagtcagaatctgatgctttttttagtcagtgcatggcctgcccatttttttatttaccacttccatccacacctctttcccgcactgcgtatttgtctcagtcacagttttgttaggcccacaagctaactatccaacatgagtaaaaaacgtcgctggagagcttctttgagaagggggaaagacccaataatgagacagcagaagacaagactgccaatgaaaagaaagcttcattgaaaagaaaataccaagagtgctacttaaattacaggttcattgcaacagatgattcacattctccaagcccactttgtataatatgtggcaacaagctatccaacaaagccatgaaaccttcaaaaccacttcactggctgggcacagtggctcatgcctgtaatcccagcacttacagaggccgaggtagatcacctgaggtcaggagttcaagaccagcctggccaacatggggaaaccctggctctgcaaaaatacaaaaattaaccaggcatggtggtgcacacctttagtcccagcttctcgggaggctgaggcatgagaattgcttgaacctgggaggcggaggttgcagtgagccgagattgtgccgctgtgctttagcctgggcgatagagcaagactccatctcaaaaaacaaacaaacaaaaaaaaaactgcttcaccacttggagaccaagcaccctgcgtttaaaagacaagcctttggagtttttcaaaagaaataaacatgaacgtgaaaaacagaggcaattattgaaagctcccacttcatcaaatgtgactgcactgagaacatctcattcttagtggctaactgcattgctaaagctaagaagcccttaactaactgcattgctaaagtaagaagccctttactattgaagagttgatcctgcctgctgctaaggacatttgtcatgaacttttaggagaggctgcagttaagctgcagttcaaaaggtggcacatgttcctctttgagctagcaccataactagatgaattgatgacatagtagaggatattgaggcatagttgttagagaggattgatgagtcaccgtggtacacattgcaggttgacaagtctgccgatgttgacaacatggcaacaatgcttgtttttgtgcaatatattttcaggaggatgtgcatgagactatgttatgtgtacttcgttgccaaccagcaccacagctgcagaactattcaagtcttttgaacgattacatatcaggaaaactgaattggtcattttgtgtcgtatatgcacagatggagcggctgccatggctggacggctttctggtttcactactcgagtcagagaggtcgcttctggatgtgagtctatgcactgtgtcatccatagagaaatgctggctagctgacaaatgtcacctgaacttaacgttttgcaggatgtgattaaaattaaccacattaaagtacatgcccttaacccatgtctgttcacgcagttctgtgagatggatgcagagaatacttctcttacacagagaagcgagatggcgttctaaaggtggatcactggccagagtttttgagttaagaggcctgctccagagatttctctaagaataacagtcaccactagcagaacattttagtaacacagaatgagtggtaaaacttttttttttaagttcaggggtacatgtgcacgtttgtcgcagagataaacgtgtaccatcccatcacctaagtattaagcccactgtccattagctagttttcctgatgctctccgtccccagcctccacaggccccagtgtgtgttgttcccctccatgtgtccatgtatactcatcattcagcccccacttacaagtgagaacatacgatacttagttttctgttctgagcattgggatttttgacatgtttcaaacagtaggagtgatttttgaaagagagtgagccagggccttctttctcacagctggtgcatgatcacctatctcagctctcaaaagagtttgagcattacttcccaaccacaaaagacccccgaactgggaaggaatggatccacaacccatttatgaataagccaggtcaatcgactttgttcatgcttgaagaggatcaactggttgagatcacaaatggcagtggccttaaaagtatggtttgagacaacttcaaaatctccatatattctggattaaagtcgaggtggaatatcctgagattgccaaaaaagcactgaaaaacctgcttccatttccaatatcctatctttgtgaagcaaagttttctgcagtgacagcaaccaaaacaagattatggagtatactggacataagcagcacacacttcgaatgtcactgtctctcattgcccccagatgggactgtctagttgcagggaaaacaagctcagggttcccattgattccacattatgatgagttgtataattatatcattatatattacaatgtaataatagaaataaagtgcagaataaacataatgcgtttgaatcatcctgaaaccatccccccacccccaggctgtggaaacattgtcttccacaaaactggtccctggtgccaaaaaggttgaggaccgctgtcctactgcactacagtcatcatcttgggtagatacttatctcctgattcacagggcctgacactgagtaggtacttggtacctgtttgttattgccagctataaataaaatagctttcccttccattgacatatgaccagagttttaaaaggtaatgatttcaaataactatatgttagattccgtttttcattcataagggaaataatctctgatcataacatagaattaaaagatgattttcagtagttttggcatttgacccaggatttatacatattttacagatttacagattttaagaaataactaatactttctacccaagatattcctcctgattagtttgtgttttctttgcatgctgagtttgtttattctcagtcactcttagaataaaacgcttctcacgtacaggtggcttagagcagcagtctccaacctttttggcaccagggactggtttcatggaagacagtttttccacagatgcagggaaggggttgggggcggcagctgaatggttttgggatgaaacggttccaccttagatcaggcattagattctcataaggaatgcacagtccagatccctcacatgcgcagttcacaatagaatttgcactcctatgaggatctaacaggtgatgtgacaggaggcggagttcacgtggtaatggtcactggcctgctcttcaccacctgctgtgcggcccaggccacagaccagtaccagtcctgggagttgggaacccctggtttggaggaagcagaatgattagttttcacatcagtcagcatgagtatttcttttctttaaaaattagcacatatgacagaaattatcaagaaaatagaggaggaaaagcatcaaggagtttgggtgcagttaatggtataattctctggaagcatttttacagttttattttgaagcatattgagacaggcaaaaattaatgagttataaggtggtaaaatggacagagaataggacatctcacttatttccaaatgttatgtccctttgtcccttctacagtttttccatttttcctaaaaaccatttgtgcttgttgtctatttaagttcacctcaaacaggaagaacagccacatgtgcaagagccagtaaaggacattccttggaaggtggggggcagttcctgagagcaaagatgggtcagccaacaaatacttgagcatttcctatgtgccaggcactgcggaaaatagtggtttaaaaaaaaaaggaacaaaaaaacaaggttcctaccctcttggaccttacagagaaatggtgtttttttttttttgttttttttttttaaatcataaataggctaggtatggtggctcacacttgtaatcccaacacttggggagggtgaggcaggatgattgctggaatccaggagttcaagaccagcctgggcaacatagacaaaccctatctgtacagaaaaaattgttttaaattaagaattctaaataataattgcaagtaagcaaagtgtgttgtaatggagaagcaccacatactcatggtgagagcctatgacctggcattgggaggtctggtgagtaagactgcctaaggaagtgatgttgactgagactccaaggtggagtcagagttagccaagcaaagaggatggaaagagcatgcagagaccaggaggcaggtgagagcatggtgtgctctaggacccaggagaagcaagaactgccgcactagaggtccgaacaaccagctagagatgcaggtgcctctcagcctcctgtcccctgagtcacagggttattatgggtgtttctcaggttcctgatttgagcagctgactgtgactctggtaatgatacccaagagaaggtacatgatttttttttttttaactttttactgtcaaaaatttcagacagtgacaaagggtaaaaataatagcaaaatgaacccccatgttcttatcactcagcttcagcaattattggtcatagctgatcttattttattcctgcatacccttaccttcttccccactccatataattttgaagcaaatcttagccattgtatcatttcatcagcgagaattatagtgtttgtcttatctaccaggacttctagctctctgattttatgggactctatcggacaaagggactgagctgtagcacatagtagaaagaaagtgactgcagttcgtggccttacagcatttgttctgtgagccagcccacagatcctcaacactttgtcccctgtggagcgtcgaggatatttaatgaatcccttttggactatttttagaaggagaagatgaggaagacgaggacgatgaggatggtgaagaagaggagtttgatgaagaagatgatgaagatgaagatgtagaaggggatgaggacgacgatgaagtcagtgaggaggtcagtgcagctgttttctaccctgcttcctatttgtaattacaacaaaagtgggggtttcaaaaagatgacaaaagaaaagaaaaaacaccttttgaagaaattagtatacctgtgaatacatttacaatatgaatctggttaatttagtgtttgtctggctttaaataactactaaatagaatgcctactgaactcaaactagtacggttcctggctgtgcaaggtaagttctggccctctgggggaaggaatgaattgagtattcagtgtggtgagaaaactggacatgttgagaattgatggtatgtctgttccttcattgaattgtagggaagtttatgtttaccaagtctaaactttttcttgtatattcagtgtaattcagtaaatatatatctgctatgttaaagagttgggagtacaaaatgaaatgagattgtggtcctgccctgaaagagcacagtctggtttatgaaatacccaataatagaggatccctgaggaaataaatgctatacgagggcaggagaaaacagtgtcttgactttgaccctcaaagaggtttgggaaacaggcagacaacattagttgttaacaaaacgcatcctcttttgtagtataaaaataaggcttggggtttgtgtgatgtcattaggtgtatgattgacattaaagttctgaaagaagctttgtatatgaatgggatatagaaatttttgtctaaatctgttttgaaatttgagattttaagatgttttcttgaattatccagagttatatactaattaaacatctagcaaatgaactgcttgcttctaaaaaaaatttttcttagaaaaattataaagctcgttaaggaaaatcagtgggtcttggtacatcaaagtagataaaaataacattacagtttcctgcttgattgatattgttgcatttatttgtacttcttagtttggcagaatttgtactatatgcacttttcaatttggcagaattaatttaatgttatgctgtttgctattctttaggaagaagaatttggacttgatgaagaagatgaagatgaggatgaggatgaaggtgggcctaatgcatgcattttgatcattctcagttaaaaattagagaaaaacatccattatttagaatatgataccactgagaagaaaataaaatactcttggctctggtggtttacacattcacattctcgtttctatcgtcccatcagtgtgtctgtgctggtgcaggctccctgctgctacagcagttattcctgtctcatggcaagggtcctgttggtcttcagtcctcatggggtttttttcggggtggtggtggtggtggtggtgttttgagacggaatctcgctctgttgcccaggctggagtgcagtggcacgatctcggctcactgcaagttccgcctcctaggttcaagccattctcctgcctcagcctccagagtagctggggctacaggcgcctgccaccacgcccagctaattgtttgcatttttagtagagacggggtttcaccgtgttagccaggatggtctcaatctcctgacctcgtggtccacccgcctcagcctcccaaagtgccgggattacaggcgtgagccaccacacccggcctgttgttttcttgagatggagtcttgctctgtcgcccagtctggagttcactggtgcaatctaagctcactgcagcctccacctcccaggttcaagggattctctgcctcagcctcctcagtagctgggattacaggcatgcaccaccacacttggctaatttttgtatttttagtagagacagggttttgccatgttggccagcctggtcttgaattcctggctgaattcaagtgatccacccacctcggcctcccaaattactcggattacaggtgtgagccaccatgcctagcctgttccccatgttttaaatgtgtttttaggaccagtcatttggtttactgtcaagtgtgagtttctgtgtttggagttctttcattttttaaaaaaaggctttaataattgaaccatcattttcaggatatataaatagatgtagcagtttcccagttttgtcagtgttagtcctttccccactacaaccaagacaaatgaaatagctgttacttatttaatactgttgaaagtatgccagcctggacaacatagaccctgtctgtacagaaaattaaaaagttagctgggaccgggtgtggtgactcacgcctgttatctcagcactttaggaggccgaggcaggtggatcacctgaggtcaggagttcgagagcagcctggccaacatggtaaaatcctgtctctactaaaaattaaaaaattagtcaggcgtggtggcacgcactcaaacccaggaggcagagattcagtgagctgaggtcatgccactgcactgcagcctggacaacagagcaagactctgtctcaaaaaaaaaaaaaagttagctgcacatggtggtgcacacctatagtcccagctacttgggaagctgaggtgggaggactgcttgaagttgcagtgaggctatgatagtgccaccgcactccagcctgagtgacagagggagaccttgtctcaaataaaaagtctcatggttgtgtctcagaaaatcaggtgttcactgtgctgttggctgatgttttctcagcatccactttgtcaagctctcaattacatttacactagatattaccctggttaggacctggtcactgcctttaagaacctgtatgattgggaggccgaggcgggtggatcatgaggtcaggagatcgagaccatcctggctaacacggtgaaaccccgtctctactaaaaatacaaaaaaattagccgggtgtggtggcaggcgcctgtagtcccagctactcgggaggctgagtcaggagaacggcatgaacccgggaggcggagcttgcagtgagccgagatcaagccactgcactccagcctgggcgacggagccagagtctgtctcaaaaaaaaaaacaacctgtatgaaatatgatttaacatatagttaatttcattaaaataaccatggattttattagttgaaaaaattggtctatatgtaagtctctgtgtctcgactacataatactcttaagaatttcctttttagttaatattagtttgctacaatttgagtcttaatgatgttccatactatgttttgtgtgttatttaattctcagaataaccttttaaagtcagtaccattgtccccattttacagatgaaaaaggcttaaagaggttaagcttgtctgagatcacttgaaagtaagcatgtcttgaagacgtgctagatagcacgaggggttttgttttgtttttttggagacagtttcgctcttatcacccaggctggagtccagtggcacaatctcagctcactgcaacctccgccttccggattcaagcaattctcatgcctcatcatccagagtagctgggattacaggtacatgccaccatgcctggctcatttttgtatttttagtagagacggagtttcaccatgttggccagggtggtctggaactcctgacctcaggtgatctgcctgccttggcctcccaaagtgctgggattataggcatgagccagtgggcctgaccagctcaggttaataataagcactttaataattgctagatttgtaaaaagaaacatttggaagacaacaccttaaaatcgaggaaactggattaacttttcctgggtgagttgaggtgctgctgtgcattttgcttttcttggttctgtggtcaccacttatacttgctattagtcacctatattaatctgatcaagtttacattgttttatctcctaactgtcaaaaactttgttgttgttgcctccattggcaataatctaagcaaaatgcctttccactgtcctaaagtcaatttttgttactgtacagaggaggaagaaggtgggaaaggtgaaaagaggaagagagaaacagatgatgaaggagaagatgattaagaccccagatgacctgcagaaacagaactgttcagtattggttggactgctcatggattttgtagctgtttaaaaaaaaaaaaaaggtagctgtgatacaaaccccaggacacccacccacccaaagagccaaagaatagttcctgtgacattccgccttccttccatgtagtccctcttggtaatctaccaccaagcttgtggacttcaccccaacaaaattgtaagcgttgttaggtttttgtgtaagattcttgctgtagcgtggatagctgtgattggtgagtcaaccgtctgtggctaccagttacactgagattgtaacagcatttttactttctgtacaacaaaaaagctttgtaaataaaatcttaacattttgggtctgttttttcatgctttgctttttaattattattattattttttttacattaggacattttatgtgacaactgccaaaaaagtatttttaagaatttaagcgaaataaacagttactctttggtaa

SEQ ID NO: 2321 - DNA, 82273 bp, Homo sapiens
  source 1..82273: mol_type = genomic DNA
tcattaaaacatgttaaaacattttattttggaagttttatagaaatttaacatttactgtctttctcttggtagttttatagtaattatataatataaagaaaacacaatgactattttagcctaggcccatggaagatgtccctaaaatccctcaaatttaccccactgtgccatatagatatgtttacttactttcatttttttttttttttttttgagacagggtctcactctgtcacccgggctggagtacagtggcgtgatctcagctcactgcaacctctgcctcccgggttcaagcgattctcctgcctcagcctcctgagtagctggcactacaagcatgtgccaccacacttggctaatttttgaatttttagtagagacagggtttcaccatgttggccaggctggtctcgaactcctgacctcaggtgatctgccgccttgacctcccaaagtgctgggattacaggcgtgagccaccttgcccagaagagatatatttactttctatgtgtgacactgattgaagtctgagaagccctgtccataactaaagtgtctaatatggaattatccagaacatgtgtagtatatttgaatgaggttcaagagatacctttatccaaatatggtgacaaatttcaaaagaaccggaaaaactatgatggatttacatgaggtccatctttacaaaattgtattgaaaaataaagaatttggccgggtgcagcggctcatgcctgtaattccagcactttggaaggccaaggcgggcggatcacctgaggtcggcgttcaagaccagcctgaccaacatggagaaatcccaactctaccaaaaatacaaaattagccaggcgtggtggcgcatgcctataatcccagctactcgggaggctgaggcaggagaatcgtttgaacccaggagacggaggctgcagtgacctgagatcacaccattgcactctggcctgggtgacaagaagcgaggaaagaaaagaaagaaaagaaaagaaaagagaaaaagaaagaaagaaaggagggagggaggaagggaaggaaggaagggagggaaggagagagagagaagaaggaaggaagaaaggaaggaaaagaaagaaagaaagaaaagaaagaaagaaagaaaaaaagaaagaaaaaattctaacacattaaaaagttaaaccacaaaactgaaggttagctaaagtaaacacagtggtcaatcatacatgataaacttcaagctgatgccataattgtaattacatggtaacctgaagaaatattggatagtaaaagcctaatgattattttatatgctaatctgagttatttcctttgaacaatggttatattgaggaattggtgaatttttccctttgttctcctgcttgctttgctgttttccctaaatatgtctgctgagatgaactaaagagaacatttttccatcgagttctctaaaaatctaccagatgggatctcctaaagaatccaacaggaaacacactcttctaggaaatcactggaggtcccaaaccactctaatatgaatgataccagacctcaaagctaacattgaaaatgcacaggtaaaacatcaaatagcaggcagcaagacagaatactacaagcttttactttttctttttttttttttttttcttgagacgcagtcttgctctgtcacccgcctggagtgcactggtatgaccttggctcactgcaacctctgcctcctgggttcaagccattcccctgcctcagccccctgagtagctgggattacaggcacctgccaccatgcccggctaatttttttgtttgtttgagacgaagtctcgctctgtcgcccaggctggagtgcagtggcacaatctcagctcactgcaacttctgcctcccaggttcaagcgattctcctgcctcagcctcccaagtagctgggactacaggcacgcaccaccactcccggctaatttttgtatttttaatagaggtggggtttcaccttgttggcgaggatggtcttgatctcttgaccttgtgatccgcccacctctgcctcccaaagtgctggaattataggcatgagccactgtacccggcctaatttttgtatttttagtagagatggggtttcatcatattggccaggctgctctcgaactcctgacctcaagtgatccacctgcctcggcctcccaaagtgctgggattacaggtgtaagccaccactcccggcctacaagctatttccctgtaatatgtctgatcactgttaggacctggttatacagaattttcattccaggaagcacaaatgtgatatacttacagtaataatggtcagcagcaaatcttttctttggggaggaaagggtaagaaaagaaaaaagaaggaaaggaatctaccatataggctgtgataatcttaaatgctctaagtaagccatgtaataagtcttcaaatgcattagagatacattaaaacatatttgaaatgaaatttccagcatctaagagtgcttggaacgtgaattttaaaaaatagtagcaataattattattgctattaattcttatcatactattttagaataataaaggaagtcatagatgctgtatctctaggtctctataaaccttaataaatatatagttcatagaaaaccttattggaatgtcccttatattcaattaaaagataaattaaaacctcagtcaagatagcagcttctaaggcatcaaaaacacttattaagttctatactctttggttattttcataatcccaattctaaaaaaaataaatgaattcagcacattaaaatcagacattttgtatgtgaattgcagttacagtactattaagtgtatgaaaaatgtctagcattacatataaactctgcactattaacataattttgaattattatacaatttagaaaactaaacatttagaaaaagtattaatgacatcatatatactttacattcaaaatcatggattattacaatattgtgtcaaatgcaaaaaaaattgcagctaatgtatctaaaccagcttaaaaacataacatggagttaatacattacaaatattgtctgttgggttaggtggtagttactttaaacatttagagctacaagtacctatacagtataacacagacacataattttttttaataatacagacacatagtaattataaatatgttaaacaactttaactttgttagttaacaaagaatccctttaaattatttttggcatggtgcctgaggctccatcaaaaaaccggatgggaggcgttgcttatttacagcttcataacatgtagtgctggagtcttcaagtagatttccagttaaaatgtaggcttgttcatgtattcttccattgtctgaaagcgaacaataaattagaacaattttccctttaagtcacagccttccgcagactgtgaaatcttctgcattcttttatttatttgccattgttgaaaacaagttgtcaaaaggatacatggatataaaatctttgcattctaatcaaagtttgagtataatttgtatacacatccatatggggctggaattaagtaactttcaactgagaaaaagttaagcttgatcataaagtgaatgtctgataagagaaatgcttggccagtgtggtgctcacgcctgtaataccagcactttgggaggctgaggtgggcagatcacctgaggccagcctggccaacatgacaaaaccccatctcgatgaaaaatacaaaaattacccgagtgtggtggcatgcacctgtattcccagctactcgggaagctgaggcaggagaattgcttgaaccgggaggcggaggttgaagtgagccaagattgcaccactgcactccagcctgggtgacagagtgagactccgtctcaaaaacaaaaaaaaaaaagagagagagagagagattgaaatgctaaagcaaagttgccaagatatcactgttgacttaagataaacacgtttgctaaaatgatcaggaggaccacatccaggtacgtgtattagagaattctgaattacgtctgtataacatatgtatcgttacctatattgtgcagagcatctttattatacatattgtcaagacaaaaaagataaacagaccaaaattcttaagaatttctttacttctctacaaggttcacaggaaaaaatgtatagtttctgccatatgttttcaaaggcttcctcccaaagtatacaaattatgtttctttttaacttttaagttcagagatacatgtgcaggtttgttatagaggtaaacgtgtatcatggggatttgttatacagatgatttcatcatccaggtattaagcctaggacccatgagtcatttttcctgatcctctccctcctcccaccctccaccctctgaaaggctccagtgtgtgttgttcccttctatgtgtccgtgtgttctcatcatttagctcccacttttaagtgagaacatgtggcatttggttttctgtccctgcactagtttgctcagaatgatggcctccagctccatccacgtccctgcaaaggacatgatctcattcttttcatactgtccatcagttactaagtttgctaacatgccccaaagccataatattttttttcagcatttaaaaaaaaatgtttgaacagactcacaattacaggtagagttcaaagttaacagtgatgttccaggttctataccatgcaagacagatgggctttctcttgcacactctcctactttaaacatatatatttgtgtcacaccagggccccaagttgaatcaataagaaagctcgagaggacaaaaaatcacctgcctctttcgtttgagtcacgatctgctcatttagcaatccaagttcaacttgttcttaagcttaaactccagggtatatgattcatgtgaacctgccaggaaatacgctgactgacatgggctgaagataccaaggctactggccgagcaagattgctcaggagatactagggctagaaatctgcccttaccttcaaaagaggttttctaactggttttcaccaactctatctagaattccagagttctgccagaaaacatttgtattcagtcatccacatttactcaacaaagctctcacctcctaagtgggcattggccaagacagccccatacccatctacccctctacagatgctgcccgtggggtcttttaacttagcagagggatcatacaggccattgggccatgctggttttatggaatctagagtttacaccatttacatgggaatacaaagttacaaatacaaaatcaggtataaagtgtacttagaatgagaaaagaaacgaccacagattgtgaattttgaagatgacaaatatcacaaaataaaaaatggttgcatgttattttcacgaattaattgcttgacactcctctatcatatattatattgtatggctacgtactttttgcagttaaaatatcttatttttgcaaagtggacaaaaacccatgaccagatgagagcattgctaggccctgcctgtagcctcgggaggggcctggagttgacactttcctgtctttgtggttcagtggcctctagtcattggcactgctcacatcaccagatgactcagtctgctaaacaccacactggctgccctgtctgagccgagccaggctggttactcaagctatgtaaaccaataaggtaaaagttggcattttcttgagcttgccactttaaaggtttggggcagacttttagagctggcagaaccttagttgctcttaccttctcaagacaggagctggagtctgtatcttgggtcctcttctggatacatctagctctgctgtgtttcttatgcatatagcacagtgtatgttatgacttcctactgcattgtggtttggcctagctgttaacatggtttacgcttttaagggtgacagtgttagggtgcacctagcagtttcgcctgcatccacacgagggcacatagaatcctattgctcatgagatacaatctgaccctccccttcttttttttgagacagggtctcactctgtcacccaggctgaagtgcagtggtgcgattaccgctcactgcagccttgacctctcgggctcaagtgatcctttcaccttagccttccgagtagctggaattacaggtgtacaccaccatgcctggctaattttattactttttgtagagacaaggttctcactatgttgcctaggctggtctcaaaactcctgggctcaagcggtccttccgcatcagccttctgagtagctgggattacaggtgcacaccaccacacctggctaattttatcatttttctgtagagacaaggttctcactatgttgcctaggctgatctcaaactcttgacttaagcagtcttcctgcctgggactcccaaagtgctgggaatacaggcatgagccatcgcatctggccttgagcctcccttcttggcaggctgttagttggggtaaaatatctactgtttgtcgctcctacctattgcaagtcctgtggttaatgaccactatcgcctttgagagtttcattttcttttcttttttgagacagagtctcactctgccgcccaggctagagtgcagtggcatgatctcggctcactgcaacctccgccccctgggttcaagcgattctcctgcctcagcctcctgagtagctgggattacaggagcccaccactgcacctggctaatttttgtatttttagtagagacggagtttcaccatcttggccaggctggtcttgaacacctgacctcgtgatccacctgcctcggcccaaagtgctgggattataggcatgagccattgtgcccagcaattttttttttttttttttttttgagatggagtcttgctctgtcacccaggctggagtgcagtggtggaatctcggctcactgcaatctctgccttctgggttcaagcaaatctcctgcctcagcctcccaagtagctggggttacagatgtgtaccaccacacctggctaatttttgtatttttagtagggatgggattttgccatgttggctaggctggcctcgaactcgtggcctcaagtgatccgcccacctcggcctcccaaagtgttgggcttacagacgtgagccaccacgcccagacagagggtttaattttccttctaataactttgtgccattgtccacattgttgttacccccaaataagtattcccaaccaagtaaacagttcctttcttttcctcttatcaacatctagccaccacacgctcagaataagctttgagcatttggagatttgaggctatgtcttcttactaaatccgcaggcaggtgtagctttttaaaagttattattctaagaaactgttattaagtaggagctagagaaaagtcttaggggctactgaagattgacagctgttctcacagctaaagcaatgtcacaaaggcctcccttaaccttcagtaactacaaatatatgattgggtccaaaggacaggaaaaaaaaaaaagcagtaattattttcctttatgcaagtatactactggctcctatccagttgaaacctcttaagcaggcaagatatgcaaagtcaattcttcaacaagctccccagaatatttactgacttcactgaataccagagcccaagagaacactaataacactctctgtatttggcaagtgttgttagcgcaacagaagagactgagagggtggccatgacattgcctgctcaccatagggacaccagggctaaatgcaaggtcccctgagacctacccatcaagcccctccactcattcaccaattagcatttaattgtgaaagagctcactcttgaaacacttacttcctagatttaaatggaaccagcaacaccagatttatgacaacctttttaaaacatttcctaatttgagaggatttcaaattaacccaggtgtgtcttggcccccaattcagctttaattactgaagtgccaaagactccgttaaaaactctgtttctcctgtaaggagactccacagtcaggaccctgaggtcctgaagttaaaaaaaaacctccaccccctccacctgcccccaactcccagagtattttatgaaacactgttttgtgaaatttccaaaccactgatttctcaaataccttgtaaagttttcctccctgtggcatttggagacagccaaatcaacatcagagagtttagatgcactttttgaggtcagacacctctggtaatgaatgcattggccttctaataggcacacgcagctgcttacggcacccactcaaatagatgttttcctccacatccattcaccagaggactgatgctctggctgggcaggagcaagtaatcagcctaaagatgcaccaaaacagttgctgggaattcacacctaatggtgttttgttaatttaatcaccctcttccaaatagcaggaaaaaagtagctttaatgccagttttacttatttatttatttatttattttgagatggagtctcgctctgtcacccaggtggtgctgtggtgctatctcagctcactgcaacctccgcctcccgggttccagtggttctactgcctcagcctcccaagtagctgggattacaggcacacatccccatgcccggctaatttttgtgttgttagtagagatggggtttcaccacattggccaggctggtcttgaactcctagcctcaagtgatctgcctgcctcggcctcccaaagtgctgggattacaggagtgagccaccgcatccggccaaatgctgattttaaaaaggtgctttacaatgctctggatcctcttgacctacttatttgaaaataggaagatgggaagacccactgaggctgtgggaagaagaatctaggggtggcaggtctgggatggaacccagcccctcagagcatctcatttgggagggcagaggtcagtggggtgaagtgctctttctcacagtgtcctgggaggaatggaggggctgatgtaggtaagttccctgaggaggtatgatgcaaatctgtgcggcttctaaaagaacattcccactttattttatatagaaatcccagagtccagggcagtacaaaatggatgcttctgggcccatttataccttggcaagcaaaccacagtgttcccaatttctttatgcaagcaggagcacacatacagccttcccaaaaggtgtaagaaattttaattaaaatgataaatgccatgctcaataataaagctttaatatctctggcaaacaaaataacaatgtactgctattctcctttcccagggaagcataggtattttaatgaaagtctttttatacatctcataaaattattcttgaaaagaatagcactaagtatttgatacctttttggcagtgaaggactcttgcactccaaagctcatccaaatgtgaagagcaaagactctaaagcccaattgcctgggttcaaatctctatgccacacttcctagtggaatagaggaattccacacttcctgtgtgaaattgagcaggtcatttaacctcttggtgtctcagtttactcatctgtaaagtgggagtaacaataccacctactttttcgagttgttgtgaggattaaataagctaatacatataaatagtttagaaactgtacccagcacagagtaagtactcagtaagtctggttaatattataattattaacaccatcatcatcatcatcatcatctttctcccatggtttgggaaaccgtactgacctcctgtaacatatcagagtcttcaatggctttgacagcaattttcttggatgtttcctgaatttccccacctattataaactcgtccaggatgaaataagccttttcaaaattaaagataatatccagctcacagacctggtgggacaaaaacaaacgttttgataaacttgcagttgtatcaggggaaacatctgcccgaatctcgagctttttcagtttgcactcatgtggcgtaccaaaaataaaaatatcagatggcattttaaggacagaaaaaaagaacagggaatgtcaggcctttaataaatggaatgctacattctattaaagcaaagcacatccttagataataatgttttgtgttacaacaggaaatttgaggctcagtaagggaatgaggccactcggctcctcttcctatctgcaccaagaaaactgagccccagctgcattccaggaaggagggcagagctttgtttctcctgctctctgctctgtaaatcttggcttctagctttagaactctctcagaaactaattcttcagaggaaaattagctcaactgtgctaatttttctcaaaattatgtcacagccagtggttctcaaactcattccaaaggctcattaaaacacactggtgctacagcccacccccagagtttatgactcaggaggtctagatgagaactgagaatctgcacttttaacaggttcccaggtgatgctgaggccgccggactgcgggatttcacatccagaatccctggcgcggatcaaagcagagtctgatagattttggtgtttatttaagtgtagcaagtatggcaagatcactcccatcatccaaataaagctcatttcccgtactcacacaccatccttgctgtcttactccctacttattcctctactcactgacaccttctctttccataccataccccacccacccaactgaagctgttctcctgaaactctgctcattgagtctccagactgcataaatgtcttcttttgagaagcgtctgttcatatccttcgcccactttttgatggggttgttttttttcttgtacatttgtttaagttctttgtagattctggatattagccctttgtcagatggatagattgcaaaagttttctcccattctgttggttgcctgttcactctgatgatactttcttttgctgtgcagaagctctttagtttaattggatcccatttgtctattttagcttttgtcactagtcattagaaaaatgcaaatcaaaaactacaatgagataccatctcatgccagttagaatggcgatcattaaaaagtcaggaaacaacagatgctggagaggatgtggagaaataggaatgcttttacactgttggtgggagtgtaaattagttcaaccattgtggaagacagtgtggtgattcctcaaggatctagagccagaaataccatttgacccggcaatcccattactgggtatataccaaaggattataaatcattctactataaagacacatgcacatgtatgtttgttgcagcactgttcacagtagcaaagacttggaaccaacccaaatgcccatcaatgatagactggataaataaaatgtgggacatatacaccatggaatactatgcagccataaaaaaagatgagttcatgtcctttgcagggacacagatgaagatggaaaccatcattctcagcaaactactacaagaatagaaaaccaaacacggcatgttctcactcataagtaggagttgaacaatgagaacacatggacacagggaggggaacatcacacaccggagtgtgttggggggtggggggcaaaatacctaatgtagatggcaggttgatgagtgcagcaaaccaccatggcacataaatacctatgtaacaaacctgcacattctgtgcatgtatcccagaacttaaagtgtaattttagaaaaagggaggagaaaaaaaaaagaaagaaagtctccagacctccccaacgtttacctctcagccacatgtggtactcttcaccaatctctcttccttgaaaatctcttctcccttgctcccctgattttggcaataccacttaatgcctgtttttcttgtctatctctgataattccttctcagactccttggataatttatctccctcctaccctgcatttgtttaagaagtatttaaggtgtgcctagcacatatcagtcaacagaacagacaaacatctctactgcatgttgcttatattctagccatccatcttctgcttgaatattcatgttcctcaagggagcctcttctctttgcaaaatgcatattctcctggacaatcttgctgactctctacagctgtgtctagcatgcaggtagctcaacaaacctagatgactagccctgatctccctctgggccactagtccaatattctcacccactaactagacatctttacctacctattcctcaatccatgtcactatgtcccaagctgatatcaagattattctttttcctttagtccctattttgcttagtagttgcaatctctttctaatttctccatctaattcattctagagttcaaccaacatacttccccttccccactcattcctctccctccttgatctcatccctctggatttggtcatcagtttctactgattctattgtctaaataagtccctacccttcctgtcttctctgctttcacagctgctgctcaggcctacagcacttctccatcaggccactgcaatgaccttccaggtggcggttgtgcctgctcagggccattgaccactaatgcttagctaaaatgctgatcttgtgcctctccagtgtaaggtcttcaggacaaaggcatataggaatctttaccagcctgggccctgctgtctgatttcccgtgccagttctcatccatgcatctgacacacatgccacaaactcacaatgtcacggtgttttgtgcctttgctttctgcacattccaacaattcttgaattgtgtccccaaatgtccttttctttattctcctgctggcaaaaccaagctcattttttcaaggccaaattcaaaagtcaggcatgtggcgattccccacatccccttttccccattcagatttcacatcacttcctgtgggttctcacttacatcttctgtgcactagtttctgcttattgattactaatcactcccccgtactgtgagttcagggcagaaactttgtcttcattatctttatatccctggtttctggcacattgtaagacacaaaaaatgcttgtaagataaatgaatgagcaagtttaagtagaggccttgtctgggcatggtggctcacgtctgtaatcccagcactttgggaggctgaggcaggcagatcacttgaggtcaagagttcaagaccagcctggccaacatggtgaaaccttgtctttactaaaaatacaaaaattagccaggcatgatggtgcacgactgtaatcccagctactcaggaaggtgaggcagaagaatcacttgaacccaggaggcagaggttgcagtgagccaaaatcatgccactgcactccagcctgggtgacagagcaagactccttctcaaaaaataaaaataaataaatataggccttgtttctaatatgctagagattaatggcatcccagatacaattctatggttgtactgaatgctataactttgcatgaaatagatgtcaatattttagcaaattcctccatatacttacaagttaggtcaataaactagcaaacttcacaaggaacatggtttaagtcaacagatccaaatgaatccaacttccatacagaattaccatggcatactgggggtatatcacagtttatttaagcagttcctttatggatatgggcagactttgggctgtttccagtttttattctaaatgatgctgccataatttttgttgtgtattgtatactaatttgagtatagtgtaggaataaattccttggggaattttgggtcaaaggatttgtatatttaaaattgataaatactaaaatgtggtcctccaaagtagtctataaaacttaaaagtttcactaacagtaggagtgattacctatttatgccatctccagcaatggatagtctctaaattttcggatgaatattaattaaacttgcatttccctgcttattagtgagactgtacatcttattagatatgcactggccctttccatttcttgccttgtctacaaattgcttcttaaagactttgtttttttctattgtaatatttgtcttagaaatttgaatgattctttcggtgtcacagatactgtctcctttccctgctgttgtatatgtttcagctatgtagaagctgaaaagaataaggtagatttacatgcacaaatatggcaagagctctaagatagacttgtaaggaggaaaaaaaagaaagttgcagaataatatgcagaatgcaatcccatttttttttttttttttttttttttttgagacggagtctccctgtcgcccaggctggagtgcagtggcgcgatctcggctcactgaaggctccgccccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgcctcggcctcccaaagtgctgggattacaggcgtgagccatcgcgcccggccgcgatcctatttttaaaaaccgtatatgtttagagggacatgtaaaaatatgcatcatttttgcagttttaaacaatagaaagaaacaaaaagaaatcacaatagattagacatccatgtacatgaaagaaggtatgagaagaaagcagttaccagaggtcagaaaaggcagaagtcaggagttatagtagcaagctgaggaacctcggagttcaaggcaggcgtagaccaggaatccaagacagacaggagcctcattaggagaaaccagcaattaaactcctgcaaagtgaacctgacagatactaatgaaaattctccaggaacttcttataccccactttgacacgtccccaggtctgggtcctccagcagccatggggcaattaatttactgtactagtttcaagggataagggtaaggtaaggtggtattcagagttagagagacaatacacacacacacacacacacacacacacacacaccccttgatatacagttactatctgtagctctgaagagaaatgtatatgcaagttccataggcattacagagaatgttacaactgagcaactatttcacatacagcaacacaaaagtgctaccctatagttattctttgagtctactgccatctgagaatgagagaaaatatccaggaagacccttagaccagttcatttttttttttttttttttggaaacagtcttactccgtcacccaggctggagtgcagtggaatcatctcagcttgctgcaacccctgcctcctgggttcaaactattctaccgcctcagcctcccaagtagctgcgattacaggcatatgccaccatgcctggctaatttttttatttttatttttagtagagacagggattcaccatgttggccaggctggtcttgaactcctgaccttaagtgatcccccccaccttggcctcccaaagtgctgggattacaggcatgagccaccgttcccagtcccaagtcaggtttctgaagctactgcctaattacttatgcctgtaatcccagcactttgggggggctgaggcgggctgatcatttgaggtcaagagttcgagaccagactgggcaacatggtgagaccctgtctctactaaacatacaaaaaattagccaggcatggtggcacacgcctgtaatcccagctactcgggaggctgaggcaggagaatcgtttgaacccaggaagcagaggttgcagtgagccaagactgcaccactgcaccccaacctgggcaacggagtaagactctgtctcgggaaaaagaaacaaaataaaataaaataaaataataaattccaccttgaggttgtcccaatacaacaaaaatatgtacttgatgctcaagtgattccactccttctaattatgcaaataccccggcttcttgctccctcaccatgttaataaacatgagcctctttatttattttctcgtgtatctagattctgaataaagctttcaaatggtagaaactatcatttaactttatcttcaatgtcctagccttgtgctcttctgtaatttggcttaaggttcttttcttacagcagaattcatggtgcagtgagattatttctggcatttcaccaactgaatccttttggacagaatctaagaagcacatgtacttattaaatgatgctctaaagtaaatacaaaaagtttcaagttacatgcagcaaatgcttcaaataatagtaaactatataactaccataaagctatatataaaataagaataggccgggcacagtggctcacgcctgtaatcccaacactttaggaggccgaggtgggtggatcacctgaggccaggagtttgagaccagcctggccaacatggcaaaaacccatctctaccaaaaatacaaaaattagccaggcatggtggcacatgcctgtaatcccagctactagggaggctgaggtaggagaatcgcttgaacccgggaggcggaaggtgcagtgagccgagaccgcgccactgcattccagcctgggcaacaagagcgagactccgtctcaaaaaaataaataaataaaataaaacaagaataattataatgcaatgtacaactatatagcaattaatagtttattaagtattgctatcacgccatctctttgcccctcccagcagccctataaggttagcaaagtaaacacttctcttaacctttttgagggtcatttttctcatctgcaaaacggagacacatgacaggccccaaatccttgaattggtgagagagtgagcctacaccagcatccgggggacccatagtgctcttcccctgacagcaaaaaacaaacaaacaaaaaactccctacatcaaattcaaaagctctctgggagatcaacatcctcacacactgaggcaccagtaaaaattcacactgtagtctgtaatgcagaaatatggcaggtatctaaatcctcagactcttatctggcatgagactttgaggcatttcctctgagcctctataaattgaggttaatgctacttactgaagatcggaagattaactagttaatcctcgtaaatctccttggaattgaaaagtgctaaaaaaaaatacataacttaaattagtagccagagattttgatccgtctgtcttcagcagataatattttccagtgttataagagaagctcagtaccaagttttcccctagataacattatataagggcagaattcaaggaaagctttagtattaatatgggaggaaaagaaaatcaaagagaaatattttattgctgagattatgtcaatgagaatcagtactggaagtctttgctcatcactgttaattaacaagaaccgaacttctactgggcatatagccttgaattgctcttagctgctcttagcttaatgaaagattcattgaattttttaataaattaaattttggtacatgacaaagacagagcttccaaaggtataccaaaatagaatgggaaattaatgttagagaaatgggaattcattctgactctctttgtactttaactgggtttagcattggtgaaggtcactcaagttctcttgagaagcataatgccctgagatatctggctgaaatttggtcagatagattgagatcaaaattcagccccaattcacattatcacagttggtttaatctaggaaaatacaacaggtcaagccggagttcagaaatgagaaagagaaggcaggttacgggaatgcccagacctcaaggaaacttcttcaggctcttgcaaaaggccaagtctgtagtttatttcaaaggaaagtacaaaaatgtgagaattcatttgaatagtagaaagtattaaataatatgtttgaaaacatgttattatacatttgcaaatttctccttaaaaaaatgaaaataaacttggtataccaagaggagaaagaaaagatggtctagttgtcttattgctgttatatactgaccaacaacctgaaatccctgaagcaacattttaggtcttaacaacatcatttacaagggggaaaaaagggagggaggaaaaattctttcagaaatctttccagtgttcatccttatgaaaagtgttgcaacaaatctgataaaacgtgttcaatattgcaaatactgctcattccattaaagagaataacaacaagaacaaaaaaaaactctgctggaagcaaattatcctaacacttaacaaaaacttcagtgagtaagggaatagggaagagggtattatgagaagaaaacattttccaaatccaatgatttatttcttgaaactgtgaaatggattaaatgtttttggaacatttgctatcaagtctggcccacagctggttacaagttaagcggtggggggataaaatgagtcacaaagcactggtctcaagagaattgcaatttggtggtcaagcaaatcgggtgccagttagggacactccaaggtcatttcttgttgctggagaactgtcaggtatataaaaagggaaatgtaggctggaggcagtggctcatgcctgtaatcccagcacgttgggaggccaaggcaggcggatcgcccgaggtcaggagttcaagactagcctggccaacatggtgaaaccccatctctaataaaaatataaaaatgagccgggcatggtggcgggggcccgtaaacctagctactcaggaggctgaggcaggaagatcgcttgaactcgggaggcagaggttgcagtgagcagagatcgtgccattgcactccagcctgggcaacaagaacaaaactccgtctcaataaataataaataaataaataaataaataaataaataaataaataagggtagtgtatcaaggatggaggagtggtcagggatccatgctttgaaaggttaaacaacaggctgggggggttgattttatttattgtacatgatggaaagtggctgtgaaggaatgccacacctatatctggtttttttaaggaagatggtaactaatagggcaagagggcgaacagagaaaagctcagaggcataaaaagccaggtaagatgtttaagagaaaagcaaaattgaaatcccaagtgaacctatattagtgagagtggaaagaaggaaatgaatgtcagcccaatttgaatagacagaggcagattctggtaaagcataggaaaagacaaaacaagctgcgtccttttgcactgaaggatcctggaacataacaaattccaatcacaagacagaacggattttcagtagatgagtttggttctgggccatgagaagcccagtgaagactgtcaccaacaaggggaagaagagtcacttagtaagggatttccaggacagagcgtcagtacacacagagttaggaagagatgagggcatttagggctgggcagaggaagggagctgagtggaagaaaccaaggaggcgcttcagaaatcaatgtcatggcaaaatcaagaagggcgaatttaaagaaagcgtcatggtgagcaagggtccagtgctgcagcgagaagcaggtgaaagcaggtgaagactcaagaggaatcgctggtgtcaacccgcaggagggttcaatggtaacttgctgatttccctgcagagtaaagatggacccatgctgtaagcactgccgagtgaatgagttctgaggactggagcacctagcatagtacatcacttggcagaaaatgcaaaaagattattgcatagcaatgtgaaggaaaaggatttgggttttttgtttgttgctatttttcttatgcataaataattaagaatacttatagcttagaaaaaaagccagagaaaggataaaaagtcaaaacagaaaagagacgacaaagccaatgaagaataaagaacagaatatcaagaaatccttcacagttaaattctggttcactgaaataaggtctctggtgtatttgtggtatgaagataaagatacatccacctcttgaaagctttgggtggctgggcacggtagctcatgcctataatcctagctctttgggaagctgaggtgggagaattgcttgaggccaagagttcaagacccacctgggcaacatagcaggactccatatctatttaaaaagaaaaaaggaaagctttgggtctttcatttactaagaattataggtagggagaaaaatcttgtattctaatcttagggggactaaggtgatcttcggttcaagttcaattcatattttagatgtgacagagagaagggatgtgaccagagacagaactgaagtaagagctgagatggggactgtagctaatcctaaccgacaaggacaacacttacatttccaaaatatttgtccagcagctccacgtaacgatgcacaatctctagcgtcaagagctcattgtcctgattttctattgcacagcaaaaatataaactagcataccttgaaatgaaaaataacaaaagcaaaatatgacaatacattaagcaacctggagacagtttttcccacgaatatgcagtcacctcctcccccgccgagcctctcctcatccaagaatgaaatcattattcatcacccccaatagcctcctgaaatataaatcagaatatatgaaaattctgtgggggttggattacttccattaattacgcatgaaagactctcaacaaaattttaccttgaagagctattatcaggaggacagtatcctttcgctcttggtaatcagggtgtcttcacacccctctccagcttgtcaattgttttttgtaaaatagaaagccctgaccagtgctgtcaggagcccacgctccccaccctcccacttcacaatgggcttcagtcattctgtgtgagcctccctcctcaatttgtcaaactccaaccttgggcccagcagaaggagctttgcaggcacttgctggtaatttactccattgaatatcaatctgtgaaggttgcctctgtttttcccaacgagctttataaacaccctttgcaagagcatatctaaggatcataactccttccgggagttgcagtagggtgttggatgcagggtcaggtcagctgtgttctgttcctggcttaggcatcaattacctgggtctccaagggcaaaattatgttacctctcaggcttagttatctcatctataaattgagggtcctttctagtatggtcttgccatggcaagcagatatggtaaaaacaatatacaggctttaaagccaaaaagatctagatttgaatcctggctctaccaattaacactcaattactgtgactgggaactgactacttaaactcttcatgtcctcaatgtactcattacaaattcaagtaacaggcataataagagctgccccactgaacacatccccatctctctgtcatactaacctccagtttttccaaagcacttgttactaagtgaaaatattgtatttggttacttaataaatatgtatactacatgacagcaggaatgtcatctgtcttgttcaatgatgtatcacagccattagaacaatgccaggaatggccggacatgatggctcacgcctgtaatcccagcactttgggaggccaaggcaggtggatcacctgagcacaggagtttgagaccagcctggccaacatggtgaaaccccgtctctcttaaaatacaaaaattagtcaggcatagtggcagatgcctgcaatcctagctactcaggaggctgaggcaagagaatcgcttgaacccaggaggtggaagttgcagtgagccaagatcacgccactgcactccagcctgggtgacagagcaagattccgcctccaacaaattaaaaaagaacaatgccaggaatgtaacaggtgttcataccacttttcttgaatgcatgcgtgcactatcaaggtgtagtttatttacctagaatccatcctggcacctagaatttctttcaataaaatgagagttcttttctagttagtctattggtacaaatatctgggccccagccttcaaagatttcagtaaatgatggaattggtatagcaatctaaaatgttcaggattagaacaaaccaaagtaagactgagaaattgagctctcaaaaagttactcacaccttttataaacaagttttagctccttccagtcaacaaaactgcttgtcctgtgaccacgggagagaataatctgaacaatttcccgggtgatcttcttcctctctttatcagggagagtgatgtaccatttctgtagccgtaatttcccttgtcgactgaagagcaatatgaaatgtatctagaacaaaggacacaaaaaacagaacctgatcaaccaagtcactctgccgttctgcaaagacactgaaattcaatgatggatttacacagaaagataattctgaacggatgaaaaaattcttaccagcatgaaaactatctcatctgacaaattatatttaacccatcagagaaaaaagaaatgtgtataccacaaatatagcttacttttattataggagaaaaataagtttttttttgttttttttgtttgtttgtttgtttgtttttttgagaaggagtgtcgctctgctgcccaggctggagtgcagtggcgcggtctcagctcactgggacctccacctcctgggttcaagcgattctcctgcaacagcctcccaagtagctggaattacaggtgcccacctccatgcccggctaattcttttatttttagtagagacggggattcaccatgttggccaggctggtctcgaactcctgacctcaggtgatcgccccacctcagcctcccaaagtgctgggattacaggcatgagtcaccacacctggctttattgtaattctttttaagtgttataaacacacatagggaaaaataatcaagaaagtagtagtacttctgtttttaaaacattaatttcttcctttacaagacaaaaaaaaagtgttaagaacaacagaaggatttactttaaaaattatattccggcaccaatatttaactatagaaacataatgataatatagaaataaaggggacaaggaaaggaagtgaggctgaagcaaggggaacgagaaaatgagaagctgtcttaaatgtaagctttttttttttcttttgagacagagtcttgctttctgacccaggctggagttcagtggcatgatctcagctcactgcaacctccccctcccaggttcaaacgattctcatgcttcagcctcccaagtagctgagattacacatgcacgccaccatgctcagctaattttgctgtgtttttagtaaagacagggtttcaccatgttggacaggctggtctcaaactcctagtctcagacgatccgcccacctcagcctcccaaaatgctgggattgctggcataagccacaacatccagccttaaatgtaagctcttttctccattttgcacgctacttggctgagagctttagaatcaaccatctcaagttacaattgtctttggcatcaccatagactcttaacaatttagacagtatattggctacactaggaagcaacctgattttattttcaaataagttctgaaatgtgtatttgaaataatggtaatgaattttaaaagatttaaataagcagaagacattagaacatctggaaatttacttgaaaaccttggaaggtacagtatttggtggctcacacctgtaatcccagcactttgggaggccaaggcgggataatcacttgagcccaagggtttgagacaagcctcggcaacatagtgagaccccatctctaaatttttaaaggctctgttagaatgttttttaaaaaagaaatttttaaaaaccttgaagttatggtatatttaatttttgggaattgtcagatggcctaatctttattttatgagaattaagttttctcaatccacggtatcagaagatcaggtttagaatcataatttattttgttcagttttgttttgtttttaaaaaataaagtgcattgtttcagttgtgtcatgaaggaaattatatataccaggaacaaaaaattattagattttaagaaaacgttttacagataaaagattcaactttcggccaggtgtggtggctcacgcctgtaatcccagcactttgggaggccgaggtgggtggatcacctgaggtcaggagttcaagaccagcctgaccaacatggagaaaccccgtctctaataaaaatacaaaattagccacgtgtggtggtgcatgcttgtagtcccagctactcaggaggctgaggcaggagaatcacttgaatccaggaggcagaggttgcagtgagccaagattgtgccactgcactccagcctgggcaacaagagcgaaactccgtctcaaaaaaaaacaaaaagattcaactctattgaaaaggctgaggcctaaaatgccacgacataaatcattacaacccactaggtggcgatatctgagggtccaatgaaaccatgctttttactcagatcttccactaaccacctcccccggctgcctcaccaccaccccctggccccagcctacagaatttgaggtcttcttttggagtgcagtggctcactgcggcttcaacctcccagacttaggcgatcctcccacctcagcctccctggtagctggaaccacaggtgtgcaccaccatgcctggctaatatatatatatatatatatatatatatatatagagagagagagagagagagagagagagagagagagagagagagagagagtgtgtgtgtgtgtgtgtgtgtgtgtgtgtgtgtgtgtgttttgtagagacgaggtctccctatgctgcccagactggtctcaaactcaagcctacagaacatgaggtcttcttttggagggcagtggcatgatcatagctcactgcagcttcagcctcccaggctcaagtgattccccccaccttggcctcccaaagttctgggattacaggtgtgtgccaccatgcccagctaatactttttaaattttgttgtagaaacgaggtctccctatgttgcccagactggtctcgaactcctaggctcaagcgatcctcccacctccgtctcccagagtgttgtgattacaggcatgaaccaccatgcccagcttgaggttcttaatagttcatcttttttttttttctggtaactacaaattacttttttcataatttcaatttctgtgttagattcaggagtatatgtgtgcttttcttacatgggtatattgcatgatgctgaggtttcaggtacaactgaacctgtcaatcaggcactgagtatagtacttaagttagtttctcagcccttgccccactccctttcttccccatctagtagtccccagtgtgtattgctgccatctttatgtttgtaagtatccagtgtttagctcccgcttgtgagaacatgcaatatttggttttctgttcctgtgttaattcccttaggataacggcctccagctgcatccgtgttgctgcagaggacatgattttgttcttttttatgctgtgtagtattccatggtatatatgtatattaccatgttttctttatccattccaccattgatgggcacggaggttgattccatgtctttctattcactttctattgtgaatagtgaataggtaatcttcttagaaaagaaacatccgttataataatgatatgaggcccaagacatcacaggtgatgagaaaccaatttaaaaaccctcctcatcagcagctttaaaaaaaatcaccttcagtctggaattttaacacagcatttttttttttagtatctgtttcactataacacaggtataaacaattcaataatcttggccaggtgtggtggctcacgcttgtaatcctggcactttggaaggctgaggaaggaggattgcttgagcccaggagtttgagagtagcctgggaaacatagcaagaccccatatctatttaaaataacaataaataataataataataatcaaattcaataatcaaacactaccttctgagaattctattcagaagggtatttttgcttccaagaagagatcataaaagtgactgacactctacgagcataaaatagaatggttataggaacacaaagaatagggctcagcattgcatcatcacggtgcgtaagattattcaatccaatgcctagtgaacagttccatttttactgggaaaatgaagtccacacatttgcctggtattctcttgcatttcctgctagaaatttttcttcctccacctaacctaaatctcttgttataatttaaaccagttttccctgattttatccatagattatataaaaagagaatgtatcaagtatctttggaagaataactaacttcactgatttggagataggctttaagtctttttttttttttttttttagacagagtctcactctgccacccaggctggagggcagtggcgccatcttggcttactgcaacctctacttcctaggctcaagtgattctcctgcctcagccccctggagtagctgggattacaggcgtccatcaccaagcccagctaatttttgtatttttagtagagatggggtttcaccatgttggccaggctggtcttgaactcctgacctcacgtgattggcccacctcagcctcccaaagtgctgggattacaggtgtaagccactgtgcctggccgcctttaagtcttcttttagccttttccttccagacaaaataaacccagttttatgtcttctgtttattggttctattttcagatctcataatcatcattgttgagtatcctctgggaattctccataggctaaacgttacttttaatcgagggcacctagatcaacgttggaagttttattgagaggtgtaactattgctgggattaatagtggatgcttttctagttggtctgcaggtcaaacttatctcaggatcaggtgtctgccttcttaaacaagaatcaacaatgcagaacaacgaacaaagagcaatgtttcattctaacaacaaattcaaggagaaaggatgatcaggaaaagaatacatccattaagcccatatgaaatgcaaatatgcattccaaactcaaaaacagcaacaaatagattcaagcttatccaataattgcattgcatgaggcagtgttggaagatttagccccctcacgttctgctctgcttgagaactgagcttgtgttgtcgtgtctgtcacctctccagatttaatgaggtagctggaacaaactggcagaatgaattgtaatgattcacaagagttcatcacctccagcaattaattttatacaatttatcagtttagtcattcagggcacatttgaataatactcttcaaaaggttaataaaaaataccatttttgattaatattcgcttgagagtaggaaaaaaaaggcatgggaagactttttcaatatttgccaagagccaacttaaatgcaagttgatgtcataaacaagttcatctgacttcagaaaacaacactctagcattccctttcaataatattgttgggacaaaaggaacaatggagggactctcccaggagacaccaacttcagcaacagctgtaacatccagggaggcgtggtgacttcttacacttggcccaaatgcttggaaccaggtgggcacctggttccaccaagacctccatccccacctccaaaggggcaacttctgccagccgccattttgagaggtctcacttgttaacagattatccttcaaacccaaagacatcaggtgattccagctttctttgtcctcagagtgcctactagagcaatccttggtctaattgggcacagtcccaaattcttatttagactcagaacgcaaacttctatgggcgttttctaatctctttctgaagcatgttctggggacactgttagtcctccgagggaagcacgaagcgcagcagcaccagtctgctgagtctgcgccctggccggtgtccgcatcttccttctaggtgaagaggaaccctgaaggcttccagtagcagctttggttcacatctccctgctcttgacctggatccatgaaatggacccacagccagcttccaagaagagagacatccaggacccttacctgtccccagtattgtcacattccaaacaccagcctttccggactagctcgtatctcaggacctgagctgctcagacaaatactcaggctgtgattggcccatggttctgaagcctgttacagtatgtttaggggctattaccaccttatttacagcaatctgtgctctaacacaggttcaaccaacccgacaggccctcctccggtggcccagatgatgacccatcccttaacgccactgctctgatccttacttcctcagccctttttcccacctctacagccactctgcaaattcccaaacccgatcagcacccatccactctcatctttgcttttatatgaaggtctccaggcacccctgagaaaaatcaaagagggctttgcaaattggtgccaccgttaaggtctgatgaccaagctcagctgaatctccagtagtactcggagaccctccacgtacctctcaatacaaaggatttccaagcacctttccctttgatcccccacgtgggtcatttcatatcaccaccatgcccccatattcccagtctccatcctcactccctgactctgaggagaggataaaagccatgctggggactcccttggctcctcccaacctgcatacctgtgtgcacagacttgtcacacccaccccccaacacgatgtattttcttcctgcatcagagagcacaacacttctcatgtgctggctttcaaccctcacctacctctttgagagcacggcatcgtcactcccacactaccaggctgtgccccctcttctggggctcctcacctgcaaatgctgaataacccaagtctctctcatctttaaaaaacaaccacccacccccagacctccaactctcctgaaaagtgactcagcagtaagtgtcaagagtcctataagtgcccatatctttggtttcagtaattctgcttttaaaatctgtctttgaccaggtatagtggctcatgcttgtaatcacaacactttgtgagtccgaggtgggaagatcacttgagcccaggagttcaagaccagcttgggcaacatagggagactgcatctctaccaaaaaataataataattaaaaaataaataaaatatttcttaagaatgtgccctaaaatgcagacaaatattgaggcattagatgtttactacagttctttatattagcatacaaaaacaataaaactaacaatgcctaaagatccaataatagagtttaaatgatatttactaaatagtttcaacaaagtaagaatgcttatgatacaatgttgtttaaaaaagatggccaggtgcgcttagacctgtaatgccagcactttgggaggccgaggcgggcagatcacctgaggtcaggagttcaagatcagcctggccaacatggcaaatctccatctctactaaaaatacaaaaaattagccgggcgtggtggtggacgcctgtaatcccagccactcgggaggctgagacaggagaattgcttgaacccaggaggtggaggctgcagtgagccaagatcacaccattgcactccagcctgggcaataagaccgaaactccatctcaaaaaataaaaacaaaaataaaaagattatattgtgtgtgtagtataagaaaaatgtaaaactattcttgcaaaaaaagattacatgaaagaaatacactaaattgttatagtggttatcttacaacagtggaattataaatgttattttcttctttgtacttgtctggattttccaaaattcatatgtatgattctataattagaaaaaaatgcttaataaaaagaatatcagtgagttcaataaaaatccatcaacattctatctgaaggtctaatactaagtaaatgccaaagttctttcaacaaataaaactttagctcaaagagatggcacattactcaggtgaccctgcagtaatggcaaaaagaatggcagactgtgtggctgccagtggctgtggcagtgtgttggggagggatgaataggtggaggacagaggattttaggggagtgcaaatagtcagtatgatactataatggtggatccgtgtcattataaatttgtccaaactgatagaatgtccaacaccaacaatgaattctacatgtaacaaactcacacctgtactccctgaatctaaaatatagttgaaattacaaaacaaaaaataaattaattacagagaggagtcagtataggctcatcagttgcagcaggtgtactactctggtaggggacgttgataatgggagagactctacatgtgttggggcaggaggtatatgagagatctcataccttccactcaattttgttgtgaacttaacactgctctaaaaaaattaagtcttaagaaatgtaagaactgtgtaaccgaagtatctcctagctacacaactaagatgacaattacatatgcatagcgaaaacaatcataggtaaggatcattacaaaatgatcatcgttgccttgttaagatggaggagccctaataactatttttctttaatttcaaagcaatgtcatttcattctggcaataaactgaagaaagtgaaagggcaagaaagtgcgaacctacagtttaggtttcattcacattaactagagcattgtttttacagcaggtgcgatccagtgggttataaaacaaacttagtagatcgtaatcaacataataaaacaatccagggatggtgactcctgcatgtaaccccagcactttgggaagctgagacaggaagattgcttgaggccaggaattcaagactagcctgggcaacatagtgagaccgtgtgtctctacaaaaaaaaagttattaaattaaaaaaaaaagaagaaggagaaggtcaggtgtggtggctcacactttgggaggccaaggtgagcagatcgcttgagctcaagagttcaaaaccagtctgggcaacatggtgaaaccccataatctctaaaaaagatacaaaaattagccaggcatggtggcacacaattgcagtcccaactacttgggggactaaggcaggaggatcacttgaacccaggaggtggaggctgcagtgagctgagatcatgccactgccctccagcctgggtgacaaagtgagaccctgtctcaaaaaaacaaaaaaaaaagaagtgatatggtttggatctgtgtccccactaaactcgtgtcaaattgtaatccccagtgttggagatggggcctagtaggaggtgactggatcatcagggtctggagttctcatgaatgagttagcgccatctccttgatgctgttctcatgagagtcagtgagtgagttattgtgagatctggttgtttaaaactgtgtggcagctgccccctctctcttcttcctgcttcagccatgtgaggtactgcttccccttcgccttcaaccatgattgtaagtttcctgaggcctccccagaagcagaagccactatgctttctatacagccttcagaaccatgggccaattaaacctgttttctttataaattacccagtctcgggtatttctttacagcaatgcaagaatggatgaatacaagaagaaatatttatagacatctgcaacactcctgggtctcaacccttcagagtgtgcaaagccatatgtcttcatttaagagagaaaggtgttcttgagttaagaaggttgacagaaatcttcaaacaaactttggaagacagagacagaaatgagatgaaagatttagcaaaataggggaatttgtcactgaaagggtgaattcccaagagaaaccagataggtctccccatagaatgcctgagagcaatacttgggggcaccatgtccctagaagacaagggataaggcagagttctgaaagcagggagagtggttgaaagtctccctatcgagtaactgacatgtgccacatgcagatttctagagactacagctaagtgaaaacgcacatgcatatgcaacacacacacacacacaaactacaccatacgataagtttccaattgcttcatccaagggtacagaaatttaggaactccatgcagttggagaacctcttagcacagcttgctccggcccccagagtcagtaacctcccaagcaggggctgctgacactgtccacacaaagcagggtattacctaatctgagaagctccaatgtaaatgccacagttcttttttttgggatggggtctcactctgtcatccaggctggagcgcagtggtgtgatctcggctcgcccaggttcaagtgatcctcatgctgtgcctcagcctcctgagtagctgggattatagacatgtgccaccatgcctggctcatttttgtatttttagtagagatagagtttcaccatgttggccaggctggtcccaaactcctgacctcaagtgatccacccacctgggcttcccaaagtgctgggattacaggcatgagccactgcgccaggctggactgccacagttcttatatacttaaggcttacatcaccactcagaggacttacatcattttcgcccttaagaagagatatttggccgggcgtggtggctcacgcctgtaatcccagcactctgggagaccgaggcgggcacatcacctgaggtcaggaattcaagaccagtctggccaacatggtgacaccctgactctactaaaactacaaaaattagctggggctgggcgcggtggctcacgcctgtaatcccagcactttgggaggctgaggtgggtggatcacaagttcaggagatcgagaccatcctggctaacatggtgaaaccctgtctctactaaaaatacaaaaaaaaaaaaaaaaattagctgggcgtggtggcacatgcctgtaatcccagctacttgggaggctgaggcaggagaactgcttgaacctgggaggcagaggttgcagtgagccaagattgtgccactgcactccagcctgggtgacagagcaagactctgtctaaaaaaaaaaaaaaaaaaagaagaagaagaagaagagatatttgcagatgcctgccaccctcctggatcctaaacctaattcagagcctgaaaagctatgtatgtaaggtttctgaacttccatctctagctttgtcatacagaaaaacccatctcttaattcaagagactgaatgattcttccctgaagacactaaatgacagagaaaagacctttaggtactaacaatgaagcctccagtcaacctgtctatgccctcagaactgcctgtcagcattttaagcaccctgcttctaactatgagtagaggacaagagtcccaggcatttgaaaatagcctgtgccaagaaagagacagaaaagaacaaataggaaaaaaaaaacactggatacagtaacaaatcacagagctgaacaaattgctacacacacatacacacatacacacacacagagtatactcagagatggttaaaagatgaagttcctatgtcaataaaacaaataacagagtttcctttttaaaaaagagataagaaaaagttcttaaaagttaaaaactatgataaccaaaataaaatcaaaggaatctccaataaactggaccccccccaaaaaaatagatgtaagctgggcgcagtggaatgcttgtagtcccagctactccagaggctgaagcaggaggatcacttgagcccaggagttcaaggccagccttatagcaagatcccatccttcaaaaataatttttaatagatggaaaattaatggaaaatataaaactatagagggagtgctgggtgtggtgactcatgcctacaatcctggcactttgggaggccaaggtgggtggatcactcaagaccaggagttcaaggccagcctgggtcaacatgacaaaaccctgtctcaaaaaaaaaaaaaaaaagccaggcgtggtggcacatgcctatggtcccagctactcaggaggctgaggtaggaggatcgcttaagcccgggaggcagaggttgccgtgagccgagatcatgccactccactccagcctcggtgatagtacaagactctatcaaaaaaaaaaaaaaaggcaatcaaatgcaatcaaacaagaaggtgtaatgatatcaagaaagatgaagcagagataatggagaggaagaaaatatcaaagaaagaattcgaaattttttcaagaactaagtagatgagacttcagattttgaaaagcccatcaagtgtgcagcacaatgaattttagaagcccatcaacacgaaacttcagaacaaccaggacaaagagagcagcctgagattccaggaagacagtttacatgcaatggatcagaaaccagaacctgcagatgatgaaagacaagatgtctacatccagccaaattatccatcaagagacatgacattttgacacatgcaaagactaaaaatacaaagaaaagaaattgcctccagtcttttttttttttttttgagaaagagtcttgctctgttgcccaggctggagtgcagtggcatgatctcagctcactgcaacctttgtttcctgggttcaagcaattctcctacctcagcctcctgagtagctgggattacaggcacctgtcaccatgcctggctaattttttttgtatttttagcagagatggggtttcgccatgttagccaggctggtctcaaactcctgacctcagtgattcacgtgcctcggcctcccaaagtgctgagattacaggcgtgagccactgcgcccagtaatcgtttgattttacctaatgtagttttttttcaacctgtacaggttcatagaataaggatgtcattagtctactggcctgtaggtagagtaatacactttaatatatgtcctgaaagatagtatatatttatggtataaaatgtgatttttacacacatatgttataaagtgattaccacaatcaagctaattagcatatccatcacctcacatagttaaaaatctgtgtgtgtgtgttgtgacaacatttaagatctactttcaagattcaaataatcacaaccagaaatgataagagggatatcatcactgaccccacagaaatacaactaaccatcagagaatacaaaaacacctctatgcacataaactagaaaatctagaagagatggataaattcctggacacatacaccctcccaagactgaacaagaaagaaattggatccctgaatagaccaatagaccaataacttgttgtgaagttgagacagtaacaaacaacctaccaaccaagaaaagcccaggatcagatggattcacagctgaattctaccagaggtacaaagaagagctgggaccattcctactgaaaatattccaaaacattgaaaaggagggacttctccctaactcattcatgaggccagcatcatcctgataccaaaacctggcagagacacaacaacaacaacaacaaaaacacatcaggacaatatcctcgatgaacatcgatgcaaaaatccttaacaaaatactggtgaaccaaatccagcagcacatcaaaaagcttatccaccatgatcaagttggcttcatccccaggatgcaaggttggttcaacatacacagatcaataaatgtgattcatcacataaacagaaatgaagacaaaaaccacatgattatctcaatagatgcagaaaagccctttgataaaattcaacatcccttcatgttaaaaactctcaataaactagatattgaaggaacatagctcaaaataataaggccatttgtgacaaaaccacagccaatatcatgctgaatgggcaaaagctggaagcattcctcttgaaaaccagcacaagataaggatgccctctttcactactcttattccacatagtattggaagttctggccagggcaatcaagcaagagaaagaaataaaagtattcagataggaagagaggaagtcaaactatctttgtttgcaaatgacatgatcctatatctagaaaatcttatcatctcagcccaaaagcatattaagctaataagcaacttcagcaaagtctcaggatacaaaatgaatgtgcaaaaatcactagcctgttgttggtgaacaacaggcaagccaagggccaaatcatgaacaaattcccattcacaattgccacaaaaggaataaaatacctaggaatacagctaacaaaaaccactgctcaaagaaatcagagatgacacaaacaaatggaaaaacattccattctcatggacagaaagaatcaatatctgaaaatgaccatattgcacaaagcaatgtacagattcaatgccattcccattaaactaccattgacattattcacagaattagaaaaaactattttaaaattcatatggaaccagaaaagagcctgaatagccaagacaatcctaagcaaaaagaacaatgctggaggcattatgctacccaaactatactacaaggctactactttgaggctactatactgcttcaaactatgctacaaggctataataaccaaaacagcatggtactggtacaagaacagacacgttgaccatggaacagaatagaaaactcagaaataagacctcacacctacaaccatctgatcttcaacaaacctgacaaaaataagcaattttttgcttattttattaaataaataaaaataatcatttattaaaaggattccctatttaataaatggtgctgggagaactgactagccacacgcagaagattgaaactgggctccttccttataccatataaaaaatcaactcaagatggattaaatacttaaatgtaaaaccaaaactatagaaaccatagaagaaaagctaggcaataccattcaggacatagtcacgagcagatttcatgacaaaaatgccaaaagcaattgcaataaaagcaaaaattgacaaatgggatctacttaaactaaagtttctgcagagcaaacgaaactgtcatcagagtagacagacatcctacagaatgagagaaaatttctgcaatctagtcatctgacaaaggtctaatatccagcatctacaaggaacttaaacaaatttacaagaaaacaaacaaacaaacaaacccattaaagtaggcaaaggacaagaacagatacttgtcaaaagaagacatacatgtagccaacaaacatgaaaaaaaagctcagcatcactaatcattagagaaaagcaaatcaaaaccacaagaagataccatctcacaccagtcagaatggccattattaaaagtaaaaaaccaacagatgctgatgaggttgtgaagaaaaaggaacgcttttacactgttggtggaagtgtaaattagttcaaacattgtggaagacagtgtcgcaatccctcaaagacctacaggcagaaacgccaattgactgagcaactccattactgggtatatacccaaaggaatataaatcattctattataaagacacatgcctgtgtacattcattgcagcaccattcacaatagcaaagacatggaatcaacctaaatgcctatcaatgatagactgcactaagaagatgtggtacatacacaacatggaatactatgcagccataaaaaggaatgagattatgtcctttgcagggacatagatggagctggaagccattatcctcagcaaacgaacgcagaaacaaaaaaccaagtactgcatgttctcacttagaagtgggagctgaatgatgagaacacatggacacattggggggaacagtggggagtggagggtaggaggagggagagcatcaggaagaatagctaaggaggaagagcatcaggaagaatagctaagggatgctgggcttaatacctaggtgatgggatgatctgtgcagcatgctcaagtatataatacattattattaatatagtcaccaagatgtctattaaatccccagaacctattcaatctaaaacttcgtaccctttgaccaacatctccccttttcccaccaccacctaatacgttttttttttgtttgtttttgttttgagacggttcaccatgctggccaggctcgtctcgaactcctgacctcaggtgatcctcctgccttggcctcccaaagtgctgggattacaggtgtgagccactgtgcccagcctacaatttttaaagagaaaggattgatagtttttgctgattctgtgtttatcctttgtgttttagtaagttactacatatgctcctcagctatcacctttggattaaagaggtttcacctcttgggttttttttcctacaataggtttcttaattcccttatcattttgcatttttcttcctgaatcatgtctaactccatttcttgctcagaatggggactcacatattggtggaactgttaaattttgagaaatagcaactagccctctattaatattctgggtggagaattgctttggcttttctataggggttagagaacactaacgcctataactaacccctataacactaacactattgcgccactgcactccagtctgggcgacacagagagactctgtgtcaaaaaaaacaataaaatataaaacaaaataaattatccaggagtcagaccctcctatggttttcttgagaaagccttcctttaaaaagcccagggttttattgggtatcagaaacttacaacttgtgttacttttctccagatacaataaactcaactagcacttgtatttgccacatcttctggcagcttatcctgacaggtttaacagttctctggtaagaagtatctaatagcatctgcaaaccgagagacccagctgccctcttctttctgctagatcaattataaaaatgttacacacgacttgtcggagcactcattcctccagggctccatggtttacctttgaatgtcaggatgagcccttaaaacaattatcctgacgtccttcctctaagcgcatctgaaagccacaagactatctttccaaggctactccctctcaacccctctcccttgcgtctgaacccccatccgaggggctttctgaaaagtggaaaggagggacgttcactgtttcttcagcagcatggcatattcaccttctcaaaggactccagccaaatccagttccctcttccagaagccaagctgccttctccctaaaaaggccatctgcaggccaggcgcagtggctcacgcccataatcccaacacttccaaggtgggcggataacctgaggtcaggagttggagaccaggctgaccaatatggagaaaccccatctctactacaaatacaaaattagccgggcgtggtggcacatgcctgtaatcccagctactcaggaggctgaggcaggagaattgcttgaacccaggaggtagaggttgcgatgagccgagattgaggcactgcactccagcctgggcaacaagagagaaactccatctcaaaaattaaaaaaaaattttaaaaatttataaaggccatctgctgaagccttttgtaatgtatccttagtatagattttaccagcatgctctgggtagaaataagatttgccagacggaagtttcccagacactttttacacatgttcttaggatgaagattcactgacatctgccagtcttctaatttagcgaccctttgaaacaaatgttacattccacaaatttaaatgttagctttttcaagcttgctgcatgccatccagccaaaatggtgtaactcaatcactgttccggatttcatccagggcctgctgggcatttatcactaggccaggcagaaggggccaggaggcgccaggaggcagtggaatagcttgattgttaagtgggaaaactttggtaatcagtagcttgagagcttgtatttaaatcccggctctgtcatttatgagctaagtcgatgtgaaaaagttacctgatctttgtagtctccttatcaacaaaataggaaaaacaatgataaggacctcagtgatgctgggagaacaaaatgatattacatatgtcaacctctatagtgtagagtccagcaaagaatgagcattcagtaaatgtctgtaatcattaataaattacccaggccagtcacggtggctcacgcctgtaatcccagcactttgggtggccgaggtgggcagatcacctgaggtcaagagatcgagatcagcctggccaacatggcgaaagcccttctctactaaaaatacaaaaattagccagacgcggtggcaggcatctgtaatcccagctactcgggaggctgaggcaggagaatcgcttgaacccaggaggtggaggatgcagtgagccaagatcgcatcattgcactccagcctgggcaacacagagagactccatctcaaaaaaattaattaatataaaataaattatccaggggccagcccctcacatttatactcccatttatcttcatcaaggcaggcaaaaacaatctctgcttccccattcagaatcatcccattactaccccattatttatttcactaacagtttccatgttctgatgggaagagcctctgacagccatttcacaggtaccccagaaggacattcttgggaaacaacaaactatttgctgtctagctgacttacttaccttgtctccttaatcgcctggtctcatcagtcacctttccattattattatttaaataataagtttatcccagaaacagcagggatatacttagagatgagtaatctggagttcctttctttttctcttgaccactgaccaatggtcttctgatcatgtatttattcaagttccctgtaaggtgtttacttcagggttccccattttttcacttatgggtgtgtattcttctagcatcctttttcttttctcgagatggagtttcattcttgtcacctaggctagagtgcagtggcgcaatctcagctcactgcatcctccacgtcctaggttcaagcgattctcccgcctcagcctcccaagcagctgggattacaggtgcccgccactgcgcccagctaatttttgtagttttagtagaaactgggcttcaccacgttggccaggctgatcttgaactcctgacctcaggtgatccaccgacctcggcctcccaaagtgctgggattacaggcatgagccacggcgcctggccctctaacgactttttctatcattgagtggcagcagcagaattttgaattttgagttttcaccttccctgctgattccttaattgtactgcattactcctctaaggtgaatcactttcactcttttcccaccagtttctacgcacagtcatagcaccagttagtggggatcggaaggcaggtgtggcctgaaccaacttccctcgtctctctctccagacctcatgtcttcatatccaaatgcctttcacaggcttggcagaggcaggtaacatattaaataagggtaaagatcagcatcatacaatagggggtggaggagagagcagcaactatgaatcacaagctccaacgaaagccgcagccacagctctgccatagtcaagtgtggccaagaaaaacatgtcaatcactgttgctaagtcttcagatttttttcccaaaagcctgaaatctggatgattaggtgaaatattggagttgtcttaacgttgtcaattaataataataaaaccttgttcaggctgacacagctcacgcctgtaatcccagcactttgggaggctgaggcaggtgggtcacctgagatcaggagttcgagaccagcctggccaacatggcacaaccccgtttctactaaaaatacaaaaattagccggccatggttataggcaggtgcctacaatctcaactacctgggaggctgaggcagaagaatcacttgaacccggggggcaggggttgcagtgagctgagatcgtacctcttcactccagcctgggccaaagagcaaaactccgtctcaaaaaaataaataaaataaaataaaataaaaccttgttcaagctaaacaaagcacactgtgtgtggatgtggtctgcaagctctgtttggctgcaggcctcatttgaggctgctgaatcagatgatagctggagtccctcatcgcactaacactctacagctttgcttggctcaagagatttctcctttctgtggcttctgagactacctatttgaggaagtggtcctctgacccaagaacctcgcttctatatctcagccgaatattactgtcaaatctattctgaggtcaaagtctctcatttacatatatacatcaaatgtcataggttttttttcccctcaagattgccagctcaggtttccatgataaatgagaggaaaatttacataaaaaatttaaatctccacaatctcagaatgtcatttttggcctgctgtcaatctcagaatctcaggtaggcctgtcatgtcagcctttttcctgaaataaaatgttgaaaagacactggccaacatatttcaattattttcctaatccttgcacaccatctggtggcagaactagctactgtgaaatgttcagggaaaggcaaattaagtggatctgagggggcagaacagagctaggaagaacaggataagaggaacaacaataaggggaaaaaaatggaataacacagaaacaaactgttgacatgtattaagtccatgccagctacaagtaacctgcagaataaaaggttaactgctatgaattattaagtagccacttacgtgaaatgtgaacattctctctataaagacaattcctcataaaattgtctgtctgttatccatccacctgtatggcacagtaaaatttaatggaagaaaagaaggaaggaaggatagacaggtagttacactgaaaggacagaataatccacttgctatgaattgaattgtgtcccctaaattcatatgttacagtcctaaccccccagtacttcagaattcaactttatttggacatagatgttgcagctgggtgcagtggctcatgcctataatcctagcactttgggaggccaaggtgggcagatcacctgaggtccggagtttgagaccagcctggccaacgtggtgcagccccatctctactaaaaatacaaaaattagctgggtgtggtagctggtacctgtaatctcacctactcaggaggctgagacaggagaatcacttgaacccaggaggcggaggttgcatggagcgagattgcgccactgcactccagcctgggcaacaagagtgaaactccatttcaaaataaaaagagagagagggagataagaaatagacattgcagatgtaacttgttaagatgaggtcatactagagtagggtgggcccctagttcattgtcactggtggactcatataaaagggaaattcgggcctagacacacacacacacacacacacacacacacacacacacacacaaacaccacatgaaggtgaaggcagagattggggtaatgcaactgaagcaaaggtgcaccaaagactgcccttaaaccaccgcaagccaggagaaaggcaagcaacccattctctcttgagagttcctagaagaaaccattcttgccaggcttctagcctccagaactatgagatgataaatgtcagtgtttaggccacccagctcatggtacttccttatggcagcttagcaaagcaatccaccatatatctctggctttgaattttatgccttttatttttaatctcaaaaatcatcactgttgttttctatctcattacaattccatattataaaaccagatcatctacattccaaagataaagtcagcagattccattcaacttagcaaatatttatttagtagctaccacagtgaggtatttaaaatgaaataataactcattcctagactcacaaaattctagcattagaaaggacaataaagctgattaggtacaacacttctcatcctaaaactgaagaaatcttctcatgaacctaggtgaaaaaaatcttcaacaaaatattagcaattcaaatccaataatatataaatagaattacacactacaagcaagtgggatttatcccagaatgcaaagccagatcagcattcaaaaatcaattaatgtatggccaggtgtggtggctcacacctgtaatcccagcacttcccgaagtggggcaaggagggcggatcacttgaggtcaggagttcgagaccagcctgatcaatgtggcaaaaccccatctctactataaatacgaaaattagccaggcatggtggcacacacctctaatcccagctactcgggatgctgagacaaatgaattgcttcaacccaggaggcggaggctgcagtgagctgagatcgtaccactgcactccagcctgggcaacaaagcgagattgcgtctaaaaaaaaaaaaaaaagaaaaaaaatcaatcaatgtagtccaagtatgatggctcatatctgtaatcccagagcttcaggaggctgaggcaaaaggatcacttgaggtcaggagtttgagaccagcctgagcaacatatcgagaacccatccttacagaaaataaataaatagccaggcatggtgacgcacacttgtagtactacatactcaggaggctgaggtgggagggtcacttaagcctgagttcaaggctgcaatgagctatgatcaggccactgcacttcagtctggtgacagagcaagaccctgtctctttaaaaaaaaaatcaattaatataatttatcacaccaacaggctaaaaaagaaaaatcacatgattatatcaacagatacagaaaaagcatttgagaaaactgaacatcaattcatgataaaacttcttagcaaactaggaagagagaggaatgcccccaacttgataaagaacatttacaaaaaactacaattaacattatacttaatgatgatatactagaagctttccctttcaggtcaggaacaaggcagggatgaactctctcattactgcttttcaatatcatactagtcctagctaatgcaataggacaagaaagggaaataaaagtatacaaatagggaagaaagaaaactgaagaaatcaaggcccagagacctggtgattataccttcagtggtacagtttgaggcagaattaagatgatctccacattcccagcccaaggctatttgcacttagcatctgacactttttctcatccaccaaagctaaaacccctactgttcattttttccagttatgcaaataattataaccagagaagtcttttgctaataccagagacctatgtataacagtcgatggttgacatatgtagggcatgcgtcagacaccatggaagaagcacattacacacagtacttcatttaatcttcctcataaccatgagaagtagatactattattattcccacttgataaggactctagggcttaaaaaagttaagtaccttgttccagatcgacgagctagaaggtttcagagctgggctttgattccagagcccattctcttaacagcaatgcaacattgcctccttgagcagaaagcaaagagatatacgctggcaccagttagactggccttgcccacttttaaagtcactatgatattgaaccacccatataatgagaaggtagctctcttttttctttttttgagacagtgcctcactctattgtccaggctggagtgcagtggcgctgcaatctccacctgctgggatcaagcaattctcgtgcctcagcctcccgtgtagctgggattacaggcacccaccaacaagcctggctaatttttgtattttcagtagagtggggtttcaccatgttggccaggctggtctcgaactcctgactccaagtggtctgcccgcctcggcctcccaaagtgctgggattacaggcgtgagccactgcacccggcccatgagagagtaacacttaaagctccctctgccccatctaatactaacggtttctgtgaccaccataaaaacaagcagagaggccaaaaggcctaggcttacagagactaagaagaaataaaaattcaactgacgacaataatgacactagtactgagtcattctgtgtcactagtattacatttatcacagaagtgacaataaaataggtagaaaaagctctaagtaaagtttttgaactgtcaacattttgcaaaagatatctgaggccatctaactagtttagcttgatcaaacgtgggctcttatctcttcctagagagtgatgaggaacttagaaaagattgtttgtatatctctactgagggtctggaacgttattgagaggaggagccattacttcctttgagattttaagataactaaacagaccttgtattggcagggaaatccctgtttctaagagaaatgagatgggaggatggtaaggaaggaggggaggaaggtacagtcactatctgctgggctttcttccttattaagaaagcatccagttttattttattttttttttttggagacagagtctcactgttttgcccaggctggagtgcagtggtgtgatcttggctcactgcagcatccacctccctggttcaagcaattctcctgcctcaacctcccgagtagctgggattataggcacctgccagcatacccagctaatttttttgtatttttagtagaggcagggtttcaccatgttggccaggctggtctcgaactcctgacctcaggtgatccggccacctcagcctcccaaagtgctgtgattacaggtgtgagccaccactcctggccaagagctcttaaacaactttaacaaatcaccgcacaaatcccaaacgcaccaaagcccaactcttaatagtgtacttcactttcatttactctgaaacatgttggatcacagtgtgaaataaattgttaccagtctcatcagtggtttcaggaaggggcattttctctggagttttgatctaccccatggttcacagttctcaaaaaaaatgtaactttctggaaactaaataatctgggaatattttttgaacaaccaaccattttctgtagtgaaactgcaataaatctatatcctgggctacataaatcaatatatggtagaaccaaagtaagattgtttttccattactacaattaacttaattgtgttaaaatctgaacatttctagcaatgaaaatttcagtatggttgatagtacagaccaaccttttcctatgactgcttgaaccctgttgaaagccaagtttaaatttttatgatgttatcagatgtaaacaaacataaatatatctgccaacaactgagtaagaagtgttgtttttcttcttgtaaattacttctacttcatgaaggcaatccaccccagctccaagatcttccatattcaagcaggtcataaattttcttataaattcactctttcagaaagttaaagctttattcaaacttaaatacagccaattaattttttaacttatatgcaagatgagtcaagaggagctaaaatggtatgcaaaatgctatcaatttcatggcacaattttagtgttactaaatgttactgctcaaaattccatatgtaattgctttttgcttcttgcaacaactcattggttttttcctaacagcatggcacttaggatggtggtaaaggtgatgtactcaacgaaaattgttcttaaaagtcccaggatggctggtcatgtaatgcctttgtgatgaaaattgtacacctgagtttagaaaataatgtaggaaatttgaagtcactaaaacaaggcagaggaactataaagatggaagtatcttgggaggctgaggtgggcgaatcatgaagtcaggagatctagaccatcctgactaacaccatgaaacccagtctctactaaaaaatagaaaaaattagccgggagtggtggcgggagcctgtggtcccagctactcgggaggctgaggcaggagaatggtgtgaacctgggaggcagagcttgcagtgagccgagatcgcgccactgcactccagcctgggtgacagagcgagactccgtctcaaaaaaaaaaaaaaaaaatagatgagagtatcaattccaaaaggtacttaataatgagtgcaattttcctgacctttgaaaggtgaagtggacagcacaaatgtaaagtgcaaggatgactttattcaaacttaagtagaatgttgaattatacaatccaccctaccctgcatctctaatttcacaggctgaacaatgctccttttccaaagaaaaaaatgagtgtgaatgagagtcaggtaaagctagacatgtgaacctcccaattgatggctagtttcgtgctcttaaatttaggtcctacccctggctccagcaagacagaagccaccagccaggcagtggctgagcacagatcccacaccctccaaagtagcagctacagatctttgctgccaacctggggatgtacccactaattaatttcacaatgcaccctcaagtaagcacacttgctttgccaatgccagaatttcctttcttctagttttccaggtcattgattataatgacaggaagatagaaaagatgaggatcagcccagtatggtggctcatgcctgtaatcccagcaccttgggaggctgaggtgggaggatcattttaacccaggagttcaagaccaacctgggcaatatagtgagactctatatctacaaaaaaacttttttaaataaattaggccaggcatggtggcacatgcctatagtctcagctactcaggagtctaaggcaggaggatggcttgattttaggaggcagaggttatggtggcgtggaggttgcagtgagccatgttcatgccactgcactccagcctgagtgacagagactgtttcaaaaaaaaaaaaaagaggtttctagaaattactagaatcttctagatcaaatgaaaggcaggagagtgtttttagtaaggatattaatggtaaaatctgcaaattatgtttgggcgtccagttcaaatatctacatttaggaaaagactgaattttgcagcagtgttacagggaattggcagatctggttctagttggttgaaaaacaccttaaactaacaataaaaatgatttaggcttaaaacttacacacatacaaccgtgagtcaaatgaaaataacctgtaagaaaatatttattagagaaacaacagcagaaatgaagttgcctcagaatagcacagcaaagaaaaagacagcattaggcagaagccttaaaaaactcatcagcgggcttaggaagaatgaaatagtgaccactgcagctttagcatgttatgggccagatgccgaggctcacgcctctaatccgagcactttgaggggctgaagtgggtggatcacctgaggtcaggagtttgagagcagcctggccaacatgatgaaactccatctctactaaaaaaagaaacaaaaattagctgggcatggtagcgggcacctgtaatcctggctactcgggagccagaggcaggagaatcgcttgaaacagggaggcaggggttgcagtgagccaagatcgcaccattacactccagcctggtgacagaagcgaaactccatctcaaaaaaaaaattgttatgtacaatttcccaaaatacttctgaagattatgtttcctgcctttcaattataacatgcaatgctacacttctgatgtcaagataaaatttagcctcaaaatttattctgctaaatcatccaccaggtactttatatatttatccaacaccattctaatttactttaacaaataagtgctaaagccttattatagttcagaactatgtctaacttcttatacgtcttaacgtgttttgaaatagctggcatttcttaaaggttgatcctcaaactgctttgctttgaagtttcagtgagtttggttattttttccttttgctttattcttttttacccatgtattatacataattataattttctcagaacttttacaaataattattattctgaggttaaatttgaatatgttctgtgccttcactaggctgagtataccagaaacctccattcctaacactaattggccaactgcagaagcaaaaatgtcacaggagttggcactccactaagaaaacgttttaccaaattacaaagagaaagagaactaaaaagaacatcagactctcaacttctagaaaaataaatataacgccaaacttgggtcaaacacaagaaaaactgcatacctctctggcaggcagccttgtcaagtcaaaaagaaactagacaagttccagtgcagtagatgaccacgttttcactgttgaaagcaccaagcccaaataacacctcctggtaatcacgtcaggaaatgcaaatgcatgccatgtgaaaggaatggtcacatttcacttttttatataaacaaaggaattttttttttttttttttttttttgagatggagtcccactctgtcacccaggctggagtgcagtggtgggatctcagctcactgcaagctccgcctcccgggttcacaccattctcctgcctcaacctctcgagtaggtgggactacaggcgctcgccaccacgcccggctaattttttcatatttttagtagagacagggtttcaccatgttagccaggatggtctcgatctcctgacctcgtgatctgcccacctcagcctcccaaagtgctgggattacaggcatgagccaccgcacctggccaacaaaggattatttttatgtcattttagctgtatatgacataatttagattgtccttttattttcttacagtcagaagttacctttatactttcaatatttagaatatgtatacattcttatagataaaaacatatacctgtgtgtgtgtgtgtgagaaagtgagatcataaactttctttttgaggtcctaattatttcagccttgttcatgtttatctttataacatcttaagaagaaaattaatagaataaacaacattgcaatggctctcccagagcataatttcaggtggttttttctacatttctgttttttttctaaattttctacaataattatgcattactgtcataattttttaaaatttaattaaagattgctagagaaatacaaaataggctgggcacaatggctcacctctgtaattccaccctttgggaggccaaggtgggaggattgcttgagcctaggagtttgagatcaacctgggcaacatggcgaaaccccatctctattaaaaatacaaaaatttagacaggcatggtggtgcacacctgtagtcccagctactcaggaggctgaggcaggaagatcgcttgagcctgggagatagaggttgcagtcagccatgatcatgctactgcactccagcctgggtgacagagtaagaccctgtctcaaaaaagagagagacagagagaaaaatacaaaatacagtagctactccaatacaggaagggaagaactgggctttctggaattctggacagctagaaatagatattattcagggacatcacctcaacacactccactcaataaaatagggctttgttgatactgggtttgggttgagaaagagcccagtatttgcaagcattcttttaatcagagtgataaggtttggatctgtgtccccacccaaatctcatgttcaactgaaatccccagtgtcagaggtggcctggtaggaggtgactgaatcatgggggctgaattctcataaatgagttagcatcatccttctggtgctgttcttgcgatagtaagtgaggaagttatcacgagatctggttgttttaaaagtgtgtggaacctctcccctcttgttcctgctcccccacataagatgtctggctctccattcaccttatcatgattttaagtttcctgagacctccctagaagtcgagcatgcttcctgtatagcctgcagaactatgagccaattgagcctctttttttttttatgaattacctagtctcaggcatttcttttctttttttttttttttttttttttttggagacaaggtctcactctgtcacccaggcagtgacagaggtgtgatcatgcagtggtgcgatcttggctcactgcaacctccacctcccggattcaagtgatcctcccacctcagcctcctcagtagctgggactccaggcacagatcaccacgcccagctaatttttgtattttttgtagagacaagatttcaccatgttggccaggctgtcaggtatttctttatagcagtacaaaaatggatttatacaaacagtgaacagagctggtataagttcttcctaaatggtgaagtaaggccccagagcagaaggaggtgatatggtcagcactgagcttcaaggttcaacgagaaccctatcctgctcaacaacatcattggcagacatgaggcaacattaactcggcaggcccagagaagctgcgctgcagagaactgccccactcctctgcgagggcccctcccttctgacaggcttagaactctaggctaagtaatggggattgaatccaatgctacatgttagggtggggatggtatttttttggtcaatccataaattacctgaaacactgcagaagaaaggactctttccaatcacttttatgttagaaagttgcagaatgtatcattcctaattttaaatgacccatctttgcattaggcagacctaaacagacctctaatttttgattctctgtagcatattgactagaacacactagactaatgcactagaaaacaatctggcaactaaatttccttataaatactcagtttccttcagagtactcaatactttgtttttcaataaaatttaataggcttggctgggcacagaagctcacgcctgtaattccagcaatttgagaagctgaggcaggtggatcgcttgagcccaggagttcaagaccagcctgggcaacatggcgaaaccccatctccacagaattagctgggtgtggaggaacatgcctgtggtcccagctactgggaggctgaggcaggaggatcacttgaacccaggaggttgaggctgcagtgagctgtgtttgtaccacgccactacagcctggatgacacagggagaccccgtctaaaaaaaataaataaaaatggactggctggggaagtttgaggagaccgcattaagaacattataacaatttcttcaacaattgctcccttacaatctgttattaatataatagttagatttgtctttggtcagagcaggtcactcccctgcacaaaacttctctccaggaaagagccaaatcctcaccatggcctgcaaggccatactcaacatgccccctcacgacctctgaaatcatctactcttcccttcgctcactggaccacagggtctttgcaccagctatgccttctgctcagaacacttcccccagatatctcatgggcccctcccttacccccattgaatctgttcaaaaccccacttctggctgggcatggtggctcacacctataatcccagcacttcgggaggccaaggcgggcagatcacttgaggtcaggagttcgcgaccagcctgaccaatatggtgaaaccccgtctctactaaaaatacaaaagttagccgggcatggtggcaggtgcctgtaatcccagctactcgggaggctgaggcagagaattgcttgaacccgggaagtggaggttgcagtgagtcgagatcgcgccactgcactccagcctgggggacagagtgagactccgtttcaaaacaaaaacaaaaacaaaaactccttcttacttagtaaggcctaccctgaccaccctatataaaatgcaccgtttcacctttatttattttttttttttttgagatagagtcttgctctgtcgcccaggctggaatgcagtggcgcgatctcagttcactgtaacctctgcctcccaggttcaagcgattctcctgcctcagcctcctgagcagctgggaatacagacacacgccaccacgcccagctaatttttgtatttttagcagagacagggtttcaccatattggtgaggctggtctcaaactcctgacctcgtgatccacccgcctcggcctcccaaagtgctgggattccaggttgagccaccgtgcccggcctattttactttttatgtattgccattattctacactctacaatatgagctccatggggcaatgatgtttgtccctcacagttatggggagaagcctctactcaaagttaagtggcttattaaactgttcaggacaagaatctggggatcctgacctcaaacacagttgtcttctgacaaaagcaaaacacggctgacccagtgaaaatttagactaagtggcttaatatatgacaggggaaaataaaaagacacctgatcccacacccacccctctctcttttgtaattttctttttctttttttgagacagggtctccatctatcacctaggctggagtgcagtggcacaatcaccactcactatagcctcaacctcctgggctcgagcctcccacctcagcctcccaagtagctgggactacaggcatgcgccaccacaccaagctaatgtttatattttttgtagagacagggttttgccatgttgcccaggctggtctcaaactcctgaactcaagcaatccacccaccttgtcctcccaaagtgctgagattacaggcgtgagcctcagtgcccagccttgtaatctaattttctaaatatattactcttcagtttgcacctggcccagggaagcagtactatttcctttctagaaacaacacaaaaaaagtctacatacctaaatgcaaagatgtgctgtcccacttcaaaaaaaaaatactatgcagaaaatgttcaacaaatacgttgtgatgaatggaaaactcctaataaagtaggtagttattatttatattataataaatcattatggtattaaaagattcctctcttacagactcatttactgtaacattcttttaagaagtgcatcatctttttattatggtttaaattttggctcctttttttaattttcaaatttttaaaaattttttgtgataaaatatacataacatgaaatttcccattttttttatttcaatagcttttgaattacaagtggttttggttacatgaatgaactgtagagtggtgaagtctgagaaatttaccatcttcacctttttttttttcttgagacagagtcttgctctgttgcccaggctggagtgcagtggcattatcttggctcactgcaacctctgcccgctgggttcaagcgattctcctgcctcagcctcccaagtacctgagattacaggcgcccaccactacacctggctaattttttgtatttttagtgaaatatctggccaggcacggtggctcatgcctgtaatcccaacacttttggaggctgaggtgggcagatcacctgagttcaggagttcaagaccagcctggccaacatggcaaaaccccttctctactaaaaatacaaaaaattagttgggtgtggtggtgagcacctgtcatcccagctactcaggaggctgaggcaggagaatcgcttgaacccggtgggtggaggttgaagtgagcagagatcatgccactgcactccagcctgggtgacacagtgagactccatttcaaaaaaaaaaaaagaaaaaaagaaatatctattaagccctttgcccattttttcatcaggttgttttgggccccatttttaacatttccatctaatacaactattgatgctgggggcattctgattcaacagctatttgagacttgggagttgtatttatgtcttggggactcttggacacacactgtagaaaacagaatatgtgatttggtaggttttaggtatcctataattgtcttaaggcctgcttattctctgcctgtttgctattgagctgataaaataatggccataggaaacaatctggcacagtggcataaactgtggtcagaagcccagattttgccaagaatcagttctacatgtttatgtaagttgaccagcatctctagggagattaacgtgagatgattcccaaggttcaactttaactatctgacgctatgcctttatccacaaggcaatgataaccatatattcttcaaaatattggaatccagagagggattctcaggtcagtagtcacaaagcatttgttttacatacttctcagaagccaaatattatagaataacacaaatatcacatttattgacccagatcttcttccatttatgcatgcaggcatgtaagcctttttgtttgtttgttttttgtttttgttttgttttgagatggagtcttactccatggtccaggctggagtgcagtggtgcaatctcagctcactgcaacctccacctcctcggttcaagtgattttcctgtctcagcctcccgagtagctgggattataggcacgcgccaccacgcctggctaatttttgtatttttagtagagatggggttttgccatgttagccaggctggtcttgaactcctgacttcaggtgatcagcccgcattggcctcccaaagtgctgggattacaggtgtgagccaccgtgcccagccagcatgtgagcctttataaaacgtcagagcagtaaattttggttccctttccaactccttgctcttagagaagtggcttttttgttttggggatttttttctaaacacggaaactttagttctgaaaaataaaacttaattatgaagaataaaatgtaaaatttgagctactctgatttaagagaatttggaaggtattcagggattccataaagcctggcctgaaaaaccactgcctttgagtgccacatcttcctgttcagtagtagagggagagagaaggagtaaatcaggaatgtgcagtgaagttacaaaaatgagtaaggaactcaaaattgtcaataaaaacaatcaaaaatcacttttcttctattattgtttcatgttgccattttgtgtggggttttttgttttttttttaatttgagatagagtcctgttctgtcgcccaggctggagtgaggtggcatgatctcagctcactacagcttccacctcccagactccagtgattctcctgcctcagcctcccaagtagctaggattatagccgtgtgccaccacgcccagcttttgtattttacaataaaaatttttgtattttcagtagagaaaagtttttgccatgttggccaggctggtctcaaactcctaacctcaagtgatctaccccactcagcctcccaaagtgctgggagtacaggagtgagccaccatgcctggcccacatatgccattttgaaaccttagtgagcaattttcctatgactttcaaaacgtgccttttgaaatttacgcctggagatggtgttcagcctctccgtgacaaataatattaatttactgcttttgtacattatttggaatatcatttactacatgtcacgtcttatgctaagtattttacctcatttaatccccacaacaaacacatgaggaggataacaattattttccatcttttaaaatgtggtaactgaggatcagagagattaagtaatttgcccaaggtcacacagctataagtggtagaactgggcttagaagccaggcaggctggcagcagatccccaactctgaatatttttaccaactatagccctgtttggagaacatagctgagctaaatacactctgacacagcccctctatcccttcataagacattttctaaaagttgaacaccagtgtatgggatagcaaagacaaacaaatcatcctcagaatagaaggtagttccttgagtgaaagaggtaagaagggaggggcagccctcacatccacaaagggtcccatgcttagaatcatggccttatttaggctgtcacagagaaaccccaatgaggccaaaagacagagacgtcctttatacatcaataagcacatgtcctattccaagcttaagctcctggcatgcacagtgagtggacccatgcatctttacaaatccttaaaacattctgcagaaggcaaaatgaaagtacccagtattttataaatgacacattcattaacttgttaagcacaagcctttaaaatgtgccaccaactagcgtcagatgtgccccaatatttataaccttgtttccacactaccttcattttttaacataccagtggcttccgaaaatggaagtggcaggagctttccaaccctgagtggccctaaccttctgtgactctgggagaaagacttcaagaagcaagtaagagaaaaaacagtgggaagaggcctcagtggatacggctggcatcactaggtatctcacactctgttctttgttttctgtgttaacaatgggacgtggctgttctctgcctttcacgttctgttctgccccatctagttcatagccggcagcctcagcaaagaccatgtccactacaagaagttaaataaagcggcaaaaatgacaaggggttggcctttctgcttctcaggcatcacctaattctgaaatcaaatgtacttgaaaggtaacatttagaccattcctggccctccaggacaaagtaatcagggatttgaacatggggctagttttccaaagaccctaacaaacttcacaaacgaaattctcactggtcacatgaacatccactatttacaaaacattctcatttcaaatatagaaactacttagttacacttcaatcaaaatgaggtttgcacattaaactaaaaaatatgacaggcgttctaagactatacaggagatttcaggctgacaataagaactaagactcaatgtttatttatttttctttaatttgaaacagggtcttactctgtcacccaggctggtgtacaatggcacgatcacagctcactgcagcctcaacctcctgggctcaggagatcctcctgccttagcctcccaagtagctgggaccacaggtacacactatcactccgggctaattcttttatctgtagaaaggggtgtctcactatgttgccaggctggtcttgaactcctgggctcaagcaattttcctgccttggcctcccaaagtgctgggattataggcatgagccagtgcacctggccccaatctttattttaaataaatgtgatttagtatttgacttagactttcgattgattttaccaatagggtgacagagttagcaaaacaataccactgattctgaaaataaatgtcaatgtgccataaaccatgttggaaaaatctttgagtactttttggcatcaaaccaagaacacagtcatcagttctccttgcttggtaaattttagtcatgggctgtagtctatgacacatctttgagaggcagactttgaaggagctaatgctggcagaaaccaaccagggttgattttggatgcaatccaaggaaagcagaaagatcaggttaattaattccagtcagccctaagtaatgattctttagggtctgacccaactctcaaaacaaaaatcactttccctcccaagtttacgagccaccttcaaattcctgaggactgcggtactaaccaacctaaaatgaatgcatgcatagatttgtaaagccaaccaaacttgtgaaccctgaaaaactaaggtaatcagtcttagtttcctaataaatataaaagtgttttaattccacagcaaataatccaagcatataaactgttcttatgcatacagtactctgtattccacagaatataatacagtttttaagccctcacttaacttcagcaatagattcttgaaaactgcaactttaagcaaaacaacatactatgtaacaaaactaattttgccacaggctaattgatagaaacaagagtcagggacaggcagtggctcaggtctctaatactagcactacgggaggctaagggaggaagacagcttgagcccaggagttcgagaccagcctgggcaacacagtgaaaccacatctgtacaaaaaatacaaaaattatctgggtatggtggcatatgcctgtggtcccagctactcaggaggctgaagtgggaggatcatttgagcctgggaggctgaggctgcagtgagccgtgatcatgccactgcgctccagcctggacactaaaggaagacctcttaaaaatagaaagtcaagttcctttcttcaagttccacgggcatacagcgtgtcattttgcttaaagacacagtttctaagaacatatcaacagtgttaagtgaggacttaccgtactactttatcaccagttgggttaattggttaaaagaggaatgcaatataatttatttgatgataaaccgctatgacagatagtgggcaattattccttccttcctcccccatgcttctgaaaaaaaaaaaactacttcaactggtcacttgccaaaaacaaacgaagagatcaaacggtctttttaagcaaagccaggtttccgggccatgaacacgtagctttgctaagagaagcatgaaatgtgagtagccacaaaccttaacaatcacgagaaccaacagcaaggaacagatagcaagtattcacaggagaccgtggatagggtcccataatacctatgtcaatgactgagcccaaaggctagtaagtggcagggagagattctaataagatcagtctgacactaaagcctgaggttgtcccagcatccatgcctccatcctccctgcaatcaaatgccgttttcacatatgtgcagtgtcagtgggactgctgtttaccaatatgaggcttttgactctatgttaaatagatccataacaccagagtcaacatactacagactgcttataaagatgacagacaatcccccataacttgccaattaaaataaaatagcccagtctaggtgcagtggctcattcctgtaatcccagcactttgggaggccaaggcgagtggatcacctgaggtcaggagttcgaaaccagcctagccatattgaaaccctgtctttactaaaaatacaaacattagctaggtgtggtgatgcatacctgtaatcccagctacgcaggaggctgaggcaggagaatcacttgaacctgggagacggaggttgcagtgagccgagctagtgccactgcactccagcctcgacaacaaagcgagacaactctgtctcaataaaatacaatagcctgtaggcaataaaattaggcctccgtatgagaggtggtccagtcaacatcaccacaacgtaatgttagtaagacatggctggatgacaaccaaaagtcaacctggctccagggtctgcctgaagaaagatgtgttaacagcaatggtctgcttagagtcctggaaaaagaaaacaatttgggggctgggtgtggtagctcatgcctataatcccagaactttgggaggccaaggtgggcggatcacctgaggtcgggagttcgagacaagcctgaccaacatggagaaaccccgtctctactaaaaatacaaaattagccaggcatggtggcacatgcctgtaatcccaactactcgggaggctgaggcaggagaattgcttgaacccgggaggtggaggttgcagtgagccgagatcgcaccattgcactccagcctaggtgacagagacagactccgtctcaaaaaaaaaaaaaaaaagaaaagaaaactatttggaagagtttgggaccacatctctggggaaagatgccctgtttggcttctctgagtatccgctgttgatttatttaactggaatggagatagacacaacagctatgagctgaagaacatcagagactatttggcccactaactcttactactctgattctaagctctcccaagaaattttctgatcatcatctaacttcccaggagacctttttccaaaaaaagacaaatatgatgaccaaataataagaacatggtattctacacgacaattacattcatcaataaaaatgacccactgcatggcaggtgtgatgctgggcacttttatatacattatattgtttaatccacaaatctaggcaatgtgtcatattgaagacaaaaaagattaagttgttggcagttgaaagactttcccagaattatcaaaatataggtggcagggtaggtatcaaatgcagcttggattctatacttctataaaaaatgtccagctgggcacattcattcactcttgtaatcacagcacttttggaggccaaagtaggtggatctcttgagcttaagagtttgagcccaggctgggcaatatggcaaaacccagtctctactaaaaatataaaaataagctgggcatcatggtatgcacctgtagtcccagctacttgggaggctgaggcaggagaatcgcttgagtccaggaggcagaggttgcagtgagccgagatcgagccactgcactccagcctgggcaacagagggagagtgagactccatctcaaaaaaaaaaaatgtccaaggttccaagataatgtggaaggaaaaggagtgtctgtaggcatcctggaagcatatgaaaaattttgcagttataagcaatgttcttgggaaaagacccagaaacgttagcaaattttcttttttttttgagatggcatcttgctctgtcacccaggcaggaatgcagtggtgcaatctcaactcattgcaacctccgcctcctgggttcaagctattctcctgcctcagcctcctgactagctgggattacaggcatgcgccaccacacccagataatttttgtatttcttagtagagacggggtctcaccatgttggccaggctggtctcaaactcctgacctcaagtgatccgcccaccttggcctcccaaagtgctgggattacaggcatgagccactgcaccaggccaaattttcaaagttgttcttacaccagaaatcctgaaggaccactggctgctttaaagatgacatcacttaatgattatagattcaagcttcaggcatggggaaataatttgatactattttaattgccaataaagtaattgtagggctaattacctaatagccagtcttcatgctcaaatcccactacatattttttcagggcctttttctacacttataatgtgatgtgactgagggtgcatgtgaaataaatatggcatttgttctctacatggtgacttccatctccctacatgaaagtagtacagtgagtgccaaaaccacgcccagccctggactgttttggtgtcatagcaatcagctatgtgcagagagatttaacatctttgatttcaaacactcgctttttgtttatttttaatcatacctgccaagtagctgaactgcataaagcttttttgagggagaatgcaacagatactttcaggtccttttgctggaaataacctttctttacatcactcattggagaaaaagcacactctgtttgctcacttcttccacttgccaaatattttaattcgttcttttaaaatgcagaaatctaacccaattttagcaatgtgtagctacagaaataaactataaagtccataaataactggcagttggcaataaaattgacatttaattatatatctttcaagggtgttacaaaaatactgcttcaagatgccttgtgtaaaaaaaaaaaaaaattaaagtcctatctttgtgattatctaatttcacagttaaccaaaaaaagaattttgcatcctttttggccatttttgctcaaggtcctaaattcttagtttccatagtcaagattatagtacagaatataattctaaattagtagtatattatagaagcactcatgttacaaacatttgctataaacacagtgattattgcaaagttagttaccttatattttctgctttttgaacttttactgataaaatactattatattcactggttataaaaaatgagttcaggataaatgggatttaaaagctagttatgttaaaaaaaaaaatcttaatgtaacacttgctagatttcgtgtggcctttaaaatattttgaccctgaaaatgatttatgtgtaaaagagtttgcaacaatgcaaattttattggcataatgtttgctaaactaattgctccagaattcctttctattgtgatttaaaggcactttgatatcaattttactaataaatcagacaagtctattatttcaaggaagctcacttttaaaaggttttttttctcagactgaaagacatttatcttgcaattgatgtaagataaaggtctttttcccagtgatttacataagggaccagagttgaagttttcgcatttaggtccattacgttttaaaatgttttattcttaaatatacttaatggcttggaatgtaatatgcatcgactgacatatagctgttcaataaatatttattgccagaatattttttttcaaaatgtcgaaggcaaagatgagttcaagtttttctgaggcacggggtgtgcctgtttaactcatcttatatataagaaaatgaacataaaactttaaacttcactttaatactctaaatcagtaacatctatatgtgtacatactatccctatcatccaaaaaaaaaatcacagaaaggagaatttaagtttcaatgtttgtcccaagcagcacctattactttattcatattctatatacctaggaaatgatgattcagtgattccaaactaggagaaaaaaaaaaaaaaaacaagccagaccttcctggactgccctccagacaaatgataaggagaaaatttcctttgcaaatcaacatcctccaccatatgactccactttttctcgggaactagattgctgacgttttgggagtatatgtctgtttcccaaactcattctcatgggcagccaaaccaatctgctttgcaaaccctgaaacacaccttgctggaaccagtctcactgccccagctcctccttccccatcatgcctgaaatacacttctcactaacccaagtctctaacatactttcagggccctctcaaaacacatacttccctatacaccgtgagcctcccaaccatacattcatcttccatgctcttgagagaaaccctctatttagaatgacatccaagctgctctaggtatggatgccttccctccctggagcagaagcataatcagttttgttaactttatttatctatctatttatctatctatctatctatggcagagtctcacactgtcgcccaggctggagtgtgcagtagcaccatctcagctcactgcaacctccacctcccagattcaagcgattttcctgccttagcctcctgaatagctgggattacaggcacccgccaccacacccagctaattttttgtatttttagtagagatggagtttcactatgttggccaggctggtcttgaactcctgacctcatgatccacctgcctcggcctcccaaagtgctgggatcacaggcttaagccaccacacccagccagttttgttaactttttatctcttaataatgtcccaattctggtaggtattcaataaatatatgcctaaagcaaaatagtagtgctgtgctgcttctccacttgatctcattgaagccaaaactgcacttactatagcagctagacacacagagatttcgtgagcaatgcaagattcgtgagcaatgcagccacgtgccccctatgtgcatggctgttggcccctccagccagctatggacacgaaaacccccatcttccagccacacctggatgagcctggctcctgggcaacagcaacacaaggacatatgcttaacaactgagcatcaggccagccttgcttttgattctgacatacttggaaaataacgtacgttatgttcatagagacatattattattttcttgtagccaataacagactgagagccagaaagagttttcaagattgtatctcaagcccaagttctcatttgacaaccaaagacaagccccagagaagctagatattgtcgggaggtcgcagttatcggcacagctgagtatagaaacgaagtcccctcatcgtccagtccagcaatccttccaagcaatatgctcttctgcctttctaatggtgattgtctcaagctgctattaaaatcaactcctggccaggcacagtggttcacgcctataatcccagcactttgggaggctgagattggaggactgcttgagcctaggagttcaagaccagcctgggcaatatagtgagaccttgtctctacaaaaaaaatagaaaaaatgagctgggcatggtgtcacgacctgtagtcccagctactcgggaggctgagacaagaggattgcttgagcgcaggctgtggtgagccatgatcactccactgcactccagcctgagtgacacagtaagatcctgtcttaaaaaaaaaaattaaaaataggccaggcacgatggctaatgcctgtaatcccagcactttgggaggctgaggtgggtggatcacctgaggtcaggagtttgagaccaaccttaccaacatggagaaacctcatctctactaaaaatacaaaattagccgggcatggtggtgcattcctgtaatcccagctactcaggaggctgaggcaggagaatcgctttaacctgggaggcggaggttgcagtgagccgagatcgcgccattgcactccagcctgggcaataagagcaaaactccatctcaaaaaaataaataaagtaaaaataaaagtacaataaaataaaataaactcctctattacatcaaactaaaaagcttctgcacagcagagaaaacaaccaacagagtgaagacacaacctatgaaatgggagaaaatatttacaatccataaatccagtaaggggttaatgtacaaaatacataaggaactcaaacaactcaatagcaaaaaaacaacccaactgaaaaaaaatgggcaaagaacctacatagacatttcttgaaaaaaagatatacagatggccaaccagtatatggggaaaaaaatgctcagcatcactaatcatctggaaatgcaaattaagagccacagtgaaataccacctcacacctgttagaaaggctactatcaaaaagatgaaagataataagtgttagcaaggttggagaaaagagaccttggtacactgttggtgggaatgtaaattagtacagctattatagaaaacagtatcaaggccccccaaaaatattaaaaatagaactcacatatgatccagcaatcccactactgagtatatacccaagggatatgaaatcagcatttggaggagatacctgcaatcccaggttcattgcctcactcttcacaatggcccaagctatagaatcaacctaaatgtccgtcagtggatggttacagaaattgtggtatatatacacaatggaatactatttggcctttagaaagcagaaaaccctgtcatttgtgagaacatggatgaacctgaaagacattatattaagtgagacaagccaagcacagaaaaagtaccatatgatcacacttaaatgtgaaatcaaagaaagatgaagtcatagaagcagagagagagtagaatagtggttaccaggagctggggggacagagaagaaattgaggagatattggttgaaggatacaaactttcagttagacaacagcagtaaattcaagagctctatggtacaacatggtgactatagttaaaaacaatgtattatatacttgaaaattactaagagtatattttatgtgttctcatcacacacacacacaattacaaatatgtgaggtaacacatattctaattagcttgatttaaccattttgcaatgtgtatacatatcaaaacagcttgttgtacggtgtaaatttatacaatttttatgtgtcagtttttaaaaacagatttaaaaaataaacttcccttctcaaagcacacattaaagtggcagaggaagaaagcctgggggcagacatataggggtgtagagggaaatagtagacggtttgtcgttgtttttgtttgttttttgaaatgggatcttgcactagagcgcagtggtgtgatcatggctcactgcagcctcaatttccagggctcaattgatcttcccacctgagcctcctgagtagctgggactacaggcatgcatcaccacacccagacacccagctaacttttgtattttttttagtaaagatggggttttgccatattgcccaggctggcctcgaacttttgggctcatgcaatcagcctgcctcagcctcccaaagtgcggggattatagatgtgagctactgggcccagctatagatggttttttaaagatacacaaaaatatccaaaaatgatacatgagataatccactcagagacaaaagacatacacagagacttctaaatacacctgcaatttcaacagcattacaccttgtgtggaaggtaaggtaaggtcatcccctaagccatgcggttgagtggctgaggcaccgcctgactttggataagccacaagctacttttgactcatttctccaaatgcaaaaggcaggtggggtttttttttgagaatcttgctctgtcgcccaggctgaagtgcagtggcgctatctcggctcattgtaacctccccctcccaggtccaagtgattctcctgcctcagcctccggagtggctgggattacaggcgcctgccacatgcgcagctaatttctatattttcaggagagatagggtttcaccatttggccaggctggtctcaactcctgacatcaaatgatccacccgtcacggcctcccaaagtgctgggattgcaggcgtaagccaccgcaactggcctaaaaggaaggtattactatttttttaactctaacttttttttaggtttgttttttagttatgtgaaaaattcacacgtgagaaatgtcactccaataatactggatacataattcgttagtgggattacccggaggggcagagctgggaagaaagggtggagatggaagtgtcaataagaaaacagttcctcggccgggctcggtggctcacgcctgtaatcacagcactttgggaggctgaggcgggcggagcacgaggtcaggagatctagaccatcctggctaacacggtgaaaccccatctctactaaaaaaaaatacaaaaaattagccgggcgtggtggcgggcgcctgtagtcccagctactcctgaggctgagataggagaatggcgtgaacccgggaggcggagcttgcagtgagctgagatcgcgccactgcactccagcctgggtgacagagggagactccgtctcaaaaaaaaaagaaaagaaaacagttcctcatggtcgaccttcacccagttctcctccagcacttctatttccttaataattattccctttctttattctactcactgaccccttccctctcacacacacatccagtcactcatacacacactgttttctgaagagctgaaggcggggtcatcccacccttccaggctcagccccaggcctgtctctcccatctcctccccactgaattcctgtggcaattatataatttaacaacatacttcagagcttaattttccactctagatttgctatgcatgtaaaaaattttgcccaaaaacatgacaagtatcttgtaatcaagaaacagatcttatatttgtggggttttttttcctattaataataaccactgcagttaagaacacaaagattgccggccatggtggctcaggcctgtcatcccagcactttgggaggccgaggtgggtggatcacctgaggtcaggagtttgagaccagcctggccaacatggggaaaccccatctctactcaaaagacaaaaattagtcaggtgtggtggcgggcacctgtaaccccagctacttgggaggctaaggtggggggatcacttgaacctgggaccagaggttgcagtgagccgagattgtgccactgcactccagcctggatggcagagcaagactctgtctcaaaaagaacacacagatgaacaggtgagaaataccctgaaacagtattatttttccattcatcatttttccctgacagagtaatcaactttgaatatatccacaacacctgtcagttgtttaattttttcctatagtaaatatgctgattgaatttctcctggagtcctttgagaatcagactagtcctgtgttgtgtttcaagtcatccaaggagaaaaagactggaaatagggggcagaaattccaggaaatttcagtacgactctgaagttgaataaaacattaataacttgcggcaggtatggtggcttatgcctgtaatcccaacaatttgggaggccaaggcgggcagatcacttgaggtcaggagttcgagaccagcctggccaacatggtgaaaccccatctctactaaaaatacaaaaattagctgagcatagtggtgtgcgcccgtaatcccagctaattgagaggctgaggcatgagaatcgcttgaacccgggaggcaggggtcgcagtgagcagagattgcaccactgcacttcagcttgggtgacagagagagactccgtctcagaaacaaaacaaaacaaaattaataacttaggactctattcatatttcatagagatgcttttttgtttttgtttttttaagacagggtctcactctgtcatccaggctggagttcaggggcacaatctcggctcactgcaacctctgccttccagattcaagcaatctttccacctcagtctcccaagtagctgggaatacaggcgagcaccaccacgcccagctaattttgagatgctttttttgaactttgctcaagaggctatgcttactatgctaaactcaacaccctgcatggtaatgaccacttaatggttattaagaactttcattttcttcctactcaacactcattaaaaatctatccccagggccttttataccttgacaaagatgacttcagttacaagcaaaattttgtaagaggcgggcaatggtatatccatcataccctttcaaagtttaccactaacaaacttcaagcattcatctgagagaccaatctgccttattgtatattcaagtcttgcccttcccccatagtttttgcaaagatggttgatgtagactagattatcgtgagacggaatggactttgaaaggcgggactctcttatgtagtggacttagaactgaagacatgacttcttagtaatgaaactgaaggtaagtacttgtttatacaacaaaattaaaaagttctatacagacttctgaatcatactttaaaaaaaaatgtgatattactgtaacccttaccttcccctacctccccaatatctgcagtccataattttgttttgttttgagatagagtctcactttgtcgcccaggttggagtgcagtggcacgatctcagttcactgcaacctccacctcctaggttcaagctattctcctgcctcaacctccgaagtaactgggattacaggggtttgccaccacacccagctacatttttttttattttcagtagaaacggggctttaccatgttggcctggctggtctcgaactcctgatctcaagtgatctacccacctcaccctcccaaagtgctgagattataggcatgagccactatgcccggccgattttgtttatttcatcagtttaaataaatttctcagaggaaaaaaaaaaatctaaagtattttcattagcttttcccatttctcttagaaatagccctggctaggctgggcactgtaatcccatcactttgggaggccaaggcgggctgatcacctgaggtcaggagttcaggaccagcctggccaacatggtgaaatcacgtcctacttaaaatacaaaaattagctgggtgtggtagcaggtgcctataatctcagctactcaggaggctgaggcaggagaattgcttgaacccaggaggtagaggttgcagtgagccaagatcgtgtcattgcactccagcctggggtacaagagcaagacttcatctaaaaaaaaaaaaaaaaaaaaaaaaaaaaaaaaaaagaagaagaagaaaagaaaaagaaatagccctggctagcatttatgaaatatgttccaggtgccaggccctgtgctgattgaaccaagcagtcttattccacgctcaggtgatctcatgaaatgggatgaaccaagtatctaagatcaaagcgctcacacagggccctggggtcattcccctcaccacattctcctctctctctttttttttttttttttttgagacagactctcactctgttgcccaggctggagtgcagtggcacaatctcggctcactgcaacctctgcctcccaggctcaagcgattctcttgcctcagcctcccgagtaaccggggttataggcgtgcaccaccatgcccagctaattttttgtcaaggccaacactgccccctaccccatgtgccacatctgggtccccacatggcccacctgcaacttcccaggaaataaaactgagatgactcaagaatgcttaatatcaaattcttctcctgtgtgattgatccaaaatatttacagagttgagagaactcctcaccaagaatgtgagctccgtgcaagcaggtggcttctggcttgttcaacacactctctgaggcccagacccatggctggtttctgtggacacagggtcattacatggagaagccctgcattcagaaggacccaaaacttggtttaatgctctgctgtcactatcttgaaattcctggtaaactttgaaaaagggatcctacattttatttttattttatttttttgagactgagtctcactctgtcacccaggctggagtgcagtggcgcgatctcggctcactgcaacctccaccctccgggttcaagcgattctcagcctcccgactagctgggattacaggcgcctgccactgcacccagctagtttttgtatttttagtacagatggggcttcaccatcttggccaagctggtcttgaactcctgacgtggtgatccaccagccttggcctcccaaagtgctgggattacaggcatgagccactgcacccagccaggaccctgcattttcattttgcactgggcactgcaaattaggtagccagtcctgcctgtcatggggcaggcatccaaattatttgtccaatatacctatgatgagttagtggaagctgccctagaaaatgggtcaataagccatgacttacaggccaaatctggccttctgcctgttgttgtaaataaagttttattaaaacacagctccagccaggcacagtggctcatgtctataatcccaacactttgggagaccaaggcgggaggatcacctgaggtcaggagttcaagactagcctggccaacgtggcaaaaccctatctctactaaaaatacaaaaattagcttgggaggccaaggcgggggagatcacttgaggtcgggagttcgagaccagtctgaccaacatggagaaaccttgtctctcaggaggctgaggcaggagaatcacttgaacccaggaagcagaggttgtgataagccaagatcacaccattgcactccagcctgggcaacaagaatgaaactccatctcaaaaaaaagttaaaaattagctgggtaaggtggtgggcacctgtaatcccagctacttgggagactgaggcaggagtatcacttgaacccaggaggcagaggttgcagtgagctgagatcacaccactgtgctccagcctgggcaacagagtgagactccatctcaaaaaaaaacaaaaaaaaaacaaaaaaacacagctccatccatttgtgtcttgtccgtggcactttcactctacaacagaagagttgaggaatactgaaagactgtagggtccacaaagcctaaaatatttactatctggccttttacggagaaagttcactgtcccctgctttagtaaattgtctctccaaattttctatccaaataactgtaacagcaggaaaggcaggtggcctcatgagaccaggagggtagcctaagctgcaagccataaacaatatatgtcttagggtttgtatgtatgaattttgcatccgggagccaaatatattagtgtgttaatacaaaaatattttctcggctgggcgctgtggatcacacctataatcctagcactttgggaggccgaggcaggcagatcacttgaggtcaggagttcaagaccagcctggccaacatagtgaaaccctatctctaccaaaaatacaaaaattagccgggcgtgttggcatgcacctgtagtcccagctactcaggagactgaggcaggagaattgcttgaacctgggaggcagaggttgcagtgagccgagattacgccactgcactccagcctgggtgacagagtgagactctctctcaaaaaaaaaaaaaaaaaaattatcattctgaacaatactccagggatgagtcaaatttatcccttgacaacccctgtctacaaggatgagtacgcagaaggtatgggcaccccagtttgcaaaccatgccttcattcctcatctttgatatacccagtgtggaaggaagtctcctgtagcatttcagtgtccactgagcttcaacccacaccaatcatttcttaccagcccagaaaatcctgttagagaagatccaacaaggacattaaatacagaatctcttgtgcacttattcttaactgactgtactaggtccatgccccatcgcactgaaagactaaagtttcagaagctactgagagccaggaatttcagagcccagagatgcctgtaggaaagtttttagaagagggatgttggcagaggccagtttcctcatgattgtcgataacattctatttctaacttgaatgattttcagtatccccttttcattgttaagatttttaatttaccttattgctagcagcgatacaagaaatacatttttttttctttttaatagagactgagtctcactggtctcaaactcctgggctcaagcaatcctccctcctcagcctcccaaagtgctggcatgagcctccaaccctggcccctttctcttttggagataggatctcactctgtcaccaaggctggagtgcagtggcacaatcatggctcactgcagccttgacttcctgggctcaggtgatcctctcatctcagcctctcaaatagctgggactacatgggtgcactaccacgcccagctaatactttctgtattttttctagagatggggtttcgccatgttgcctgggctggtctcgaacttccagactcaagcaatccacacaccttggcctcccaaagtgttaagattacaggcgtgagccaccgtgcccggtcaagaaatacatttccttagtcagggtgctggctggatagtttcatatgccactgagagaatttaggagcatttgcctctgacatttgtgtacattctttcatgtcatagattatgggggagcttcaaatggtttaaagggagttttcctggatacttcaggttaaacagagaaagtatcggggaaaactaggtataccagaaagggagactctgagagagaaaaagacaggccccagggaagaaatgaaccacagaaccacagtgaagtttcaggtctctgggagaaacactggctatcgtaacaacaaaacaatatcaaaaggacaattcatgaagacatcaagaagtacttgttctgttggccgggcacggtggctcatgcctgtaatcccagcactttgggaggctgaggcgggcagatcacgaggtcaggagatcaagaccatcctggctaacacggtgaaaccccatctccattaaaaatacaaaaaaattagctgggcatggtggcgggagcctgtagtcccagctactcaggaggctgaggcaggagaatggcgtgaacccgggaggcagcgcttgcagtgagcagagatcgtgccactgcactccagcctgggagacagagtaagactccgtctcaaaaaaaaaaaaatcaaaaaaaggacttattctggggattattaaaggagttttctctctgtgtgtgtgtgtgtgtgtgtgtgtgtgtgtgtgtgtgtgtgtgtgtgttggaaaggggagtaattttatcattatgtcttaaaatgaaataattcacgggacccaaaagggcagacattgacaacaccgttcagcaaatacacagtgtgctgcttccttacagctgttgttggcaaaatgccacacaaaagttatcagcagctgacaatactcaccacaaacaaacaaacaaacaaaacgagtgatagaaactcggtagtaacaatcctggtgaggagtaaatacaagtctcactggtgtttttgggagacctgtgggaagggccagtggaggagagccctcttgggacaactgaacaccacaaagggtcatttctcccctgatcccaaagccctcgatcttacactaactgctggccagcagcctagaccaagtctccgaggaggaaagcactcattagtgtaatagaccgcttcaccctcaaactggaacttaaattgccaaaatcattacatgcttattacaattcattcaagcttcagaacataaaattgatacagaaggggaagggggcgtggcaggacctacaggttcatagttcggtttttccaccctcaccctcaacaactccctgagattaaaatgaacaaaggaattttttttcttttttcttttttttttttttttttaggagaagggtgtactcctactatttcaaacttaaatatcttctgaataagaaatggctttccagttctgtttggtaaattctctcaagtcagattttaaatcgtacacccaaaaaaaatccttgatttttttttagcataaatctatcctactttacataaataacatacattatgagaacggaatttgcaacacaaaaagacggttattcatgtttccaaagggatcaacatttgagtttctttcaatgggtggctctactgttttgttcacaatgtggttttgtgtcacctcaacttttcagaagcacatggactacatacatcaaagtccacttgtgcttttattaaaagtacccccaaagcatttcaaatgtcactgtatacatccccacagctatcttgttaaaggcaaaatacatacatacatacatacatacatacatacatacatacataaacaacataatcctccttcattgccaaccattcaacagtacattctgccccataagcctttttaaacacactgggctcagctcgtgggattcctgaagtgcaatagccctaacactgttttccaaggtagagatttctaaaaggtgagatggagtacacagttgcttcaaacagtgtgatccagatacaaacacagtcccaacatgcaccagatatgaaatctctgtgccagaaaccagggtcactggcaccatggaatcaagaaccattttctgtgtgtaaagtactaggtgcctagatctgccagtaagcatctaccagtttcctagcataaaagtcagcaaaagtcaggaatgaagcagcaggaaagacagggagttacacagtgagcctcaacaaaggtctcagagcagctgggcactagcgagggccgccaattctttcttacaacttgaaggtaataacagaggagaggtgatggttactgagcatttacaatggcaaagctgtttgaagcgccttcacacgcattcacttatggtacctgttaaactccgggacagtgattatgaaactttttggatgcctttacactctttttatttatttatttatttatttatttatttatttatttatttgagatggagttttgttcttgttgcccaggctggagtgcaatggcacgatcttggctcaccacaacctccacctcacgggttcaagcgattctcctgcctcagcctcccaagtagctgggattataggcatgcgccaccacacccagctaattttgtatttttagtagagacagtgtttctccatgttgatcaggctggtctcaaattcctgacttcaggtgatccgcctgccaatcccaaagacctttttgtttatgtgggttatatccactgatatttattgtatttgaaattaaaatgaaaaaatagatattaacatattttaaaataatacgacttgggcaacataggtaggcttcatttctacaaaaagtaaaaaattccactgggcccaattgttcatgcctataatctcagcactttgggaggacaaggtgggaatattacatgagttcaggagttcaagaccagcctaggcaacaaagtaagacctcatttatacaaaaatcaaaaaattacctgggcatgatggcacacacctgtggtcccagctacatggaaggctgaggtaggaggatgccttgagtccactgggttgaggctgcagtaagccatgttcatgctactgcactctactctgggtgatagaacaagccttgtctcaaaataaataaataaataaatagctgggcatggtgggacatgcctacagtcccagctactcaagaagctgaggtaggagggttgctggagcctaggaggttgaggctgctgtgagctgtgatcacaccactgcactcagcttgggcgacacagagaccctgtctcaaaaataaataaataaaaagaaaaaacaatagtaaacctattacacattaaacataaataacatttttatgaccaataacaatatttttccaaagcaaaaaaaaaattagtgaaaagcatggcactgttttacaattttgcaaatctccttaatgtctgggcttatcaaagacagttggactttcctatctgcatctgtgttcaatctgttgtactatctcagcttatgtagacacaagaaaacttcactgtagtcttgtgagaatgagaatgaaatgggaaaattaatatcttagtattattatgaaaatagttttgaccttgcagacctccagtaaaagtcttggggactgctgggggtacccaggtcacactttcagaacctctgccttatgagttaggagatattatctccatttttcaaatgggcaaactgagacagagaggtcaaggaattgtccaaggccatactgctagaatagctcagagtagctaaaatgcaatgagcataacagatttaacctcaattgtttgttgcaaggattgaatgagatcgtgaatataaagagcaggacatcctgcttgtcttatcacaaatgcccaataacattaatgtttccccgccaggtgcggtggctcatgcctgtaatgccagcactttgggaggccgatgcaggtggatcacgaggtcaggagtttgagaccagcctggccaacatggcaaaaccccgtctctactaaaaatacaaaaattagctaggcgtggtggcgggcgcctgtaatcccagctacttaggaggctgaggcaggagaattgcttgaactcgggagatggaggttgcagtgagccaagatcatgccactgcacttcagcctgggtgacagagcaagattccgtctcgaagaaaaaaaaataataataatgtttcccatttagcaaaaactggtagaaaagctggagaaacttcccacatttctgatcaactcatcacacatatgacaccagcaagaaaaaataaaactccaccacaggtattgtccagaggagcagcttttccttatagaccaaaccttggcccattcctcagcacaaaagcagcctttgatgactcagaaacgcagggccttattccagcctctgttaggcaaattacactggtggactgggcatctgtcaccttgttccttgggaaacttgagcaagccaagaaacctgctccattatttacagcattgtttttgcatcacgctgtatttacaaggaaccctcaacagacaaaaatgatgccgctagtgtgtgcagccaaacctttaacagaaaccagcaactgcggtcttgctggccaggtgctcagcactccccggctctctttgttgatcaactttcttagcccacgtggcccacccactcctgcctccggtgggcccacagggtgcaggtcacttcccttctgcggatttgggaagtggtaacacacttggggaagtgggactagtgacgttcagaccaccacactcttaaaaggctgcccctaaacagcaggcaagagcaagaggagcctgagctatcgcttccacccaagtgcaggtcaccagatctctcatcagcagggctgcggccggcctcagcttccaacctgaccccctatcccctgcccttacacaccccagtccattctccaaccacagccaaactgcacaccatgccgggtgcagtggctcacccctgtaatccctacactttgggaggccgaggcaggcggatcacctgaggtcaggagttcgagaccagcctggccaacatggtgaaaccccgtctctactaaaaatacaaaaattagctgggtgtggtggcacacgcctgtaatccccgttactcgggaggctgaggcaggagaatcgcttgaacccgggaggcagagccgagaccacaccactgcacttcagcctgggcgacagagcgagatcagtctcaaaaaaacaaaagtgcacaacgggtaaggtcagttttcttgctaaaacgtccccgaggtttcccctactcagttggaaccaaaaccaaactccttattttggcctataaaaacccgcctcacctggcagaagcccacctctcctgccacaaacaaggccttctcccctccgctttgctctctctaatccacctgtagcgcccctccaggacctccagcagctagaatgtcatgtccttgaagaggctttgccaaatcaaaagttgccactccacccggttgtatttgagactttacagcgcttcttactttagaagttctcttcattttacttgtatattggacgtgtccctccctccgcatccccctcctggaaggtaagcttcctggagaacaggggctcctcctggtcccccgcgacatccccagcgcccagcaccgagcccggcacagactaagcactcggctaaggcggatcgaatgaatgaatggagccgcggcgccgcggcgccgcgttgccgcaggaatcccgggcaagcgatcctggcgcgtccgcaccgtctggggcagcggggccacagggacgcacggttcgggtggccaggcgggactcggcccgcacccccacccggccgcgcgcccggcccggacgccccaggtgcctccccggagcgcgagcgcccccaccgcctacccgggccggcggttcccccgcactcaccatcgtggctgggccgccgcctcccccgccttgcgagcaaggagcgctggagaagcgagggcgagaggcgagcgctggagccggtgcggctgacaggtgaggcgcccggcttagaccatggctgcttcccacaatgccctggcactgaaagtgtg

SEQ ID NO: 2322 - DNA, 20107 bp, Homo sapiens
  source 1..20107: mol_type = genomic DNA
ggcaggccccgccccccgcccacgaggaagtggctgctgctccggcgcggagcccagagccggttcggcgcgtcgactgcccagagtccgcggccggggcgcgggaggtgagggccgtgggggcgcccggaggtgggggtcaggggagccacctggaggtgggggggcgcgtagatgtggggcgccgcctgggagtgagcgggactggagggatgagagggggtgcaaggaggggaccggggggcgcctggaagtgaggacgcatagatgtggggcgccgcccaataggggcacggggatgagtgggggcacatggagaggagggggcgcggggacgaggggctcacggaaaggagagggagccctgggattggagggggcgcgggggtggccgcagggccagactgtggaaacgcgggctcccagcgcaccgggcgccctcggggcgtccccagcccccggccccaagcttccgcctcgtgccttccgcccctgctccccggcccccatccccagccttgccccgcggtcggtcggtgtagccccgttacttcgggccggcggggccccacacccagtcacttcccctccatccccggagccttccgggttgcagccgccgggaaatgagctggcgtctcctgccgccccgcccctgccctcctggccgctcccgctgctcccacccgcctcccccgggccaggtccgaggggtcccgtacggggcgggcctggctggcggggtcccggaacgcaccccctcagctgcagggctccgcggccagggcagatccgagcagcccctccctttccggaggcgctgggagagcagccaggccgcctagggcggggcggggccgggctgcacccgcgggcagtgaagggatcaggagtgcaagcctggggagtcagacctccccctgcctcctctgccaatgcagcccggaggctaccaccacccatcccggccgggcgcggtggctcacacatagaatcctagcattttgagaggcccaggcgggaggatcgcttgaggccaggagttggaggccagcatggacagcattgcgagaccctttctctattaaaataaataaataaaatgtagccaggcgctgtggctcatgcctgtaatcccaacactttgggagtcgaggtggacggatcacttgaggtcaggagttcgagactagcctgaccgacatggtgaaaccctgtctctactaaaaatacaaaaattacccaggcatggtggcacgcacctgtaatcccagctactcaggaggctgaggcaggagaattgcttgaacccgggaggcagaggttgcagtgagccgagatcacgccattgcactccagcctgggcaacagagcaagactccgtctcaaaaaaaaaaaaaaaagccacgtaacatgcctgtaatcccagctacttaggaggatgaggcaagagaattgcttgaacctgccttggcagtgagccaagactgtaccactgcactgcagccttggcaacagagccagactccgtctctaaataaataaataaaatcttagggacctaggtaggagtgccagcttctcccttcactggccagtgactggtaagccacccaactcctgccagcctcaactttccttatctggaaaatgggaaccttaaagactgggaggctgaaatgcaatactgcaagacacctggcagcgtgtcaggcgctgacagtataaacgtgcgtttgttgctcaccttgatcatagtgttcccccaggtgaacctaacttcctggcctccaagatttggggtcagagtcccaagctgcgtcatttagtagaagccgagtgactttgaacaaatcgttgcttttgtctgagcctgggtttcctcctgtacaaactgaaggtaaaaagcaaacaggctgggcgcggtggctcacgcctgtaattccagcactttgggaggccgaggcaggcagattacctgaggtcgggagttcgagaccagcctgaccaacgtggtgaaaccccgtcactactaaaaatacaaaattagccaggtgtggtggtgggcacctgtaatcccagctactcaggaggctgaggcaggagaatcgctagaacctgggaggcggaggttgcggtgagccaagatcatgccgttgcactccagcctggggttacaaagcgagactctgtctccaaaaaaaaaaaaaaaagcaaacaaaaaatgtctcaggcttgcttcagggggagaatggtgaaaggtctgggtaaaatcgccctgatagatgccggtaaagtttgtttcttacatatgtctgtacataatccattgataggtctttttctttttttctggagtccgggtctcattgtgttgcccaggctatagtgccatggcttgatcataactcactttagccccaaactcctgggctcaagggatcctcctgagtagctgggattacaggtatgttcctccatgcccagctaatttttaaatgtttagtagaggtagggttttgctgtgttgtccaggctggcctcaaactcctggccttaagcgatcctcctgccttggcctcccaaagtgctggggttacaggcatgagcctccacgcctgccttatacgtgctttctttttttttttttttttttgagacagtgtcttgttctgttgcccaggctggagtgtggtgacactaccttgactcactgcagcatctgcctcccgggttccagtgattctcctgcctcagcctctcaggtagctgggattacaggtacatgccaatatgcccggctaatttttatatttttagtagagacggggtttcaccatgttggccaggctggtctcgaactgctgacctcaggtgatccgcccacctcggcttcccaaagtgctaggattacaggcgtgagccaccgcgcccagcttcttcttcttcttcttcttcttttttttttttatttggaggtggcggagtttcactctgtcgcccaggctgcagtgcagtggcacaatctcagctaactgcaacctcttcctctcgagttcaagtgattctcttgcctcgaccccccgagcagctgggattacaagtgcccaccaccaagcccagataaattttgtatttttagtagagagggttttaccatgttgggcaggctggtctcaaactcctgacctcaggtgatccacctgcctccgcctcccaaagtctgggattacaggtgtgagccaccgcacccgtcggttgataggtcttttctaatattaataattacgtagcatctcaacatgttaatgtcataatttactctttccatattgtcacctgggtttttccacactgtcaccattataaagacagctattataaacatgtttgctttattttttagatgaggtttcactctgtcacccaggctggagtacagtgacgagatctcggctcactgcaacctccaccttcccagctcaaggaatcctccagcctcagcccctcagatagccaggactacaggcgtacagcatcacatcccgctaattttttttttttttttggtagtttttatagacacagggttttgccatgttgcccaggctggtctccgaactcctggactcaagtgatccacctggcttggcctcccaaaatggtgggattacaggcgtgagccatggcaccccacctgtttgcttttaaaaaagaaaaatggggccaggcgtggtggctcacacctgtaatcccagcactttgggaggccgaggcgggtggatcacaaggtcaggagttcgagaccagcctgtccaacatggtgaaaccccatctctactaaaaacaaaaacaaaaattagctgggcgtggtggtgggcacctgtagttccacctactggggaggctgagacaggagaattgcttgaacctgggaggcggaggttgcagtgagccgagaatgcaccactacactccagcctgggcgacagaatgagactacatctcaaaaataaaaaagaaaaagaaagaaaaatgtgttgctgttttcttaggaccaaatgggtgtatgtgaccaaagaatgttaattttctttttcttttttttttttttttttttgagatggagtcttgctctgtcctccaggctggagtgcagtggcgcaatctcggctcactgcaagctccgccttccgggttcacgccattctcttgcctcagcctcccgagtagctgggactacaggcgcccgccaccacgcccggcttaattttttgtatttttagtagagacggggtttcaccgttttagccaggatggtctcgatctcctgacctcgtgatccacccacctcggcctcccaaagtgctgggagtataggcgtgagccaccacacctggccagaatgctaattttcaagttcctgttagtgttattctgttctattaatatttggtcccacccacttgttgaattgagtgcccttcagaagaattaaaccaattagcaacaaatgacaatttctccacagctctgctagcattgaattttgtgtgtttttgttttgtttggatgactaaccggtgctttaatggtaccttacgattgttttcatgtgtgtttcttgacttcactctgcgtggttggtaagacttcaagagcagagctggagagggaaggataggggtaggaagggctctgacccagcataggaagttgagtaaccgcttagcacggtgcaaattagcctgctggctgctctatccaagaactgcctgagctgggtggggacttcccagagcgcctgtaatgctgagatctttcctccaggcaactcctccttggtttagcctctgatacagccaaacctctggattcagggaaacctaaggaagccaggcaagaagggtcccgcagcctgtgcctagtctagccccagcctcatctggattaagatgggagggaaatattggctgagggcacccagccagtatgaagacagctagaatgtaaacccagcacagtaagggagagagtatcaaggcccaggactttagagtgcctcaccaccaccaccccgccgctgggcagcctgaggctttctttgcctggcaccaccatgcctggctaattttttttttttttttccaagtggagacggggttttgccatgttggccaggatggtctcaaactcctgacctcaagtgatccacccacctcggcctccgaaagtgctgggattacaggcgtgagccactgtgcccggctatcccctcctctctctggtttcttaacatcaaacaggcccacagtgctggctcacagggccacagtgatagtgggttggtgtcctggatccctcccccaggagccatcactgagaccttatgctgtcaacactggtgggtgaagcagccctcgtatttttctcctgagacatccagagcagggtaattggcaggcgggggtgagcacacgctggctcacgcaggcttggtaggtgagaggttttcctgaggatgatgaagttggagtgtccccggctagaatccctgaggcaggagactggagccctgtggcagcattggctgagagaagccactccctttttgctctcccacttcctcactggtaagatgtgggggttggggagttatcgcagaggcgctttgggtttcagctgctttgcagaagttatggaaaaagggaaatgagtcttcctgtctctcgcccccttaacacttctttgccccatttaaggggtttgttcaacagactaggaagtatttctgctaattcatgctgaagtgtgattggctgataggtgtggtctcaacctccctcctctgccagtcactagtgtaccactgtggccatcttttccagcccctcctctgccccttgagtatgtctaggtcctagaaacagtggtcagggctcttcaagtcctctcggttgcccttgcccactggcacacgtgggggttgctgtcttcagcagagccagccactccgtcttgacagccagggcagagatgtggctgggcacacagcaagaatgtgaccactgatgctgggatgtcagagtctgtgcatcaacccagggttctgagtctgggctctcccaccctcatccccggaggttccttcagtctgggcctcctggggctgaaagggagggaaaaattggcctcagctggagtcctggggccaaccagagcctgggtggagtgtgaaagtgggcttctggccttcaccctgcccctgccctgctggtgaccttggaccatgggggttgtcggggtgtagatgagcaccgtgaatcagtcacaggccttgagcttctctctgcacagtgctggcatcagatgtgggtggtgatgtcccagcctgggaacacaggaaacgctcagggaaacccccatcagacctgctgacatggctgagggcgctgagatggtgcttccggggccctcaccttacacaaagaggccttataaggagagagaggctgcagaggcagccccagtgggtgccgggtgcttgttctgggtaaggctgcccacacgtgcaaagtgtgcttgtggacacagtgcgcttgcgtgtgtgcaaggctgaacatacatgtgtgcaggcctgcagtgtgcctgtgtgtgaggctcaacacgtgcatgtggggagtatggtcatgtgtgcaaggctaaacatgtgcttaaagtgtggggaggtgcagtgtgcatgtgtgtgtgcaaggcttaacatgcaaagtgtgcttgtgtgtgtgaggctgaacacgcatgtgtttgtgtgcgtggcctgaccctgcgctgcgtgtgtctacttgctcagcaaatgctgactggggacccaccggggtcctgttctaagcatggaggaaacatgaggtccctgccccgtgcatgtacacatgtgcatgtgtgtgtgtcctgtgctgctccaggaatcttccaggacatcctgatacaagtgaaagcaagcggtttggatctggagtgagcaggaggtggacagggccttccaggcagtgagcgcagggggctttgtgttgtgacctcgggcaggctggtcactgagccctgtggggccaaactgcagccccaggcaaaggtcgttctgcctttcccttgtgcctgggcccagatgcagtgcaggatgggccggcccctgggcagggcagtgacggggcagccaccggcctcctggggcattcagggttcccagtcctggttggctcccagcccaggccctgagacccaacacaaaactgccagtctggtgagggaggcagccacattatctaatggctgtcactggtgactctgggcaggtggcctcagcccccacatctgtcatctggagctgacctggagcctggcatccctccccaagtgcagccaggcctccctgaaagtccagggctggtgggagtgttgaagtcaagaatgtatacagagcacctggccaggcgcggtggctcatgcctgtaattccagcactttaggaggccgaggcgggcggatcacttgaggtcaggagttcaagaccagcctggccaacatggtgaaaccctgtctctactaaaaatataaaaattaggcatggtggtgcgcacctgtaatcccagctactcaggaggcggaggttggagtgagccaagactgcgacattgcactccaggctgggcaacagagtgagacttcatctcgaaaaaaaaaaaaaaaaaggatacttttttttctagagctggcaaggagggagtatccagaaagtgctggatggtactagttaatacattttattttagagacagggtctggctctgtcacacagtggtacaatcatagctcactgcagcctcaaactcctaggctaagcaatcctcctgcctcagcttcctgaatacctaagaatacagatgtgcaccaccacacctgcaaatttttttatttaaattttttgtagagatagggtctcactgtatcgcccatgcttgtcttgaacttctggcctgaagcaatcctcctgcctaggcctcccaaagtactggggttacaggcatgagccactgcgcctggccctatttaataaaattatttatttatttattatttttaagttattttttcacacacattcattcctaaccttttttttttttttttttttgagacagagtcttgctctgttgcccaggctggagtgcagtggtgtgattttggctcactgcgacctctgcctctcaggttcaacagattctcctgcttcagcctcccaagtagctgggactacaggtgtgcgccaccacgcccagctaatttttgtatttttagtagagacagtctttcaccatgttggccaggctggtcttgaactcctgacctcaggtgatccgcccgcctcggcctcccaaagtgctgggattacaggcatgagccaccgtgcctggcctcattcctaacctatgtaatgataatatttttgagggctgggtagggtggcgtgagcctgtagtcccagctacttgggaagcagaggcaggaggatcacttgagcctgggaagtcgaggctgcagtgagctgtgatcacaccactgcactccagcctgggcaacagagcgagaccctttctcaaatatacacacacacacacgtttctgagaacgtactctgttggtcactaatggcaatgaaaaatttgttcagcggatatttcttgagcacctactatgtgctaagcatttaagcagtggaaatagaaacgagaacaagatagaacaaaaatgtgtctctgccaagctggttctattccagcaggggaggaaggcagcgggccagatcagtgagtgcatgtctgatggtgactgctgagaaaatttaatcggaaatagggaattacgaagtgccggaccgtggaaggtgctgcagtttccagggaaggcctccccaaaagttgacatttgagtacagacttgagtggcagcaccagagcgagagccgtgtgtgccggtatctgggggaagagtgtcacaggcctagggaacagccagcacggaagcccgaggcaggtgcatgcctgtgtgccccaggattggcctctggttggctggggaggcctgctcctcaaagggctggtatatcacatccatcacaggctaagagtaaccgcctcgtggttcctcctcatagaggccaggtgcggtgtgtcatctgcttccagctctcagcatctctgctgggaggcaggattcctgttcccattttacagatgagaaaactgaggttaaaagaaggcaggtgatgtgtcccggggcatgtggctgggcaagcagtgccactgggctcctccacttccaggtccctgtgatgctgggaaactgagtcacggaggcggggagagatgtgtttgaggaattgggctgagaccgtgatctcacccccgtcaggcctggtgggctcctttgacactcagcggcaggtggaggaggctagggacaggctggcaggggctgagctgggctgacgggaggatgagtcgctgccctctgccagggttccccttcagtgctggggctagtctagagggctgcagtcaaacatctccctcgttctggccgagtgtagtggctcacacctgtaatcccaaatacttggcaggtgaggagggaagatctcttgagcctaggagcttgagaccagcctggacagcattgtgagacccccctctctacaaacaaatcaaaaattagttgggcacagtggcacatgcttgtaatcccaggagttcatggctgcagtgagccatgatcacaccactgcactccatcctgggccacagagagagaccctgtctcaagaaacaaaaatctccctccttcagttccccaaggctgggtcaccctggggcctccccaagagccatcacccaggcctcgcctagccctgtgcctcctcccagccctgggtgcagccagtggatgtctggatggagaatgggatgtatctgttaaatatctgcctttgcctcagccatgagcccctgcagaccggccacctcccttctccccgtctgagcagtgtgggggaagaccagggctctgggcacggcagggccaactgccatgtgctggacacctttctaggtggtttatgagattacttcatttcttttttttttttttttttctgagatgagtcttgctctgtcacccagcctcctgagtagtggggattacaggcaggtgccaccacacctggctaatttttttttttttttttttttttttttttgagacggagtctcactctgtcgcccaggctggagtgcagtggtgcgatctcggcttactgcaagccccgcctcccaagttcacgccattctcctgcctcaggctgggactacaggtgcccgccaccacacccgactaattttttgtagttttagtaaagacggagtttcaccatgttggccaggctggtcttgaactcctggccgcaagtgatccgcctgcctcgatctcccaaagtgttgggattacaggcatgagccaccgggcctggcctggatgacttcatcttcatcccatccttaatggggcaggggaagttgggtgggggggggggggtcgtccatcctatgaggaaaccgaggcacagatgacaagtgaggggcctgtccagcttggagtcctagcaccccaccccgccccagggagcatctcccctgtagtaccgtctcctccaccctgtccctggagcctcagagacatcctgtgaaagctgcccttttataaggagggaaactgaggccccaggaggggaagcaacatgtcaggccagttgggagccagggctggcccctgctgctcctctctgcaaactgctgcccctctaaactgaggggcctccctggtgtgaggcctgtgaggatcatctggggcctggtatgggtgaagtcaggggcaaggttggggctgacgtggattctctcttcctctctcgggcacaggagccaagccgccatggcctaccacagcttcctggtggagcccatcagctgccacgcctggaacaaggaccgcacccgtgagtgcttgctgggggccggtgggtggctgcttccacctcctgggatggggaccagccagagcacacatggggactctggagcagccaggcccccggaccatgggctccatgtggctgtcccctggcctcacccctgggtcttccagctgaccaggggcctcctgggttaaagtttaaggagggaatgggccagttgcggtagctcatgcctgtaatcccggcactttgggaggctgaggtgggtggatcacttgaggtcaggagttccagaccagcttgggcaacatggtgaaaccctgtctctactaaaaatacaaaaattacctgggcgtggtggtgggtgtctgtaatcccagctactcggggggctgaggcacgagaattgcttgaacccaggaggcggaggttgcagtgagtcgagattgcaccactgcactccagcctgggcaacaaagcgagactctgtctcaaaaaaaaaaaaagagagaaagaaagaaagaaaaagtgaccaagaaaaagcctttcggaggagatgacattttgacatttacccagagacccagagggggagaggaagggaactgtgccccagctggggaggggctggcaggtgcaggggccctgaggtgtcagcaggagcagcgaagggttcctggttggccagagcaatagggtggggagaggtcccagggttcattgctgcgagtaaaggacagccagttccaggagaagacagggtggcctagcagggcctgaaggacttcagggggcccctgcaaggcagaagaggagagactgagtcatgaaaggtgaggtgttgttgcctaggtgcactgtgtagtgtgtcctggcagagggcagtcatggagagggcccctcaatctccctccatctccccttcagagattgccatctgccccaacaaccatgaggtgcatatctatgaaaagagcggtgccaaatggaccaaggtgcacgagctcaaggagcacaacgggcaggtgacaggtatgtcagggtggctgggaccaccgtcctgaaaggaggtggtgggttgggggggtggtgcaaggcagggcatggccactcattgtggagcatctgcccactcaccgtgaaacccggattcaaactggcttcaattttaaggggactgtgttggctcatgttaccaaaaactcacagggttgagggcttcaggagaggcttgatccagcagctccacatgaccaagaacccatcttttctgcctcttggctttgccctccagcatgtttgctgatagcatggagggctctgacactccctcataagctctaggagtgccccctggtgtcactctaaataagcactggatctcagtaaaaagtgcttgctgggccgggtgcagtggctcatgcctgtaatcccagcacttcaggaggccaaggcgagtggatcgcttgaggtcaggagttcgagaccatcctggccaacatgactaaatgttgaaaaatacagaaattagccgggtgtggtggcacgcacctgtagtcccagatactctggaggctgaggcagaagaatcgcttgaacccaggaggcggaggttgaagtgagctgagattgcaccactgcactccagcctggatggcagagcgagactgtgtcgcaataaaaacaaagaaagaaagaggccgggtgcggtggcttgcgcctgtactcccagcactttgggaggcggaggcgggcggatcacctgaggtcaggagttcaagaccagcctggtcaacatggtgaaacctcatctctactaaaatacaaaaattagccaggcatgatggcgggtgcctgtaatcccagctacttgggaggctgatatgtgagaattgcttgaacccggaagatggtggttccagtgagctgagatcgtgccagtgcactccagcttgggcggctgagcgagactctgtctcaaaaaaaaaaaaaaaaaaaaaagattggtggtacacacctgtagtcccggctactcaggaggctgaggcacgaggattgcttgaacctgggaggcagaggctgcagtgagctgagatcatgccactgcactccagcctgggtgacagagcgagactctgtttcaaaaaaaaaaaaaagtgcctgctgggcagatacagcttccacctggatggtggcctttcagcctctcccatgtggccaccatacagccacctctgcctgagtgtcatcagcctcctgtgttccctccatccccccacaggcatcgactgggcccccgagagtaaccgtattgtgacctgcggcacagaccgcaacgcctacgtgtggacgctgaagggccgcacatggaagcccacgctggtcatcctgcggatcaaccgggctgcccgctgcgtgcgctgggcccccaacgagaacaagtttgctgtgggcagcggctctcgtgtgatctccatctgttatttcgagcaggagaatgactggtgggtacctaggcagggccagagtgggctgttagggaccgggggcaggactagagtgtccccgggaagcaccaaatgggatgtcaggacccctgttcccatcaccctgggggagtccatcctctcctctctgggcctcattcatgaggcaagggcctctctgcagcgtccggatgttctcactgccagtgacacccaccacaccagaaacacatctgggggcacctcactaagccctgcacacacattagtcctgacttccctgcagctccgtggactgggcatcggtcactgtccccactttacagattagcaaaggccctgtagcagtcactttctcaaggcaccactcacgagctcgcagccacatcttgttccttttttttttttcagatggagtctcactctgtcacccaggctggagtgcagtggcacgatcttggctcacggcagcctctgcctgccgggttcgagcagttctctgcctcagcctcccaagtagctgggattacaggcacctgctaccatgcccggataatttttatatttttagtagagatggggtttcaccatcttggccaggttggtctagaacttctgacctcatgatccacccgcctcggcctcccaaagtgttgggattacaggcgtgagccaccgtgcccagccaattttttttttttttttttttttgagacacagtcttgctctgtcgtccaggctggagtgcagtggcacaatctcagctcaccgcaacctctgcctcccaggttcaagcaattctcctgcctcagcctactgagtagctgggactacaggcacgcaccaccacgccaggctaattttgtattttttagtagagatggggtttctccatgttggtcaggctggtcttgaactcctgacctcaggtggtcctcctgcctccgcctcccaaagtgctgggattacaggcgtgaaccactgcgcccggccatatatatatttttgagacaaggtcttgctctgtcgctcaggctggagtgcagtgttgtgatcatagctcactgcagcctcagcctcctgagctcaagtaatcctaccacttcagcctcctgagtagctcggactacaggcccaaatcatttatttatttattttgtagagatagggtcttgtcacgttgtccaggctggtcttgaactcctggcctcaagcaatcttcccacctcagcctcccaaagtgctgagactacaggtgtgagccatgattgccagtccacgtcttagtttttaatctcccctgcatggctgagggcagaggccagccaggagcatctgagagacccaaatttgcatcccaccatggccagttagtagttgtgtgacctctggtgatggcatcactttgctgagcctgctctgagggtgactgtgtggcctaaaggatagagggcacagagttcccactccagaagcgacacagcacatccctgccgccccagggccctgacggccttgtgggctggcaatgcccagtcgcctctctcctgggtctttggtgggctgcagggagcagtgggagcctggagtccctggtgctgaggtccatgagtcccacctgcctgtccctctctccctgtctgcctgaccaccgttcccaggtgggtttgcaagcacatcaagaagcccatccgctccaccgtcctcagcctggactggcaccccaacaatgtgctgctggctgccggctcctgtgacttcaagtgtcggtgagacagggcgccatgggggagggcggggctgacgtcaactgactgctgacatcatagcggggagccgcacctgaaagctctacaccccagcttctagacacattccagacctgctaccagtggatgacctgggcgtcggttgaaggttctagttcctggggaacccttcatgtctcagctggatgggcctctgcccacctcttttattttttttgagctaggggcttgctctgttgcccgggctggaatgcagtagtgcaatcatagctcactgcagcctccaaatcctggactcaagcgatcctcttgcttctcagcctcccaagcaagactaccacgcccagctagacaggattttttttttttttttggagacggactctcgctctttcgcccaggctggagtgcagtggcgtgatattgactcactgcaacctccgcctgctgagttcaagcgatcaagcgattctcctgccttagcctcctgagtagctggaactacaggcgcatgccaccatgcccggctaatttttgtatttttaaatgtagagacgggttttcaccatgttggccagactggtctcgaacccctgacttcaagtgatgcatctgcctcagcctcccaaagtgctgggattacaagcttcagccaccatgcccaggcacctgttaaccctttaaaaaaaatttttttttttttttgagacagtctcactctgttgcccaaactggagcacagtagcgcaatcacagctcactgcagccttgacctcctgggttcaagcaatcctcccgcctcagcctcctgagtagctgagagtacaggtgcgcaccaccatgcctggctactttacctctactttgcctatcccggtaggatcttttcagcctacatcaaggaggtggaggaacggccggcacccaccccgtggggctccaagatgccctttggggaactgatgttcgaatccagcagtagctgcggctgggtacatggcgtctgtttctcagccagcgggagccgcgtggcctgggtaagccacgacagcaccgtctgcctggctgatgccgacaagaagatggcgtgagtcgaggccatccccaggggaggaggtgagtgcagaggagtgggacaccgtgactcacagctctctcccctcagcgtcgcgactctggcctctgaaacactaccactgctggcgctgaccttcatcacagacaacagcctggtggcagcggtgaggaatagggaggggagggagggtgtgtggtcacagcaggcctccgagagagcccagcaactctcatctcctccctcctttctcctgcctccctcctttttttcttccttgcattctctcatgtaccagaattgggcagaacaggttgggttatgctgcagtaaccaaaagtccctggctgcagttgcttaacagagtaaagatttggccaggtgcggtggctcacacttaaaatcccagcactttgcgaggttgaggtggaagtatcactggaggccacgagtttgagaccagcccgggcaacacagtgtgagacccttgtctctacaaaaagttaagaaattagctgggtgtggtggtgcacctgtaatctcataatcccagttacttgggaggctgaggcaggaggataacttaagcatgggaggtcgaggcttctgaactgagctatggtcgtacctctgcacttcagcctcggcgacacaaaacctgtctcaaaaaaaaaaaaaaaagagccaggcccggtggctcacacctgtaatcccagcaatttgggaggccaaggagggcagatcacctgaggtcaggggttcaagaccaacctggccaacatggcaaaaccccatctctactaaaaatacaaaaattagccgggtgtggtggtgggcgcccatggtcccagctgctcgggaggctgaggcaggagaattgcttgaacccagaggcagaagttgcagtgagccaagggtgagccaccgagactccatctcaaaaacagaaaaaaaaagatatttacttcttgctcacattttatgtccagtgtgggtgttgtgaggtgctctgatggaagctgtccccagcatgctgtcccagatgccacgagggagccggaacctgcggaatcatgccctgggtcttaacatttctgcccacattttattggcaggtgcaatggcaaggccacgcctaatgcaaagggcgagagttcggggtgtgcggttcctccaggtgtccaggaagggcactgctctccctcccctccgcccacatctgtcaagtcccttttcacccctctgcaaacataatgggggtgccagggccaggtcaggcttgctttttgcctagaaaagcaaacagctgcaggggtctcccctagagcaggtgtaactggctgggcaggacagaaggcgcctgagctcccagggagtcccaacgctggccttgctgggggaggtggcagcccccagcatcacccccggttttgatacacctgcaattcgggcctccctcgctgtggcccgtctgtatccttgagctggcatctgcctcccgggcggccagacgcccgcctggccttccctccggcctcggtttcccctccgcggcgctccaatggcccccgccctccgcgcagggccacgactgcttcccggtgctgttcacctatgacgccgccgcggggatgctgagcttcggcgggcggctggacgttcctaagcagagctcgcagcgtggcttgacggcccgcgagcgcttccagaacctggacaagaaggcgagctccgagggtggcacggctgcgggcgcgggcctagactcgctgcacaagaacagcgtcaggtgagagcgggagccgggccggcgggtgggcggggcctcggctcgcccagaaacagcgtcgggtgaggaaggggcctggagtcttcctcctggggcattgtgctgggaccttgaggactggggacccggagggagggtaggcgtgccctcaactcgctgcgccggaacggcgtctgatgagcggcgggcccggacacgaggggacggggccgatttgtgggcggggccttggcgccgtactaaaaccgcgtggggcggaggccggcagaggtcgcgtagcgggcccagggtagggagtggctttgactcgctgcggaataacatcgttagttgtgggcggggcccatcttgatctcaccatagcagcccaggtgctagtggagcctgggagggacacggtgcgaccgacataagacggggtcgacctctttaggttgcataaaaatagcatcagatggggctgagcagctagcctcgctctgcatttccgggacttaggtggggactgtcgtagggctggcccctacggttctctggggtggccaggcagtgaccagcgggcttcctgggcggggtcacagctggggcgggtctattgctagcacttagcgaggtgggggcggagctgagggtctctccgcagccttctatggatctagggtgggatggggaagaggctcttcaaagcccaaaagctgccagccacacgtgtccaccccgcggcgaatcagagggagcgggagctgtatggcaagactggccaagcccttcggtctgtaaaacctcctgtgtccgccagatccgatggcttcctcagatgaaacacctttgtccagctatcagcttagtccctggctgcccccacccccatctccttttttgtcctgtccagctgcactgctggcactgtgtacactccgcagacacacgtgtctttcctgcctcccaggacttgagtgtcctgtcccatttgcctgcacctcgcatgccactgtccccaaggcagaactgacttctaagcccactacaccccctcggtacttctcactaaagcccgctccccaagaagtctgggagcgcctggtggacagggtgggcctgagcccagcgccagcacaggttgaattcataagctcctcttcctctttgcagccagatctcggtgctcagcggcggcaaggccaagtgctcgcagttctgcaccactggcatggatggcggcatgagtatctgggatgtgaaggtgaggcttgcccctcctggcttcccgccatgcctcccaggtcaaccctttccccccatccccactccctggagatgacccccatccttcactcctgcagagatggcactgcatggggatgaggggtgggggcggccccttgacatctgggccttggtgctcactggggcacccgtcttcagggccgggattccaacccagctgacagactccaaaactgcaggttctctgccctctgctgtgctggggctgagatgggtgatcaggtccctgggagtggggtgcctgcaggacagctgagaaccagcctgtccgttctgcctccctgcagagcttggagtcagccttgaaggacctcaagatcaaatgacctgtgaggaatatgttgccttcatcctagctgctggggaagcggggagaggggtcagggaggctaatggttgctttgctgaatgtttctggggtaccaatacgagttcccataggggctgctccctcaaaaagggaggggacagatggggagcttttcttacctattcaaggaatacgtgcctttttcttaaatgctttcatttattgaaaaaaaaaaaaaatgcccccaaagcactatgctggtcatgaactgcttcaaaatgtggaggtaataaaatgcaactgtgtaa

SEQ ID NO: 2323 - DNA, 13655 bp, Homo sapiens
  source 1..13655: mol_type = genomic DNA
ttattagtctcttatgagctttattagtgttattccaatatttaggacatagtaggcactcaatatgtgaatgacaggttatacgaacaaactgaagtttatacttacgtttcaaggtttttgatattgccaaatggccccctaaaagtgatataccaactcatattctattcaccaaaatatgacaggatttccccacaactctgctaatagcaagatgtacattatttttattgtcagtcagcattgtttttatttgtattttttgtaaccaatggggttcaaggtgtttcatgttttgttggccatttgtatctttttgtgaatcgaaatttggtatgttttgcctatttttcagttggtcttttcttaccaattgaaacaaattcttcatatacttaagacattaaaaacactgtcatatgttgcaaatattttccattaccttctgctgtacaaaaacttaaactatacaaaatttcctttgtttttagctgtcatactttgctaatcacaatttcattcactcgatgtgttacattactaattatttacatataaggaaatgtactaagtattatgtgtgtgtgggtaccagataaaaaccagaataactggacacatggctctgaggcagtatgcaataagtgatttaatagtggtagtttgctctaagtgtttttatgagagaaagggtatcttctccttgaatgattcagatagcctttaaaaagttaaaatctgaatcaggccttgaagaagagttaggatttgaaagggtgaaggtgtaagtaaactgcacgagcagaagtagataacagaaaacacaaggcatcttcaaagaatggtgaataatccagtttgggttaaataatgtaggcagagtatttatataaatacgatttgaactgtattcaaatagtagtatttgctgaactgttttctgaatagttttcattacgtggcctgtagctggcttccttagtgccaaaagtttactcagcatattataatccttggaaaatgaagcagaaactgcatgaaaagagatttttattttcacactccttcaacacctaaggctttctcactttgtgttacaactaaattggttgactaatgtcatgtaatctgagaaatacactgtacttcgttctagtagatatttaaggtccctttaggactgaaacttacagaaatcagattccaggaattatccaatctcattttgatttcggataaacattaatttgccttattccttaaatatggtgaattcattatgaagtctttggcatacttttaaagatggaagtacaatattgcaatattatacatatactttgtgtgccatgggtcatctatgcacagtaagatgaagcatgatattaatgacatctatttagtcacaaagaaaatttaaaatatcacctgaatgttcagtttttcccccaagtttaatcagacttgagagtttaaattaaaaataaattgtgttgtaggttctagtcacccaataacttatcggatccaggcttaattattgtttaatgttgcaaatttagcgcagaataattctttgagtaaagatcaagaaataattaaatatgatttgaaaaagtacaaagtccaggcccggcacggtggctcacacctataatcccagcactttgggaggccaaggcgggtggatcacctgaggtcagtcaggagtttgagaccagcctggccaaaatggtaaaaccctgtctccactaaaaataacaaaaaattaggcgggtgtggtggcaggtgcctgtaatcccagctactcaggaggctgaggcaggagaatcacttgaacccgggaggtagaggttgcaatgagccaagattgtgccattacagtccagcctgggcaacaagaccgaaacgctgtctctttaaaaaaaaaaaaaaaaaaaaaaagtgcaaagtcctatgtattcttcagagttgttaggaaagaaaacaaataaggttagctacatatttagctaaccttagatttaataaactattaagttatttaggtcaaaaagaataactaaatggatgctacaaatttcaaccagtattttcgattttttgaggtctatcatctgaaccctcagtggcaaacaatacgaaaattcaacatatttttatttgttaaatatatgaatataattaaatatattccttcagtaaactgaactggacaaaactagagaacagaccttttccatactcatttaactttaaaatgatattactttgaattctactacataccatcttagatcctgttttgaaattccattcacattacattcgatttactagaatgcctttttttttcttttttgagatggggtctcactctgttgctcagcaggaatgcagtggtacaatcacgactcactatacccttgaacttctgggctcaggggatcctcttgcctctgcagcctaataatttttttttaatttttatttttttgtagagttggggatcttgccttgctaaccaggctggtctcaaacttgtggcttcacgcaatccccacacctcagccttccaaagtgctgggattacaggtgtaagccaccatgcctgatctggaatgctttctaaaaatatggcattataaacataatactaaagagaaaaaaaggttaaatttcacttcaagaaattatcagtctaatagcatcagtaaaaatggcacttttagtcatggcataaaatatacaataaggctatttttcaattattgttttcaagttggaaaatgcattatgaaacactcaaaaagatgctactgggtttactcatcaagtgcttttgacaccatataaatgacagagtaacaccacagttatgtgattgggactcaagaatccttaaatgttaggactgaaaacaggtatatgacttatttgtccagaatttatatttttctgtatcccaataaaataattaagccatgtgtattgtgtaaaattacagtctttcagtctgtcctatgtgcttgctctcctggctagatattagctaaaaattagcaaaaacagccatttcccctattattccccagcaaagatgtgaaaccaaaacgcctaaccttttctgcctggtggactgccctctactggactatttgaggtattcagccagcaggtcaatgtgactaaaaaggtaaacatagagataaatgtaaacattaaaaaaaaaggaaccctttagtatattaacttttaccatgaaaacaatttcagtcattttgagaactgacaatgaagatgtttatacagtcttagtctccttttcaaccttggaggcagatctgcagcaataatagtaacaagtaggagcaatgggtgtactatcatgaccatcttttatgatgactggtgcattaatacaaatcacatttttctgagtccattcatgctatggatgttttcttatgcataaacatagagtagacacatactaaatagatcacatctgttaagtctcttgccacaagcatcaaaacttttcagagctgtctcttccgtgaaaatccatttcatgtagtagcaagttgattttctttgtggttcatccccacgcctgagacttgcagtaatgtaaaaccagtttaccatcactgccaaaacactacaaaaaaaaaaggcaataaatcaaactcaatcttttattattcttagatgaaactaagaagataaatgccacatgtatcataaatatccacacacgtatattaagttacctatgttacaggctatctctttcaaaggatgcctgtttctatcagacacatattaataatcctaagtgtttaataaaatctgtcctttaagcatcttaggcatgaatgagcttatgtattttaatcttgtcctttctctacatgtccaaccacaatatatgtaattttagctgttttctagtagtggtgctagtatgtgtactctaataactattacaatgactctgtaagatgttaaacagtcattcttatgctgttttctcaatttcttgtaggcagatttggataacagattataagaacaatgtagaagaaatcaaatgtagataaagaaaaagccttactttatgagaatcatgaagatgactttgaaatgtaatttattccttggttcttcaatcattgtataatttattaatatctttctatgatcaagatgttagataacagaacaagaaagtcatcttttctaccccagaaaattaagaatggcatgccatctcttgaaataaaaatgtgaattaacaatactacacaatatacatattatacagatgtgcatactcgattaagaaaaaaaagcagtaatttctttcttttttttttttttttttttttttttttacctcatagagagttccaacttcttggtctggggaaggagcaaaggactgattcacataaataaactacaagaaaggaaggaaaaacagagatgtttaatggtatcctgattaatctgcatttttctgcattccaatcagctagctattttgtattgttttcacaattgaagaaagcttctctgaactcctaacttttctaaatagtcaatttaaagagatcattacgaagatctcatttttcctccagaggaataaaaataacacaattccagttcctagaacagtggttcctaactttgtataactaagaaacttttaaatattttttacaaatagcttttgaagagctggctattcaagaaattacattatcgtaaaaatgtccccacttacccacaaagaatttctcctaagataattacacaggcacacagccaaaaatcaatatgtctaatattcaaggtagtttgtacactttccttgggtaaatgtatgacatatatacttaggttttttaataaagtcacttacaggcaaatgaagcaggaaaaaaagtaacaattaaaaccttataaccttgctctttaaaggattcactgctcaatgtttcagtttagtctgtttttactaaaatatttctagtacttaaagtcacagtgttgaagtgccctttaataattttctttttggaaaacaaaactttatttgcaggtaacatatttagttttcctttaatatccaaatttgggactaaaatgtcctggattaaacttagtatttaaaaaaaaaagtatcagaatagttggttgacagatactattttgatcaccaaccatgaaccatcaatattgcttgcatctctcttagccaatatagtgtggtgattaagtgtataggctctgagacacacctgggtttgaatcctggctttacaaataatctctcatcctctttatttgtaagatatggaaaataataggacctatacctcttgggtctgttaggaaagacaaaatgagataatacactaactttcagtgcctggtatatgtactcaatagacgttattgttaaattatctttaaatagttcatgctgaaatatcaatttgtggttatggctgagtagagttctggcacaaaaatttcagaactgtaacagaaaacaatgtgcattataatgtgaattttttgtaatacagatataatttgtgttcagtgcctgacaatttatgagcaaatccagattttactcttgtacattataaatgaggggaagggctctcaataacagcttagtttatcagtgtctatgatgtgctgagaattgtacatggaactatgaagattaatgtgatctcttccctcaatgagcttataatctgtaggagaggcagagacacacatgaataaatacgggtgagaaaagtacatctaatgaagtatgtagcgtacagaaatgtacactactctagcctagcaaaagggtcagtgatggctttgtgggaaataagaaataagcaggatttaaccaggtgaagaaagcagtaatcaggacttcacaggcaaaggagacaaagagtaagatggtgttgtgttcacagaaaacagcagactcgatggagcagagaaccaaccaaaggcattcaatgtgattttgtaacaggtgttaactggaaattttaaaaaagcaattcagttagttcaaaagacagaaagacataaatctgtttgcatactataaagctctatataagtaacaggttaacatcatcaattccactgcagaatcgctaagtggcgtataatttgttactttaaagtacatgtagttactccaggtttgtgaaagtaaaattccatggaagtattatttccaaactgcaagaacttgggcagacaaaattagttagttttattaattactttgcctttaaatcagcttttttttctttctgcttttaaatcagcagtctttaaattgatgtctctagttattctggttataaagctctctgtctagtggattcctcatggttcactggaatagcattttctgctaatagtctgtgccccgattaagtcagttatgcaggatatgaaagccttatttcacactttttccttaagcatctttgctgtcaaagtttgacgacagcctaactttctaagtcatgccctctttcccgtcccctacatttccaaatgatttcaagtccagtaattttaacagaatgcatcctgatgttcattattctgggttgatactctcaggtacttcagatgttttttcaatatgtagtttcaaatctcttaccttaaatgacatttttacagtattttttctgttcccttgctctggttttcttcacagactcttgtccaaaggttgactcactttttaaatttttttcatcttctatttttcttaacatattatccgttgtttatgttcctcctactttagtctccatttctgaaataattttcttttatttctaattcttttcctgagcttcatttcttagttttactaatgctgatcgtttttctttcatgtcttataccatcttattgtttttagctcattttgaaatacaaggttacaattttcgacttgtcttataggtgtatatttctggcttgatttcatcgtctctagggatgctgttcttttccgcatctcgtttttcttgtaacactgtacgggatttgaccttgttattcctgttattgtttttatgtgaaattagttttcctcaacttttagaatgaggtgaattagggtagtttttctaacttcacagagctccccttgttgttttttgtatactattcaaaacgatggaggcctgctttgagctttccaggctctgttccccaccattttgatctggtctttctctttccttcctttctcatgtccctacccttttcaattttcatttcacttcctgaaatttctcctcagtatggggtcccagagccctcctgggtccattttgagattgtttgagcccttcaagtccttagtgcaaatgtattgtcatcacgtgctacagaagagggcaaaactccttagtcagcttctattcttaaattggctcactttacttcccggtcaggatctattagcgtttttgaggttctacttttctcagtgccgtcagatgccaaccctgtttcttactgcttctttcagcacagatgctgataccatgcaggtcctgtggttgctggtggtttgtccccaccaacatgtgttttggggctcatggggataccttatcacctagttttgttacaaatactaatcaggggtttttggttttgctatctagttgactaagttttgtgagaatttcagagagattcacgtgtaccttctgattccaccatcttcccagaattcctagcattactttttttcctttaacatccattttgctagataaaattcaggaggtatcagttttagtttaatctaggaaaatgacaaaataattcttatgtttcctattgcttaaatgggaaaggataatcatattcactacagaggatttaatttaacccttatgaaattgttttcatagggtaaaatggctgaatgatggcaattttatatggttcaacctactatgtattggtatcaatcaagtcctttcaggttactgaatgaatacaggcaatacaaaatttcaagactcttaacacagaacacagtatcatttcatttttcttaaatctccatgtatttctaaactaatgcattaaattactcagtactcttattttaccaactcttcatgttgcatctttagcaaagatgcagcctctgctcatttctctcaagtgtatgtcctcattcccctgacttttccatttagcttcacttttgtgagagcacttgcagccaaactcttagatcagagtcagttttttgctcctccctgacaaaaagaaattccaacatgtcctgctttaatgatagttcacttgttttacccatgcacacgcctgtgttcagaagcaaatatttcccccagtgcccccaaaaattcctgattttatttaaaaaatacttagcaattcttcaattacctatccactcatgctatctgagttaatactatccaagattgtgatctatttgcagataaaggtgtctcatacatataattatgtatatataaaaaacacttaatgtgccaaatacatgtagacatttaaatttctgtagtcaaatgccaaattaaaatgcagtggcatttaaagaattaacctttactacaactgccactgtgaagtgcttaacgtgtactgttaacatgaagtatttcctagttctttcacaatatatggcaaagatacattgcttacctcaagaaaaataggaaaaaagtaactgctatcaaaacaaactgaaaaaatccaaaacttctgtagtaatgtacagatattgcaatgctctatgatagatttttatgcatgggtattcatgcatactttcatgtgactttctgaggaaaacaatacaggaggcaaaaaataaatacataaactggttcacattgtaaaacaaatctaaaacatttcatttcagaattccccagagaatcctttgataaagtacataaactccactaacaagagataaggcagggcacagtggcacactcatgtaattctagcacttctgaggcggccccgtctctactaaaaacacaaaaattagccaggcttggtggtgcactcctgtaataatcctggctactagggtggctgaggcaggagaatcgcttgaaccaggaggagaaggttgcagtgtgtcactgcactccagcctgggcaacagagcgagactgtctcaaaaaaaaaaaatgaataaataaaaataaagggataaaagggcataacaaaagcgacatatgtggctccatatgcatttctataaacaacagttaattcactgttgcctaggaactactgcaaatttttgtaggaaaacatcaccattggtttcataccaactgttctgaggccacaagtttaagaaactttttgatgaagtcaatgagtccttggatggttcgtgttcgctctactgcccacttctttgttttcataataggagtgtctcccacagcctttagcaaaatgtcaactgtaaaagaagaataaaatttactgacaattacactgaaacatctaaagagaatggaatataaaagacttagaaatcagaaatatttaatctacatccatcttacgtatttatgatactgaagatatgtgagagatgtaaaaatgttagattcttttccatcatttttttcttgatcctacaaagttctcccaacaggactaatttttaaaatgccttttatcttaacaggcagttccaaagagaggaaatacaaatgatcaatacacaaacaatatttaagttcacaaaaagcaaagtaaaataatgtcatgtcccttttcacccaccaaactagttaaaattagagtaattaccagtgtagatgatactacttttgagaatgtaaaatggtataccctttgtggaatgcagtatggtaatacagatcctaataaaggtatactttgattcaataatacttctaggaatccagtgtaagaaaatatgagatgtgtgaaaattcacttaaaaagatttcacctccatttaagcatttatttttatatgaaacactggtaaacctaaatacccaaaaaggatatttggaggtgactgattaaatagaatgtagtaaaccgcatacacttttaactgcctggggttcgaatcctggctctgccacttgctgggtatatatgtggatatttaatctctccaacagcatgtataatatcttaaattcattaaaaaccatcacaaacacattcacataaatatggaagaatatgcaacaaaatgatatttctcagtagtgacattgtaggcaatgattacttggatttacttatgctgtttgtaactaccaaattttctgtaataaactttttaataaaggaaagcaataagttattaacaatagaacaaccaaagccaaaaagaagttgcagaaagagaaatcttaaggtttcaacgatccaaaacacagatatgcaaacccaaaccctatgaatctgtctctcagacataaagttatttgctaaaacaaaacaaacatacatctggctgggcgcggtggctcacgccagtaatctccacactttgggaggctgaggcaggaggatcacttgaggtcaggagttcaagagggcccagtccccttccaacttcttgttcacgaccagcctggccaacatggtgaaaccccatctctactaaaaatacaaaaacttagccaggcgtggtggtgcatgcccgtaatctcagctacttgggaggctgagacaggggaatagcttgaacccgggacgcggaggttgcagtgaaccgagattaagccactgcactccagcctgggtgacagactgagacatcctctcaaaaaaaaaaaaaaaaaaatctacagtcaaaaagcaagacacattgaaagcaaaacagtgtattgctgccccctaaagttaactctattctattacacccttcttgctccattctttaggtattaaatattggggccaaaagatcagaggtcattttattcaagtttactcctggaatgaacgcatctagaacacatgatctttatcttcctactaaagaactacttaattatcctaggtccagttatcttaggaataggaatgaatttggagataacgtgggattttagttagcctatctttcatacctcctttcactgctccctcaaatcccctggggctatcaataaatcgattaattcaattaaacatttccagaaagtgaagcaggaaatatcatgagttatgctaccaaggatgaagtgtaagacagtgagaaaccagagaaggaaaataatttaattatagctgccctctctttttaattttaaaggtgatttgcttgtagttctgaacccggatacacattagaatcaactagggaaacacttactccccaggaaacctaacatacctccagtgccaaaaccttggtctgtttcaacaatctttcttctgtagattaacaaaggctgaggatacaaaacagttaagctgctttcatcatattatcctcaacaaataatgacaagcacaaggtaggaatagttagaaactaagttttatattggagaggcaaactcaaatgctaacaagagccagaaaataaaaatctcatccttaaatgacagttcaatttgcaaaaaaatactgtccagaccaagaaaatatgccctcgggcaatatttagattgtaagccattttttttagcttttgttttgcacagctatcatcagagtcaagtaacaagttttgactaagactgttagaccttaaaacgaatctccgaacgtccgctcttgcctatagtaaattggaagaaaaaatgcaacaaaacactgtaaaacctgcggaattcttttgaagaaagattccagtggctatccatggaaatacttatagtgcatcaggtggaaatgggagtctgatttaaagtgggaaggggggcagtcttgggagagaattatcctccacagtagcagaagttgaagaaaaagcaatgagaccaatgtcttttttttttttttttttgaggcggagtttcgctcttgttgtccaggctggagtgcaatggcgagacctccgcccactgccacctccgcctcgcgggttcaagcgattctcctgcctcagcctcccgagtagctgggattacaggcgcgcgccaccacacccatctaacttttatatttttagtagagatggagtcttaccatgttggccaggctggtctcgaactcttgacctcaggtgatccacccgcctcagcctaccaaagtgctgggattacaggagtgagccaccgcgcccggccagagaccactgtcatcttaagacagaacggggaaaacgtctaaggacgaaatcagcctctctgaatcgaggatgcttatatgctgcttttcccataggcaactctaactctaaacagagtgctttagaacacgtaattttagcaatctcttttacaaagggaaacattctcaagcaataaagggttgaggatagctgactcaagcaatgaaataactcacaaaggttccaaaatgtgtttcttaaaaaggtaacatctatgcctttagctttcccttagcagtcttcattctgcataagaatttggtttttggtttaaggagtgaattcacaaccaactgggagggggaaaaaagcaaaagcgagttaagttggaaggcatgaattctaatccaggctttgccaatgaccacccctaccaccataaaacattactcaaataattagctcctgtgttaagtacctggaattaccgagacccccctccccccgccccactcagctccctccctccttcaaagagctcgcagtctggccaactcaaaaaaatacagtataaaaataagtgtggcagccaagtatcaggccctacaccgatagacagagatggtattttaacactcaacttaaaggccttaaaaatcaaaaagtacacttcttttcttctgatgactggtcaaaatgcaggtctaggacaggcgctcctctaaattttgcttctttactggccgccacccctactcggatgcaatctgaacctcccgcctctctgcccggaaataaattcagttactttttttcttggtgtcgccagcaggttcctctgttcccggggaaactgcagcggaagacgggggctccggggtggttgtttctggggagacatccgtaagtccttcccctccagcagcaattgaagtaggaagctgcaacacagactgcggctcctccgccatcttgcttggagacactcgagagcggaagtagcgactgagcgcgtgcagtgggcgtgcttttctccagggagcgtcgcaaaggaggcgccggagtagggggacgcaattacacagtgaaacttggtgttcccggctagtcattcaaatcgaagctgtcgcagacctctgaacgttagtaacgcaacatgtgtttctccgcgactacagacctcgggagaggagcggtgggcaacgtgtctgtgctcggtcgaatgcgcacactccagttaggccgctggctcggacctagaaatgtttcc

SEQ ID NO: 2324 - DNA, 13655 bp, Homo sapiens; identical to SEQ ID NO: 2323
  source 1..13655: mol_type = genomic DNA

SEQ ID NO: 2325 - DNA, 13655 bp, Homo sapiens; identical to SEQ ID NO: 2323
  source 1..13655: mol_type = genomic DNA

SEQ ID NO: 2326 - DNA, 13655 bp, Homo sapiens; identical to SEQ ID NO: 2323
  source 1..13655: mol_type = genomic DNA

SEQ ID NO: 2327 - DNA, 13655 bp, Homo sapiens; identical to SEQ ID NO: 2323
  source 1..13655: mol_type = genomic DNA

SEQ ID NO: 2328 - DNA, 13655 bp, Homo sapiens; identical to SEQ ID NO: 2323
  source 1..13655: mol_type = genomic DNA

SEQ ID NO: 2329 - DNA, 44104 bp, Homo sapiens
  source 1..44104: mol_type = genomic DNA
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtgtgagcggcgccggtgcgggctgggagtggggcgggcgggccccgcggaggcatgcggggcgtcagcgggaacctgaggccgagtccctggcgccgcccgcacgcatggcggccgccccgggtaacccgcgcttgggacgccgcacgccttttaaatgttttttctaacctgcgttttatctttggaggattttccctattaaattgtacgatctttgtggggaggcacagttcgtgtttgtatttgtaaatcccagtagctcatacaatgcttatgcacttaaataggtcccagaaacatcccatctatggggtcatgttaatgaaacggtcgttgactttcagtcgcagaattaacattgccttctcaatgcactggaacgggtggcctttgattcctcaaacttacttcccttactccaccttggtggttttttttgcggggaaacgggataggggatcagggtcttgctgtgtcgccgagcctggagtgcagtggcggagatcacggctcactgcagtctcaaactcccaggatcaagtgatcctcccacctaagcctcccgagtagctgggattacagacgcgcttcaccacggtcggctaatttttttaaaaaaaaattttttggaacgaggtctcactgtgtttcccaggctggtctccaactcctgcgctcaaacgatcttcccacctcggcctcccaaagtgctgggattataggcgtgagccaccgagcccggccccaccttggtgttaatatcgtaatatcttttaggcgggacagaacctttactgttactgaaatcttcagtatgaaagaggtggttttctttccccttactgcttgcagcttaagggtacaaaaatgtttgtacctttacctaaattataatggtcctaaggtggttccatctgcgtctgaaagtaaacctgacgactttctcaagttatgctgttgatgatattcagaataataattgctaccttatattgcattctgattgtgcaaaatcagtagttctcaaacttagctccacattagaatcacctatggatctttaaaaaattacaaatcccaagccacaccccagaccaactaaatcacaagtatcacagtacacaagtatcagtgtgtgtgtgtttgtgtttgtgtgagattaagcctagaactgcatgccaagttatcagtgttttttgatgcttcccaaatgactactgtgcagacaaattttagtactgtggtaagtatttgcatgtgttattttatctttcccaaaattctgtgtatgaagcaggaactgttattgccattttcacacatggaactgaggccaagagagattaggtaacttctgaggttgcacagcaggttaatggtgagactgggtttttttgtttttttttttttttttttttggagacagagtcttgctctgtcacctaggctggagtgcaagtggcgtgatctcagctcactgcaacctccacctcccaggttcaagagatcctcctgcctcagcctccctagtagctggaactataggcaagcaccgccacgcccagctaatttttgtatttttagtagagacagggtttcaccatgttggccaggcggatcttgaacttctgacctcaggtgatgtacctgcctcagccacccaaagtgctaggattacaggcatgagccacagtgaccagccgggactggaatttgaacttaggcttgatgactaacttttgcatttgcttttctcactggctcccccagcaaatggttctttgctttcactgcacccattgttttaacaaaactaagaagaaagaggatgctttgctgttctaggaggccctgaagaacagtgctgtttcagaaagccagaagcacaagaagtccctcttcctcaaaacatgattccctgacagatgacataaatcagttcattaggtgcttattaggtgcttatgctttaaaagctaatatcctttgaaagtcaaattgggtgggaggcttgactcacccctcactgaacattttcacttactttctgagtctgttttgcctcatctataaaatggggatgaagcttgccctgcccacttcataaaaacagtgctgtgcatataagtgctttcaaagccatctgtataatagcttgtaattgtaaagcgttatctctttgacacaaatggaatgttttcctgcactttgaaaatggcatcttgatggggcaggagcatgtagaacagtcagaataagaggtcacttgtggagagcagatagctttaaagggtgctagagtagcgagtaatacctgcctgagggaccaggacaggagaccgggatgagaagctaacaagaggcaggagagtgagacaggctttgcatgttaagatcttctgtttaggcagagggattgacatttagggagatcatttctattatagtttgtgaaacaccttcattccactcattccagccttcccaggccagtcaagctctgaccctccatcagcctggagtctattctctgttcagtccgtgcctttgagtctgaagagaaaggtggaaagaagccgtagggggagggaaaggcttccctccatctccagccttctcttcagggaggaacctttgggaaggactccttttgaacgcctgtgttttttgaaagaacctaaaattatcacagggcactaagctttggtttaacatctgaaggtcttactagagccctttgacactggtggattttaaaccataatttcccaggttgaaaccaatgtccagtttggctaattcgtttgaccaatagatgagagtgtttctacccaggagttctcttttcaggtatcaaaaagtgggactcaaaactctttaaaaggagaaacaagctcttttaacaggaatagtcactagcataaaccctgtcttgttctgcttggtacctgcagaacaggtacccacatctgatcttactggtgcctgtgtacctattactcttattttttatttcatttcatttgtttatttatttatttatttatttagagacagtctcactctgtcgcccaggctggagtgcagtggcgcgatctcagctcactgcaacctctgcctcccgagttcaagcgattcttgtgcctcagtctccctagtagctgggactgtgggcaagtgccaccgtgcctggctaatttttgtatttttagtagtttcgccgtgttggccaggctgttctcgaactcctgacctcaggtagtttgccttccttggccttccaaagtgctgcgattacaggcgtgagccacagtaataggcctgtgtgcctattacacttaactacgtgttctttctaatcttgtgttttgaatttctgtactctgtctcctgtcaaatttattatgtttggaaagagaactcatttcctctctaagctctcccctcttgtgttctctcacacgttagcatcctccgcccagttgcttgagcgaggagcctcagaataatccttgactttttaccaatacagatctgttagcgtaacggcctgcttttataatcttttatttaatcattgccagtaagaagtctaaatttctgatcctgctttttcctgtgttggctccaacctttatttccagccacttaccaaaagactctgttattccttctgcatggcccatcatcttcttttaagacttaactcatatatcacctcctgtgacaccattcataaaaatgagtacagagtgtattctctgtacctttttatacttgactgaattaaatgttaactccatgttggagactgtcatttgtatttctagttccctgacctaaaaagtaattagatatgtcaacttatggtaaagttctcctgtcttacttaaaggtacatagcatttcactttgccattgtgtttagtgtgtttttcttttttcctcccaaggtagaaacaaataacttctggggtagaaagcattttcagctccctttaatagggaagacattcttgcaggtgattctgtaggttactgtggctgaggaatgtatgttcctgtattgcatccttcaatacatgacaaggtaggtacctagcaagtgtacatacgttgtaataaataacttagtttctgacttttttattttaatagataacaaattgctggaaaagtcagatcttcattcagtgttggcccagaaactacaggctgaaaagcatgacgtaccaaacaggcacgagataaggtattttgaaactaacttgtattatttatgtctcctctaaggaaatttatctcagttcagttgtcacttctctaatttaaaagcaaatcaagtactatttctgtgttccagtttttgtcagctcctttcaaataagaactaaaaccatgtaattacaattgttttttagaaggtatgtcatacctagaaaggttattatcagtacagtgctctgagcttgagaaatttcttaaggcaggttcacgtggtaaccctaggtcagtttctcatctaacctgccaggattcatgtttttttgtttctttgtttttaaataatcacagacaagtatttctgagcgggtttgtgtagatcctgttaatgtaggattgattggcacatacgtaaaaattgctttcctgcagtatgggtctatttgatcctttttaggttggtgtttttttcaacatacaaatggtccccaacttgcagtggttcgacttataatttttctttttcttttttttttttttcttttttgagacagtctcactctgtcacccaggccggagtacagtggcacgatctcagctcactgcaacctgcaacctctacctcctgggttcaagcaattctcctgcctcagcctcccaaatagctgggtctacaggaacccaccaccacacctggctagtttttgtatttttagtagaggcagggtttcaccatgttggccaggctggtctcgaactcttgacctcaaatgatccacctacctcagcttccgaaagtgttgggattacaggcgtgagccaccgcactggccagcttacaattttttttgttttgttttgttttgttttgttttgttttgagatggggtctcgctctgtcgcccaggctagagtgcagtggcgcgttctgggctcagtgcaagctccgcctcctgggttcaagccattctcctgcctcagcctcccgagtagctgggaccacaggcacccgccaccacgcttggctaattttttgtatttctggtagagacggggtttcaccgtgttagccaggatggtcttgatatcctgacctcgtgatccgcccgcctcggcctcccagagaggtgggattacaggcttgagccaccgcgcccagcccagcttacaatttttaacctttataatggtgcagaagcgatacactttcagtaggactgtgctttgagtatccatccaaccagtctgtttttccccttcagtttagtattcaataaattgcatgagatattcaacaacttattataaaataggctttgtgttagatgattttgcccaactgtaggctaatgtaagtgtaacctatgatactcagtaggtgagatgtattgaatgtattttcaacctactatatattttcaacttctgatgggtttaaagagacatagcctcagtaagtagaggaacatcagtattagtagattgtgaaatcaaattagcagattgcagtaagctcttatttttctttaagaactagattagaaaaatatcagtgtgtgctgggcttggtggctcacacctgtaatcccagcactttgggaggccaaggcgggtggatcacagggtcaggagttcaagaccagcctggccctgatggtgaaaccccatctctactaaaaatacaaaaattagccgggcatggtggcgggcgcctgtaatcccagctacccgggaggttgagacagaattgcttgaacctgggaggcggaagttgcagtgagccaagattacaccactgcactccagcctgggtgacagagcgagactccgtctcaaaaaaaaaaaaaaaatatctatatatctatatatctatatatctatatctatctcttggtgtgtattgatagaatatttcatgaaatacatatttgttcatggcggggtatttgtgtttactgggtcactggtgtgcatttatgtatatttgaagtcttattatcctcttctgtaatattcattgtgtttgcatgttaaatttggtatggggacagtagccattattgctctgaaatctccacacatttagcaattgtaaaaacaaggttggtgatttatggtgtctagaaatggtagctgtagcctgatgtatttactcctagagctgtagctgctctcatgtctcctcatctggcacgatggtctcctgatagaggacagagtgggaaagataccagagaacagatggcttggcagggcctagcttccatccttgctttgtaacagttcaggagatcctgcctggctgtggccctgggaggccttctgtagtacttaagatattagttttagtattttggttaattttaggtgtagataatgctgtttcaccattttcgtctaaattcatccaattgaaaactaaaaacatttctatctgattaaacccttgatgactatattcttgtattctttatctgttagccaaactcatgtgcttggaatatgcagccgttcttttggctaaatttcactgggatagacttttttgaggcagggtctctctctgttgcccaggctggagtgcagtggcatgatcatggcttactgcggcctcaacttccagggctcaagcaatcctcctgccttagccttctgagtagctgggagactataggtgtgcaccaccatgccagtctaattttttaattttttgtagagataggggtctcactgtgttacccaggctggtctttactcctgggcttaagtgatcctccctcctcaaccttccattagtgttgggtttacaggcatgagccaccacacccagggggatggtcatttagttggaggtcttgttataaaccaggttcattcagcccacacacagcaagttaatcactgagatgatgggttttgtgagagtttattcataacgtggccaagcaaggaggcaggagaacaggtctcaaatccacctccttgaaaacagggattgggggtacttaggcagtagaaagcagggtggtctaaagtgtgggaagaggtgattggtgggtaggaaagatgaggtaattggggcttccacgcaagcataatctagctttgtggttcctcataggacacatgcagaaaatggtggcgtcagcaccatctgagggaggagtgttttggccctctgatgtcaaaagatcacctcttgggcattcacacaggcccagttgaagggttgggggtctcaaccagctttaatgagcaagagctgcctcctagttcctggagaaaaactttaagcaccagttattgtagtgagccacagtcagttattatttataaggaagctattgggagtttagttatgtgttgtttggcaactcgacttgctagtgggagtttggaactagaaaaaagtgatgaaaagcaggcaaggcaggttgaacggtgggcttcatcaggttaccccttgttcagtctttccatttccacaaacattatccataataagcctgccctcctgacttctttgtttccattcacagtatcgttgttttccactagtcatctatggttccttcttccctctagatcttcccatctccatattcctttattcctcatattccccatattcaccaagcccattggttctccaccccctagcctcttgcatcctttggtttgcatttattttgccacctcctttgtttatttatcttcttattcccagactgtggtgagagcctcattcactcaaaagactcctgtgaccgtagtgtgggctgggcattagggctgtagagatgagtaagccagagtccctgctctgaggaggaatagagtctagtgggggagaccaactcaaagggacatttgctagagaatgtaagggtgttcacagaagctgggcactttgttggtttcctttcccctccttcctgtctctccaaagttcctgcctgtctcatcctaattaaccgtaaaacactgcacactgtgcttaaatagtgatctgcatcagttatcagactttctcttaagtattttcatcactttgcctacagtttaaaatcaaactcttcagcctcgaaattgtttattctaagcacggttcctggactagtgacatcttctgggaaactgttagaaacgaagattcttgggccccacctcagacctactctattagaaactctgggggtggggcctggtaatctgtgttttcagaaatgctttagctgattgtagtgacctctgaagtttgagcactaccacctttactgctactcagacttcctggaaccagcaacattcccatcaccagagcgcagaaagtcagaaatgcagatggctgggccttgccaggaaagcaggtcacctgttagtgggctccaggaatctgtgcttgaaacatgccctcggagtgattgttttttctacttgccgaagcactttagggggctgatattcattgtaagtaaaataagaagtccttggaggctttgggtcatggaaagagctgtatcctgcttgccttagtctctcctagcatttctgttgtgttctgtgtcttggtagactttgaagtttaagcatctaatcctgaggctcctctgcctgatgatcttgcctccattttgcccttcctaggagattcctactttagttcctctttggaaacccctcccaaaatgaaaccatccttgtctggggaaatctttgcctctgaacatgattaacactttccatcgtcactctttgatacacttttgtttttctttgtgttgttagtttttgttttgttttgctttgtttttttgttgctctgtcgcccaggctggagggcagtggcgcagtctcagctcactgcaacctccgccttccgggttcatgccattctcctgcctcagcctcccgaatagctgggactacaggtgcccgccaccacgcccagctaattttttgtatttttagtagagacgggatttcaccgtgttagccaggatgatctcgatctcctgacctcgtgatccgcccgcctcggcctcccaaagtgctggggttacaggcttgagccaccgctcccggcctgttgttagtttttatttcatgaatctgttctatagctagccagctccttggaaggtgggtccacatcttacatgcttgagtccaggagttcgaggccagccagggcaacatagtgagataccatctcaataattttttaaaaggtgggggagatttgataattattctgcctgatttaggatggtttcatgtaaagtgtgttccactgtctaatctcttggcattacttcttgggttaagattggggaagtgccaggttgcctcaagataaggtattagtttgtgcttagctatgtaataacaatacatatagagatggaaggactgctatactaccacctttatccccctctttttattttattctgggtcatatggagggggcagttctttccgctctcatcggatgttggatgagaggaacaagtgtccagccttgttccttttctccatctacaagctttccctagacagtggtttcagctgctcactatagtctgataattctcacctgtgacaccagctttctctcgaactataaatccacagttctagttgtcttctgctgtatctgagatattatgcaaacacttggcaaagattccaaaactgcattgactctggaggtgatctgaactcactcctgtggctttaggcacatctgtttgctgacagtgtctacatgttagcctccagcttggacttcttcttgaggttcagactcttaatactcagtttccatttgacagtactcagttttcacttgaatggccacaaacgaactctttaggtctcctccaaaacctgctcctcccacagtcttgcccatttcagtgggtgacacctaccttctaccagttgctcaggccaaaagccttgattcatccttgactcctatctgtcttcatgccccatagccaattcaaagtcaagtcctgttagcgctgtctttggaatggatctagaatcagaccgtatctcacctcactgctcccaccctggtctgagccgcactgtcccatgtttgcacttcacagtagcctgctggctggtcttcctgtttcggcccttaccccactgcaatctgctctccttttaaaacctaagtcattcagctgctcagagccctccagcagcttcccttcacgcctagtaaacctcacagccctcggaggtgcccacaaggctctgcatcatttccccacctcgtccttgaccgcacctcctctgtccccctgtgcctgggcttcagtcacccttcctccaaatacaccacctgctgtacacctctccaggctctgctgctgctgctccttctgcccagagggcccttccctcaagggtccacatggcttattcctcacttccttacagtctctagtcatgtgtcacgtaggagaaaccctcctcaattacgttaaaataggaccccctccctctgttccccttcttgtgcttgagttttctgcaagcacatgtgactgctgacctcacacgtgctctcagttgactgtcagctgtgtggaagcagagccctgcactcactgctgcgtcatcggcactcaggtccttgctgagccagtgggccctgttggtgcctgttactgggacttcattcaggaactttccaccctttattcctgatgtgcctgatggtcacagttgctttgcttttttccatgtgtttcatgtctcctcctttccactcatagtgcctgtaaccgcagctgctggagacacccgaatggtttattggctttgtgaacatgtttctggagttatggtttcattgcctaattggaaaggtttggagtctcatttttccccctccgttttttgcacattctcttcatctgcctggtttgccaatttagtcccggacatgatggcacatggaatgacaatcagctacaagaaatggcccaactgaggattaagcaccaagaggaactgactgaattacacaagaaacgtggggaggtaaagctagcccttttcctcatctgtcttctgccctctatgagagtcctgtggggagcgggggagctcagtcacttctcaccagaattggcagcagccttagccatatgtggcatcaaaagtcccctccataggaataaaagggtgaggaaaacagaatgaaaagaccaggcagattgaggcccatcaccagaagggcaatcctgtgagagcgctgccagttaccatgctccaaaatcagcatgagaggcaagagtggagaggctttaaagaacaaaaaagcctgctacctggtgcgctgaaggcctcactgatggtttcataaagcttttcagtacaaaccctgaaatttcagagacattcgtgagaaagaatcaagtcctaggctgtgttcgcctggatggtggtcttacggcaaagctccagttgggaaaatacagttcaccatcagtacagctgaattgattatcttttcagcagaaatgagtctccaaaaaggtagctgaagttgaggagtagacagctgtcctcagcaagcccctggcagtcacctggaacacttctcattccagccaagctgtccttcaacagggagtggcagggatagttcccctttgtgtccccataggcgcctcggctccttgctgtcacccagctcatttattctttcttaaaaataaatcgccacccactgtgtagtttccaaatgaggtcctaaaatttttatttatgaaagtattcttctttatctcccagttagctcaactggtgattgacctgaataaccaaatgcagcggaaggacagggagatgcagatgaatgaagcaaagtgagtagagaccccgcctccttggagcctggtcattgggtcccatgtcctttgttctgctgacctcttgtgagcagggccagtggcagtgagtggccacagtgcacttagcgagagtttgattttcagtgcatacacactctgggatccttttctaccagctctgagaaggaaaaagcaaggacagtgcccacaggcttctagcatcctcctagggatgtcaccttggctcttgcaagtggcccagagacactagcagctctcctgtggccgctgtgtgtgggagctggtatgttcctgtggtggaggtggtagggccaggatagctgagcgcatggcccttgggaaaagggaaatgagtttgtgagcaaaactgttgctgaccagggagaagcctggcagacaagataaatggggactctgaatcctgagaccttggagctggggtagcgtgtgcttgggtttccttaatatgtggaaaggggtctagaggcttggaaaggcagggcgcttgctcaggcttttgctcaggaaatgtcagagctggtgaaatatatacggtttccagcctccttttaaatcccctttaccaatctaagcatcgaaagtttctcttccttcacatcgtgtttttcctagtcattaataggatgaatttcaccttaggtgtttcctctcctaatggattatcctgtaaaccatggggatgggcctggctaaaagatgttgtaacagacacaaagtgttaagcactcagccaggtccgtctggctctggcacagggctctggcgaggtactattcgtcctctgatgtcatgcttccagaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggtgggctatcaatccacagttagtggtttccatccttagtagagtagaacctaggtctttgaaaagaaagagataaacctggcagttactacaggaggtttaccagggaattctttcagtgtttcaaggagaaaagctaattctgaacaatataaattaaaccagagttagaaaaaggaaatacaccacaattagaattcttccccataattttgtgaagctttttgtatccatataaaaattctgatcttgctaatgcacaagaagactataatccaaccttatatgaatatagatgtgaaattcctaaatcagactcattgatagatttttatttattttttgagacagagtctcgctctgttgcccaggctggagtgcagtggcatgatgttggctcactgcaacctccacctcccggggtcaagtgattctcctgcctcagcctcctaagtagctgggattacaggcatacaccaccacgcctggctaatttttgtatttttagtagaggtggagtttcaccatgttggccaggctgatctcaaactcctgacctcaggatccacccgcctcggcctcccaaagtgctgggattagaggtgtgagccccaccgcctggccattgatagattttttaagaattccctgcaatcctgctaagtctatttatttaagataaatctgaaacctactgagacatgggaattaaaagatggattatcaagaaatcaattacgttaggaatttgaatctctgttgtggaaaatgtgcgtgtttaaaagctgccccagagagcccagtcatcccctggtcaaggtccactgatcaaccgtctatatacactcttactaaaacctgcaagagaacaaggagaggttcactctcacaactcacagagaacaccgatctggatgttctggccaaccaaccattgaaaagaaggagtgatcacccacctagaaacctaagaaaatgagctgaaaagctgttaacacaagttcagcagatgccaggtgcagtaagtagctcatgcctgtaatcccagcactttgggaggcggaggcggaggcggaggcggaggcgggaggatcgcttgaaaccaggagtttcaagagcagcctgagcaacatagtgagactccatctgtacaaaaaacaaaaacaaaagctgagcatggtggtatgtgcttgtggcctcagctactcaggaggctgctgcgggagagttgcttgagcccagtaggttaaagcaacagtgagccaaagttgtgccactgcattccagcctgagtgacagagcgagaccccatccagaaacaaacaaaaaagctctacagattagaacatacatatttttaaatccccatatcagtagtttcgagtttgaagagattattccagttaatttaaaagtgaataaatgacaataggaaagagtcttttaaagggaataaatgacgataggaaagagtcttttaaagggtgatgatggaaaaacaagttagcatatcaaagagataatctgcactaccatcatgtttgtggcagcaccattcacaatagccaagatacggatcaatctacatattcatcattggcttaatggataaagaaaatgtgctgtacacacacacaatggaatattattcgctataaaaatgaattaaatcatgttatttacaaccacttggatggaactggaggacagtatattaagtgaaataagccaggcacaggaaggcagatactgcgtgcttctacatgtggggctaaaagaaaaatgttctcctagagatacagagtataactgtggttactagagcatgggaagagtagtggggaaggaggttaaagagagattacttaatggatacaaaaatactgtaaatggatataaaaatactgttagaaggtgtaagattggcctggtgtggtggcgcacactgtaatcctagcactttgggaggccaaggaaggtgaatcacttgaggttaggaattcgagaccagcctggccaacatggtgaaaccccgtctctaataaaaatacgaaaattagccgggtgtggtagcggatgcctgtaatcccagctactcaggaggctgaggcaggagaatcgcttgaacccgggaggtggaagttgcagtgagccaatatcatgccactaggctctagcctgggcagcagagcaagactctgcctcaaaagcaaaacgaaaagaatacttagtgctgtggaaaatgcctaaaattaatataaccgaaaataggacacaaaatgttttcatacagatgatcccaattttgtatacttttttaaaaaaatgactggaaggaattatatgtactgttactggtgtttatttttgggggtggtgagattatggtttttgatttctcattttatacttacctgtattttctaattttccggtttctattaagaaaaaataagctgtcctttttgtattgtttctgtctcacatttactttaagcagaattgtttggcttatgccatggagcttgacagcagtgtgagggtgttgggggccccaggtgagctggatgctgctaggttgcatgttcacgtcagctgagaggctgctggagggagaagttggggagatgtgtggtgatgccaaggaagagcccctgagcagtgcagtggacggggggtaatgcacatttcctagtgaaaatgctgtcctcattccctagcccaccctttgaagcatcttcctagggctgtgcacttggaggtatcatgtgattgcagatgtgggacctgaggagtcttcattactttgcttaggtagcctctcctcctagaagccttcctgcgtcattacccacttcctgcctccccagcttagatgtccctcatcttcctgcttcaggcagctgtggtttacctgggccatatgtagcacactgttttgagatagctcttcacactctgcctccttcccttatgctgccacgtgtccctgtggtcaggcacagtggctgcttcataagatgcactcagggctgggcacggtggctgctgcctgtaatcccagcactttgggaggccaaggcaggtggatcacctgaggtcaggagttcaagatcagcctggccaacatggcaaaaccctgtctctactactaaaaacacaaaaattagctggatgtagtggcaggtggctgtaatcccggctactcaggaggctgagacaggagaatcgcttgaacacaggaagcggagattgcagtgagccgagatgatgtcactgccctccagcctgggtgacagagagagactctgtttgagctattaaagacctttcctttcagctatagtgatgaatccctgataacaggtggtgttttcctctccctgtgaccctaagtcaagtttttatctccaccttgcagaactgggacctgaagttatagaaagtagatttcagacagtcaacaagtgctttaatcatagagtagtggtactcacacaccttataccgagattctggtttttcctcaaagagagttagttcacagttgtctctaccagctaagacaatttggataaattgtatttttggtaatttgccctgtaaaacttatttttcatcttccaggtataaaatcaagagtgtaatgcactttttaagctatacccacatcccttcccaagattctgctatactgcctagaggactttccttcattttgagaattaccaccgtggtaaaaacttacgagaaatttcagcagaattcttgattgcagctcagtagcattgctagagttctacattaggggtcctccacctagcaggcatagccatagttagaagtgaaatttatcaaagaagagagagtaaggtcagggttaggagttagggagtttctgaatttaggacttgaatgagagacaaaaatgattctgagaaggggagttagtggatgagactttgaccatgttaaaaatttgtcacagccaagacttctatgtcaagctttagtaaattaaagttactaatgttatgtaaactttgacatttcaagaatctcactatacctcagtttcctcatttataaatggcaataatgatatttacctcaaaaggttgttataaggcttaaatgagttaaagtctgtaaagtaattaacaatgtcaggtaaggggaagtcctaagtaaatcttcactgttagtaatcaggctgtgggtgtgttaatgcaggttgagcatcccatatcccaaactccacaatgctccagaatctgaaacttcttgagtgccaacatgacactcaaaggaagtactcattggagcacttcagatttccgatttaccattaatttcaactgaatttcatatttagacctggatcctgtcctcaagatttatatcatgtttatgcaaaacttcaaaatctgagaaaattcgaaatctgaaacactggtagtcccaaacatttcgagtaatggatgctcaacccgtgtaagactatttgctgcagaaaacttaagtcacaaccatgactaaccctcagtgagcctgaggcatgtgtctatcctaagatacccttggtcccagaaggcaggcctcctcctttgccagttcactgctttctctaataatgtggcctatctctcttctaggctttactctgaaaccctttaaaaggggagccttactgatgttatgagtttgggcttgtgacttttgagtattttgctcagggtagttgttattttacatgcactgaatgtgttattagaactggtggcttctagagagcccaaaccccgtgctttcttaagcagacataaatggtgggctttttttttttttttcccaacaggaggcggcaagcccggctgcagaaagagcttgcagaagcagcaaaggaacctctaccagtcgaacagtaagtaaagataaatgaatcaaaactgtgtttctgaaaatttggctctcttaaaagttttgtttttatttttttttttgtttggttttttttgagacagggtcttgctctgttgcccaggctggagtgcagtggtgtgatcatagcttctaatgtttttatttctgtaaaatcatcttacagattttagaaagaaaaatgttaaaggaagaaaatgaaaacatacagttcttccaccactcagaactaacatccatatatcattttaattgtattttgctggcttctaatttctcacaaatcatgtactgatacggcctttgaccctatttctgattacttacttgagatagattattgaaaataaaatttgatgggtcaaagcttttggaacatcaccaaataaccttccaaaaagtttgtgttcatcagctgtgaatgtgaattctaacttcctgcactcagtacccgttactgcctcactgtttcctgttgacactttgaacgatcagttttctgcctcttaattgtgcctgccatgtaatgcggtggggtttttgttgttgttgttttgtttgttttttccctccttgctccctttggtttgtaacttaaagtggaaacttaagcgaaaactaagatctcttggaacaaaaggaatcaaactagttctggagcttttcctaatctgcctacaagttaaggtggggtatcttctctgagatttgaagctttcatagtggtagaaaagagtttccttcgctctaggatgtttcttttctattgaaatgtgttttggaatatagttttagagttttgatccactattttttaaaatgttggttgcttccctgtaagtggaggggtttaaattcaactaggagtcattcaccaactaacgtcttaatttacaaagaaacaaaggttcccatatcatgcctttgctttagatatgtagggtacgtgtgtgtctgcactctcagatgtggaagattaatctcagttgtattttcccaagccacaaagtaaataaatagttgacctggaaatgagatttggtttcttcagaataacagcttataaaagtgtcatttgcataaccgggttgactgggataatttagacaggttgagcatcctgcccaagatcatacaggaaggggccgaggtaggatgcaaacacagggctgtaaaagcctgttattttattttgtattttattttattttgagatggagtttcactcttgtggcccaggctggagtgcaatggtgcaatctcagctcactgcaacctccgcctcccaggtttaagcgactctcctgcctcagcctcccaagtagctgggattacaggcatgcgccaccacgcccagctaattttgtatttttagtagagatggggtttctccatgttggtcaggctggtctcgaactcctgacttcaggtgatctgcccgccttggcctcccaaagtgctgaaattacaggcatgagccaccgagcccggcctaaggcctctccttaatctctatgcttccctaaggagtttctgggtcagaggacatacatctttgaaaggttttgataacttagcaaatgctagtgttttcttgtggtcccgggcctaagcacagttgcaagtacttaaaaccataaaattctattttcaacaggacattgtcaaaggctcagctcatatttgcagttcctgtctttgcagttctcctctcttccttgtatgggcacaggtgactctcgcaaacctagatccctgggaaagccaatcaagaaaataaagcacagccttgtcctttttctttcgacctgccttttattcccttctacatcctggccaagaatgtggtgcaataattacacatagtcctggaataaatagctaaggaaaataaatttactttgaccaggtttaacttgcttagtaacaggttcttaagtatatatttacctaatccagataattatttattgaaaaggaaaaatctttctgtcaagttcttatgaatccaaacagtaggtgatgaaatcttgggttattacatttaattatcttctccatgaaggttgcatctcagtaggaggtcattaagaccaaaataattacttgccctcctccaagtaggaaagacgtggcccagaaaaatgaggaagggggattccagaggtactttgcatccgctgggataaacagcaacaaagggagcatgtcctatgacttgattatgtcatttgaagtgtgatgggctctcctaatgtcagagacactatgtatttaagcataaaatgcgcagagtcaaaaatgcatagtgtttaaattttgcttttctattttttaaagtaatatttgaaactgggttaagttggctgttgatttcatggcccatttagccatcccttctttccctgaattctccctacactgttgttttatattccatagctgctgcccctaactaccctaggtacccctcagcccttgtgtcatgggaactgtgcttggtgagtactgcagcccttcaacagtgatgctgactgttgatggaatgccctactttggcactggttatgtggttatagactcaacagatcatattttattgcttcaagtgggaactgtgtttatacctaaaaggatcaaaagctcacttttaaatttattctcagttgaaattctggatttgatttgaacaggttaaatgtttattgtagtgttgttcagaacatggcagctcttcctttttctccaaagaatctttaacgcattgctgtcatagccaagtggtttaggatctaactagaaaatgacattagcatttgcggaaccgattaatcacagaactgttcaggagaatcaaagaatgtcttgcctttctttccagggatgatgacattgaggtcattgtggatgaaacttctgatcacacagaagagacctctcctgtgcgagccatcagcagagcagccacgtaagtaggcaggtttgggccagggaaaagacagcttgaggagcaatatgaaggcacatctgtggacatgacaaagaatgcagtcagatgcacccaaccccttaccccttttctgggacacccagcgtcgaacacaccacagaggtgtccagtctttctcagttcacctctgcttaatgggagggaagcagaacacgggtggcttcaaatgcttctaaatacaaaaaaatgtagtggcttactcaaatatggacagtgaaaccttattaagcagaatgattgtttaggtttgatcatcctgtttcattcttactagggcttccccccgcccgcaccgcccttcaagagtggggattggttactaacagtcagaaattgtgaagttagttagccaggaattgtgaggttagttgtctaatgctttatttccagggaaattaatttaatactagggaaccttgtttcttttgaaacttctaggctgggttttccctttcccttcccactgttttctggcagtttggtactgtgttgggtttctcttggctggggtttgggaactaagtgggaaacatattcccagttacctgtttttgtgggctgtttattgattgattatttgggcaaaatgtttctaaggtttaaacctatcctcccctcctctttagtaagcgactctcgcagcctgctggaggccttctggattctatcactaatatctttgggtaggttagaagacctttcctttttaaatgtgtataagtatacctaagtatatgtacatgacttatttttattctttaaatgtacaccaggtgtcagtgatgcagagtatacatatgccttaatatcagcttttcatttagcttcttccttttttcctcaacttcctttcctcttaatctcgctgcgtgctgatctctggcctttccctttagtctgtccgagtctccccttttgggacatcattcttcttctgatgctgccaggtgaaactattatcctctcttagtccagcatgtgagtgtgggtccttaacaattatgccaatcaccgcttcactgccctcagtcatcagatgttcacgtgctaacgaggatgctttgcatgttcctaggaatgccgggagccctcagagcagggctgccaggttgaacactttgtacagtactcatgctcttgttgctttcttttggcatgcgttagactccacattgatcacaagtgatgaggttgattctaactaggcatagaaataaaatagttttgcaaaaaagaccaaagagctacctctgagctagctgttacattaagttgagaaagtttcccagcagcttattgactgggtaagcagttgttcaggattgcttttcattgttgggttttggagtccacaggttagtgtgcaggagagtaaggcatgtgctggctctctttctcatttgagtgagggtgcttttgatttttttgtgaattgttctgtagtttgaagaatctagaaggacaggctatcaacagaggcagtctgcttaagcaaggtcgtcttggagtcctttctaacaatttgatgagcagtaaacctctgcaatcctgtctaatatttgtctttatgttatttcttaggagacgctctgtctcttccttcccagtcccccaggacaatgtggatactcatcctggttctggtaaagaagtgagggtaccagctactgccttgtgtgtcttcgtaagtatgcttcagccccgaaccctaccacgcttgatatggtgacagagcctggcaattaaagggtcctttctaggcctgcagctaagcattccattgttttacttatatcaagcctttccaccttttggctctgtcagctgtgagaaattgatatattttgcttagtttcagaggacaaaatttgttacaaccatcctctgtaatggcagagctgactgagaaaggattgctagcatgagggatggggcaaaggaaaagtaattagggattgtgaaaaatgggagagggatttatataattattgtcaccaattggctccagtttagagtgagttgccagtcagtggtgtattatggaagttcagtaggacagctgttggtttcatgaattatatccctatctgtatgactcccagccattaggggtctatgactggaagcagtcctgggcagaagccacggtgatggataccagggctgtcacccggagttcagagctgggtcctagtactagcaggtagtttgcatcccagctggggtagttgagcagaaattgaaccagcctggggaaacattcagtacctggctcagaactgtcaaagcatgaggagggtaggaaacagagcacaaagaacagaacctggagagttggactgactccagtactggcctaataactggcagcgggtaagtgaaaggagccagctttcaaagcagggaagattttgccgtaaaaatgggatggaatttatatggtgggagctttgggttccaggtataaggagggacttagctagttacacagtggactggctgagtgatgaactgccttgactgttgtaaagagagttccgctttggaggaggagttgggatggggcgcatcaacgccccttcccagtcccactccactcctgtgattccatgatgcaccgggcacctgcagaggtcgatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatgatctcaagttttcaatctgagacctcctaaggagaaagaaaccataaaaaagaaaaggaaatttcatgggggtaaaaggtttggtcacctgtcatacttttcagcagtgggtcacaagagggaggcaaagtggaaaatgaagttaccaaagtgatgcctgttgcccagcctgttaatagtcactccctccgtgatacttcaagcattttatttttttttagtcccaagcaaatgtaaatatcacatattctcttccccaagtgaccttttagacaagtgattatctacttaacaatctcatattgatagtctatgttttctagtctttcttttccttctctattatagaaatttccaaacatacgcagtatctcttcccccccacacttatgctggagcaatttgaagccaattctaggcattatatttcatccaaaaatattttactgcccataatcttcttaagagagtatagtgaatttttcgattattcccttttcccattctagaatgggatgctgagtctcactctgttatccaggcgggagtacagtagcacaatctcagctcagtgcagtctcaaccttgggctgaagcaatcctcccacctcagcctcttgagtagctggaacaataggtatgcgctaccacacctggctaatttttgttttttagtttttaagagacgaggtttcgccacgttgcccaggctggtcttgaactcctgagctcatgcgatctgcccacctcggtctcccgaagtgctgggatcacagatgtgtgccactgcacccagccaggatgcttttttacttggttttctttcttatcctgaacataagtaccatcttttgccagtgtttatgccagtattagaaatttccctgtgaagaatataaattctcttaaaataacgactgtcatttttatctaaggcttatgcattaacaggcaccattctgggttgcaaaaacctttctggagctgagcaaactgagatttcagaaacttggcagaggtcacactgccagtacacactagtcccataatgtttccagaaagaactacatagaattccattataacacagattgatgtttttgccatctacttatattaggactcattgcgaaagctgtattatgagaggccatgtgctatacattatttaaatatgtagtatttaatattattagtaaattagtaattactagtagatcaataagtagtattaactcagtctggaccaaaattaattctaggtttacttttaaactattaagataaatataggccattattgttagaacagatgaaattaatgcaaggaccaactttaagcagtctacacagattttgagtactttttgagaaggttgcactgcactctaatgcaactgtaactagaagaataaaatgataatagaatcttagttgacctgggctaggagtccagtttagtttatgattggctccacctgtctttaaggatgagtgtttccccatgaattaggcatttggagtgttcgcgcatcttgagctcttgggatgagaatgactgggtttgacacagggtgcttgtcttgcaggatgcacatgatggggaagtcaacgctgtgcagttcagtccaggttcccggttactggccactggaggcatggaccgcagggttaagctttgggaagtatttggaggtgagagcctgctgcatgttctcagactgaaaacttgagatgatgcacccttgcactgcagaaagaagctgtgttgctggcatctggttgaccttgctttcaggcactgtgaattgttcattttctcaaaacatacattttatgtaagggatcgtttgaccaaagcatcatacatctcagttattctttacttccgagtggatgtttgctctcattttctaagtagtgatcagaaaatactgttaagttatggatatgtttatgttagtaaggtttctgtagtttttctcaagtatataccaatcagagcatcttgcaaaatagtaccgtttttatgaggaaaataagtcttatgatcatggattctacaattaaactatacattaagctgtggttgatgcatttaatgacaattgcaatagcctagggaaaaaatgactggagtcatgtctaagcttgaggaaacagaggcgtactacctagaaaagatgtatttaacagtgtatcagacgagggcccttagatcaagactcagtctctttggacttttaggatgctcagagatggatggcattaaaacagaaaatggaagttaatgaaaccatctcttagaagtctgaagccgggcatttcccagttttgacgttttcgagattcagttaaatatgcgtgtatttttactaaagtaaggccgaagaataaggcttaaggtttttaacgggaaccactttgccaagtgtctgtagctgcgacacacacattatccctgtcgagcaataaatagctccaaagtgattttgtctgttaattcccctgatcatcacaacagccctgtgtggttagaatggtagagattgcgccatttcacagataaagggaataaaactcagatactacgtgatttacatggctagtgaatgatttctgtggtgagggagtggtggaactaggactaatgcaggccagaagacctgaaattccatgctcttactgtagccttctctagcaactgaaaaatcttaggggtactgcttttaaggtttatcagagcaggagcaacttattagaataggttattagtaaagcacccctcctatctgccccggcctttgattttcaggaaagggactcagcagttagagcccattgaagcatactaaaatttactattttgcccagaaacatttagcttatgaatgataatggctgaagcaattagaaaacaataataaaaacaaatcataagaaattttcactttgtgaggctggggcaagaggattgcttgaggccaggagttcaagaccagcctgggcaacaaaatgagaccctgcctctacaaaaaaaatattaaaaagtagctgggtgtgttggcatgcacttgcagtcccagcttcctgggaagctgaagtgggaagatcaattgagcccaggagtgagaggctgctgtgagctctgatcgcatcactgcactccagcatgggcagcagagcaagaccctgtgtcttttaaaaaaggaaattttagggaatttgatttgcaaaatcaaagtaaacagtctgttttgagtatgccattgagatttaaataaaaataacactagaaatattttcgttttactccttggtcagtaaaaacacctataagaaaattagaggtaccaacctttaattctagtaacctttttgcggctgaaaagaaacgaacatcagttgaagttaatactgacataatctgtgccagcacataatttgtgttaataaaatcaagtttctacctaatctacagaaatagcagaatgtgtggcggcatttcttacagttttgtgtagggcctttcttctacaaacagctgtttcagtctacaagatttttcgtcttggcaaatatttatttactgaatcttggaagaggccaagttcaagagaccttttctgaaatagtttgggggtcctgttttttcatccttttagattatcagaagaatcacactttctacccagtgggaacatctgtttttgctcattttctccaaagcagaagttccactgggaattatacaaatgctgttgacatagcaccccccgcccccaaccccgtatcttgtagataattaagagttttaatacggtctttgttcttttgagatcaatctctcatattgaatagcattaattttttggtcacttcctacatttcggcactgtgttaagtgccaagcaaatagaccagtattttaagcataagccaaagagatatttcttagaatttgcagtaatatttttatctgtgaagatttcatctaaaggaaaatcttagcgaatattagcctttttcaacccttttgaaaatcttaagaaagctaggatccagaaaaagccattaaatatgctgtattttgcaagtgagttcagaggagaggttcatcaaccaggttaacagtctgtggcctgaatgtacatgacagcttcaaaccagtattcgtgtcaccttgatatctggctccaatcattatttttactacttagaagtactgaataagataaaaatgtgttgaaatgttttctgttctgtgttcctcttttacaaatatgattacaatggttccttaatttctagcttatctgtgtggatcatccttaagttacccttttaaaaggaatttaatcaaatcattgagatttttgctcttctcagtttgggattgcccgttactgaaatttccgtgtgggtggccaggctgtctggaagcagagtagataaagtggacagtggctctgttggtgagggagagctgtgtagagggatgggaggtgctggcacttagttcgcttgccaggatcttagattcatggagataaagtatgagggcaaattccagaaactccaaactagcttgactggtattctatatgagtagtcatttaaatgtaactaacacaatttcttttcacaccttaatgaaaattaccacaccatgggtccagaaattgactgccagtttctacaaaagtggtagttaagttggcacaaatgctgatcaacccaaatatttatgtatgtaagtttttaaaatgtactgagaaatagtggaactgaataaacccagtctctagtttgattgacatggtttataaattcctacactttgtttttctaaagagaatgaataactacatttcttaaagaacagaacacacatccaagatgctggggtcagtgtccacttagacttgcattcctcttagaaactagcagtatcttttatctctcatgttctctttgtcctgctattttgtttgattctgtaaaggtacaggatagctattgttttagcagtgtaattggcttccattgtatttcagtgccctgttttaatgtatttattggctttatttaacttcccatcatcctaattttttctttttatacagaaaaatgtgagttcaagggttccctatctggcagtaatgcaggaattacaagcattgaatttgatagtgctgtaagtattgaatagctatgattttaaaggtttttagaaataatttaagacattaggttcttgaaattataacataacttacccgatttctctgccattctctgtatcttaagccaaatccatgttaaagaaagatggaaatagattatagggttaattgctgtatcaactctgataaacccttgggttctgcttcatgcattaggcttgtgatgttactcagtactttgtataatttcacttaatagttgtattttgagtgtatagatgctgtactccaggggccagcgtggtctctaccctccgagattcgccatctaaatgagagtgatgggaaagcattaaactgcaaagcgttgtgctgagttatggctgagatgtgtgtggagtagaaaggaaatactgatgagagagtagctcattctggggcaagggttaggggccatagtaaggcatttaaagcagatctaaagataatcaaaggtcagaggcaaaaagccagggacggacaccacaggcagagggagcagaggaggttgggctgggcgagtgcaggagcttgggtggaggtgatgactgggtgaggccaaggtagcgtcctcatctaccaagagtccttatcttgattgtcatctctggggagccttgttcacattcctgggtgggctgagtgtctatgttcccagcatcttgtgcaaacctattctatggcacggtggtggtctatatctgtttcttttactaagctgagagctgactacctgaggacaagtgtctgggcgttaatcatctttgtacccccagcacctggcacagtgcctattaggttctaaataaccactccttgaatttaattggggaatgataaggaaataaggttggaaaatgagggtatgttgtattgaaaggtttagacttttgtaaagccatgtggagacttgagagatttttagaaatgggtatggtgttaagttgtggtggaactgtgacagtgctgaagactggcttggaggaagcaggtctgcagtggcccgtgcgttcagtgcttctgcagagatgcagaaggcccaggtgggggctgaggaaataggggagaaaggagaggaccaggctcgacacattgaagatgaacagttctcagagtgagagttgggagattaggcaaggagagagtcaagggtgcctctgaggtttctgacttgttaatatttgctgctagtgaaggttgccaagggaaaagtgagtagggaaggctgggttccatttggagcttgaggtgtctgcaatattctgatgaaattgagcaagctcagaaaaaaaaaggtctgaactcgaaggagactggcgagttgaagcacactcacgacagtagctggtattcaggctggttgtatagggtgaagcatctaaaccttcttgtacttgattattggggaatttatatcgtgtgaactgaattcctctgatttggctaaaaattggttttcctcttctttattcccacagggatcttacctcttagcagcttcaaatgattttgcaagccgaatctggactgtggatgattatcgattacgggtaagacccagttaagaaagttagtgcaatctccaaacttcatgtggtgttatcaaggcacaaactggcaggtgcttaattaggggactttgttttcccaaaaatcatgcttgattcaccctgcccttcctttcctccttggggaaatctgtgtttccactttatactctttgtccaaaactcagtttcaaaatatttgcaatgggaccctcacatttgcatgaaaaccttggaatactcttcataaggactaaatactttggtagatagcaattttggcttaatggcacagaacttagcaacagcatgtgaattgtgattcctgtgggctctaaaacctaattacctaaagtgggatatagaagtacaaatggatgtatcatagggataagacaattctgaaacaaaaactccaagctgagaaagaggggacaggtgtcagagcagggagaaatgattggatgttgaggaaagctgcatttgaaccaaaacttgccaagaattctcttggcatctgacagagagaccaaaacttggttgtatcatttttgattggggcagggggcggagggcgaagcatgtaacttaatttgcagacattttttttccccataagcctgaaggaatcatcacataagcttattaaatacaagctattgaaagatataatggaggatgaatttggcattagtaggcattttactaaaaaaaaaaaaaatttttttttaaaaagttaacacaagccgtttgtgtgtgtcaacccacaccaaaaacagaggaagtaatgttaagatgaattttttttctttttttttttcttttgagatggagttttgctcttgtgtggggtacagtagtgtgatctcagctcactgcaacctccgccttctgggttcaagcaattctcctgcctcagcctcctgagtagctaggattacaggcatggctaatttttatatttttagtagagatggggtttcaccatgttggccaggctggtcttgaacttctgacctcaagggatctgcccaccttggcctcccaaagtgctgggattacaggcgtgagccactgtgcccagcaagatacatttctttttttgttttttgaaggcagagtcttgctctgtcatccaggctagagtgcaatggcgcaatcttggctcactgcaaactctgcctcctgggttcaagcaattctcctgcctcagcctcccgagtagctgggattacaggcgcccgccaccacgcccagctaatttttgtatttttttttagtagagatggggtttcaccatcttggacaggctggtcttgaactgacctcatgatccacccacctcggcctcccaaagtgctgggattacaggcgtgagccaccgtgcccagcctaaatttcttttttcttttttttttttctgagatggagcctgttgcccaggctggagtgcaatgacgtgatctcggctcactgcaacctctgcctcccaggttcaagtgatctccttcctcagcctcccaagcagctgggattacatgcatcctccaccacgcccggctaatttttgtttcgttttttaaatttatttattattttgagatggagtcttgctctgtcgcccaggctagagtgcagtggcatgatctcggttcactgcaagctccacctgccaggttcacgccagtctcctgcctcagcctcctgagtaggtgggactacaggcacgtgccaccacacctggctaatttttttgtatttttaatggagatggggtttcaccatgttaaccaggacgttctcgatctcctgacctcgtgatccacctgcctcagcctcccaaagtgttgggattacaggcctgagccactgcgcctagcccaatttttgtatttttttagtagagacggggtttccccatgttggctaggctggtctcgaactcctgacctcaagtgatccgtctgcctcggcctcccaaagtgctgggattacaggcatgcaccaccacgcctggcccagatgaatttcttaaatctacaagggaggtggaggagctgtagtagaatggtatattaggtgggtttctggtgattttcttgagagggttgtatagattattagtattagatgctagccaatacctcaggggtggtcattcttaattcacaatttaaagaagatccaggtccgaacatgcaaaataacgagccctgacgatgacaaggacatgttgtgagagctgaggagcctatgttcttgtcttaatgacggactagggaagtgcactgctagagagcctgccatggggcacaccaattcagatgcttgaatagggtcatttgaagccctgtagttctgtactgtacacatggaaaagatggcctagccggtactcatggctacgttctaatccatcctgtggtatactgtgatttatctatccattgatcttttattctagactgagatacagtaaaactgaccaattattgaagaggggcctacagccttttttttatgatagtcccttagaggagaagaggaagaagttgagtcaaccagtagtgcaggatattttttaattggtaatagaggagtcctatacaggtgggcatcagcctttgggtcagaaataacaagaaggggacctagagcagggagctagactgacagatgaaggtcataacattgagctggcacacaggtctcactggggaaatgttctcagtatgctggagcagggcgcaggctgctgggctgctgcttctgatgatgccgtgctggggcaggagcctcctgtgctggactagttggcttttgagtttctggcctgctcataaccttgtcctgttacttggtaaatgtgtgaagattgggaggcctgtttcagcagattccctgcacccagagaagtctcccgaaaaccttaccaggttccagaaagtaaaataggctccttattctagggagtgctggcttttttttagaccccagttaacagatggtactggaggacaggaatccattcatctatgttgtgaaactcacagacatccatgccctgttcggtgtctcctttgctcttacgacaagggaatggtgttgggagagactggcaaacaagaagcagctggttgagtgcttgctttaacatcctttttgtaaatgcaccctagaaacaacctggcattgaaaggagtcctctgtgatgcctccgttaaaaatctaaagtcagtacaaaactgcctggctgcttggtaagatttgacttgagaaacttgcttgagaacccccctgcccacttctctcgtggtgtggtgaagtggccacagtgaggattggctatggctgctaggtgatggtttctgtttggaatgttcctctttgagttctgcattcttctggaatcggctgtctttggttggtgttatgttagctgcatgattaagttgttacctgaatgagcaattttgtgtttagaaataggggtcggcactcgttatctgccatgaggcacagagatagtctgtgcagagcccagtggagcagagaaatcttgaagcctccccactttgaggccccggccttgatgacatctaaacccgctgccccgctattgttaatccctgtttaaaagtagaagatgaaacctaaaagtgttgttaatcataaaaatgaatttcagaaacacctaacagatagaagaattttaaatctgatccatttcaaaggactctataaatgatagaggtgaatgaatgcctgtaggaggcccagctctataccattggaagcaccgagacagtgagtcagcctcaggcagctccagcttattctcactgagaataaggtgagcagaagcccaaacttttttttttttttttttttttgagacagtgtctcgctcagtcacccaggctggagtgcagtggcgtgatctctgctcgctgcaagctctgcctcctgggttcacaccattctcctgcctcagcctcccgagtagctgggactacaggcgcccgccaccacgtccagctaagtttttgtatttttagtagagacgagatttcaccgtgttagccaggatggtctcgatctcctgaccttgtgatccgctcacctcggcctcccaaagtgctgggattacaggcatgagccaccgcgcctggccaagcccaaacattgtaaagagcaaggtgacaatacgtacgaggagccaagaaacaaaacgtccctttcccttattccattagttcagcagtttcattcctggaaataagtcaagagaagaaagctgtgtgctcatagatgttcactgcaacagcatctgtgacagactcttaaagaaagggaggtgcaacaaggaagagatttgatcccattcatcttgctgagtccgtactaagatagcacaaggatgtttcctgttcacagatgttacagagacccagggtgttcaaatcagtggaaccccaaagcccatgaattttcagctatcacatgaaaaaatgcttacgctataagcttaaaagagtaatggataaatttttaggaagagtataattgtgtaaagattaacatgttcctgtgaagtatgtaaaaatgaatatacagatggtccccaatgtagggtattttcatcttacaatgtgtttgtcaagactggccccatcataagttgaggatcatctgtacttgccatatcccacttatgaacaatgtctttttctaccctgtgtttgtgaaatgtgattttactcttaacattaagaaagaaacagatagtgaatataaatacaaatttgaaattttgataaaatagttattcagaatttaatgtaaggccgggcacagtggttcatgcctgtaatcttagcactttgggaagccgaggcaggcggatcacttgaagtcaggaattcaagactagcctggccaacatggtaaaaccccgtctctactaaaaatacaaaaattagctggatgtggtggcacacgcctatagtcccagctactcaggaggctgaggcaggagaatcacttaaacctgggaggcggaggttgcagtgagctgagatcacgccactgcactccagcttgggtgacaagagtgaaactctgtctcaaaaaagaaaaaaagatagaatttaagaagtagcctacccaagttttgtctctgcccatgatttgtgcagagtggatgttttatattgaatggaatcattattcatggactgtatctagtgtaggctttgttactggagctttcttgatcttacggaaggatcagtgggaggttttcacacaaccgcagcacagccggcacccgactggcagcagttgtaagatgctgtcccagtttcagaggtttgaatgtgggataaggcagtctgagaactcatacaagcttccctcattgaagctgagaggggagtatatgtggtccgaagttttcgcttctgtgctaaagtggagttaaccccactgaaaatagaggaaggattggtttcaaaaatgttaacacaaaaaaaatctaaccctgaaccatgaggtctcatctttgggaactaaggtttggagtgcagtggcatgatctgggctccttgcagcctcgaccttctgggctcaagcagtcctctcacctcagcctcccctgtaacagctgagactataagtacccaccacacccagctaattcgaatttttttgtagagatgagggtctcactaatttccccaggctggtctcaaactcctgggctcaagcaatcctcccaccttggcttcccaaagtgctaggattaccagtgtgagccactttgccaacccttgcattttctaattagaaagaaaacatcagtgaataccttctgaacctctggtgttttacacatagaaaaatgttgatcatgcactgcatagaggtcaatgatgaatggtaaaaggtctgagtcctcagatcccctcccggcatcccagttatccccagctgcctctcctccatcgcacttcagaagtgctgcgatgggcagaagggcagctgacactccgtgatgtccctcattctgtgttcctccgtgagctcagggaagacactggttggcatccaacagcttagtcacaaagggatttgattgttgggagtgctggtatctgtggctatgatctgccttgttcaagctgagacctctgattgaaaatcccccaggggttttaattgtttacataaggagtcctgatgtttccttttgtaaattatgcctgtggtgaccttgtctagtctgactttaaatatggaactgactttcagcagcatggcgcaacatcgaggctttaaaaattctttaatttgatataattcagacatagaaaaattacaaaaacagtacagcaggtatctgtggtagagctgatttcaaattcaagattgaggatggggagcacgtgaagcttggtgctagtgatgttgaatttttgtttttaatgttatttttagtgggagttttatccttttggtcttgatacctcacctttggccaacactcaaagataggcttcctatgagatacatggcccctggataagactcagtgaatgaaattgttgcttcttgtcctgtttgggatgtgtgtgtgtgtgtgtgtgtgtgtgtgtgtgacaggatcttgctatcactcaggtggagtacaatggcactatcatagttcactgcaacctcaacctcccaggctcaagcaatcctcttgcctcagcttcccaagtagctgggaccccaggcgcatgccaccactccctgcaaatttttaaaaaaatttttttgtagagatgggggtttcactgtgttgcccaagctgttcttgaactcctgggctcaagcagtcctcacaccttggcctcccagtgtgctgggattgcaggcgtgagtcactgtgcctgacctgtttctttttcctttgctgtcttatcgctttgagtgttcctggccggatctcagggtggtctgacactctgactctggaggtaaggatgctgtggatactttgccagcataggcagggcctggcgccctgaggctcaccctggctgtgttctctctcctagcacacactcacgggacacagtgggaaagtgctgtctgctaagttcctgctggacaatgcgcggattgtctcaggaagtcacgaccggactctcaaactctgggatctacgcagcaaagtctgtgaggaaattcagtctctctgtctgtgtatatgcttagatgttagcgtggaggtgtgtgtttgcacgtcagagcctgcatttatgtaatatagtttgaatttcagatctggcttcatgtttagaggggcactgaggatagtgatagtttttcttgtttaaagcttcatttaagtgagtaactctgacaagtcagtggttagagggtggcagcattatgtaaacagccacgttggtgcctctgcttgattaatgatgtttgcatttctttcaggcataaagacagtgtttgcaggatccagttgcaatgatattgtctgcacagagcaatgtgtaatgagtggacattttgacaagaaaattcgtttctgggacattcggtatgatacccaagctcctgactggaggcacataagagtctccacagtaatggttctgtacatgggttgtgcttttaagatctcaggacatggcagaaatgagtttcggtacacgtatagtgttagcttattaacacttggctgttctttcccatgaagtagactgtggagcttagcaatcatttattgagcatgcagtgagtgctaggcccttcaccagctggcaggtaagaaaaggcaaacaggatactctttctacctttaggtaatttaaactgtagtagggaaggcagaacgcaaaagtcagtgactagtgtgttgaagtggaggcagctacgtttgttccagtgtgttaaagaatgcctctccagatttctccggagacgtgagtaggattcacacggcaggaaagccactcaaacttttgagtgtgtgtctggtggctgatacatggcaagtgagcaggaaacagggcagaagccagtgagggggctatgaggggttgaaatcaggttgccacaggcttgataagccattgtcaaatcactcgatcttgtaagtcgttgggtgtttagcaaggaaatggttgctttgcaggagtctagtagacgactttggtggcattttgagagggcatattagggaataggaaaccaatagagttgataaggacctaagttcaagtcagtagaggaacatgtggaggagagaatctatttgaaggagaatttggacagggcttattgacaggttggaggaaggggaagacaggatggagagtaaatgaggacagcctcccagcagggttgtagagagggtgggggtacagggcctgtggtgatagatgatgctttgaaacacagcatggcaccagaaagtcctgacaatgctcatggttcctggacaccacttcacattttattcataatctttagtttgcttttaaaacctgaaattggaacttgaaagatggaatttgagagttaagttggatgttcgaagtctcttagtccatcccataatttgacaggtgaagaccctgagtcccaaggaagtggagtagcttgcttcaagctgcatatttagcaacaataagataaattcttgcttagttaaggtgggaggtaggaaaaggtttcattgaaagcctacaacaaaatcatcacagaacaggtcagcaccccctttggctatgaatgtcaccaacagggccctgcccagggtggctgttagccaccctggacatgggccacagcacagagaagaagagggaggtgcgtagggccgtggctctgccctggctttcctggccccatatctggaggtggagggccacagagccacagtgaatagggcagaaaacctgcaagaggctagagttacacttacaaggcagcccaggcccactaatgcaggtttctttgccaactttatccaaaagttgaaatcacatcactgaaaataatacgaattgggtagtagccctagttagctcatgctgatcagaaaccgatgggcgattgttgtcattccaaaaatggatgaggaaattcttaccaacttcagagttctagtctgggaatgactgtcttagggtctgttgatgggaaagtaagaaaagcagtcacaggttattagaagactgggaacacattgactgcgctggcagagcgttgcatgctagttgaattgcagtgccttttttttcctccacggcatgatgtgaagtagttctggcctacgttacatttctcagatctgttctccctcttagatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcaggtaactgaagatgtgctggttgcatgaagaccagaggcccagccctgctctcttaacgtgctgcgtggcctgagctccctcagtgacagtgccctgttgtttgtttcagtgcacctgggttcaagtgcggctctgactggaccagagttgtcttcaggttagtagtgacccaccccccgccaatttggttcatcacaaagagtcctgcatgggcattttcccactggggatatagagctaaattttgttcagtgcccaacctatgtttccaggagtgtgcctgtaagttcataattgcaggccaccattattgtctcttcctttccagtgttccttttgtgattacatgaacctaacgtgttgtaccaaaaaataacagttggctggttgctttgttgtgggtgagcccattaggttcacttctcatcactcattcacgcaagagctgttggagagcctttagaaaagggcaggagtggccgtgggcctggggcgggactgaaaaggctttttggagaagggtgtgcaggtggtctgcagttttctgctccttgttcccttcttccatgtatcctgcttcttccaaatacctttccaggctcagttgctaagatgtttcttttcttccctcctctctttgaggcatgtaacaaggcagtccatgggctgaaacccttagctatgtggaggttggctttgatctccctatatgttgttttgttgaagtctgtagatggttaaggacttggagccccaagaagcaatgtgatgccactgttcattagccggacggggctgaaatactggggaaaagcagatttggctggaagggccatgactagcacacattctgaggtctgggtacacaggagtggtcatcagtgaagaacaaacattccttcttgggaaaaaggccacagagatgctgaattgggggtggggaattgacaacctttcttttcttactgtcttctgtagccctgatggcagttacgtggcggcaggctctgctgagggctctctgtatatctggagtgtgctcacagggaaagtggaaaaggttctttcaaagcagcacaggtaagatgaaccctgtctcagccccccgttgcgttgtgagcaaggcctttgacttcatctcaggggtcatccggtttagacctcagtcggcgctgtgagggcactgtccgcccacctgctcggctggctgagctaggtcagtggagagaagctggggccactcacacagcacagcaggccacagtctacagagtacgccaggtagagcggttagagtggcagccgctggagaaagggttatagaaacacatccctgactctttggttatgtccacgtcctctgtgtctccttccccttccctactctccttcctttccgcctccctgtctcccttggaagtccctgttgtcagtgcatttcagtgcattgacgtgtcctaaacactgatctccacacaccttcttttatcttccacctgataggcaggccccagacccccttttttcctagctttgttctgcccacacaagcccacctgctagttggaacccagataccattttccttcagaacctctctccctgtccttgggcagcagcaactgctcccagacctaaccagtgctgaccaccactgcccggctcttcagaggcatgtgtactgtctttccagctcactcagagctcctctcttagggagagtgtgataaggcctgactgccagaggggccaaactcccttcatcccagcatgacttaattaagtacaccactggattttttctgaggtcttttgcatgttagtgagctcctgccttgtcgcgggcacagtgccagagagtaaaatggaagttggaaaaattaggactccctgaatgcacaagcttctggtgtttggtttaccaagatctcatcccaaatgttctgaaacttggtgcttttctgatctctcctttgaagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 2330 - DNA, 44104 bp, Homo sapiens; identical to SEQ ID NO: 2329
  source 1..44104: mol_type = genomic DNA

SEQ ID NO: 2331 - DNA, 44104 bp, Homo sapiens; identical to SEQ ID NO: 2329
  source 1..44104: mol_type = genomic DNA

SEQ ID NO: 2332 - DNA, 44104 bp, Homo sapiens; identical to SEQ ID NO: 2329
  source 1..44104: mol_type = genomic DNA

SEQ ID NO: 2333 - DNA, 44104 bp, Homo sapiens; identical to SEQ ID NO: 2329
  source 1..44104: mol_type = genomic DNA

SEQ ID NO: 2334 - DNA, 141344 bp, Homo sapiens
  source 1..141344: mol_type = genomic DNA
ttatttaattttttaataaaccataaaatttaaatattcaaatgaaaagaaacaaaaatagattatttaagccagcatgaatttctggttttactcttcctctagggcattgtaggcttgacttacctgggattagagtaataaagctatgatgctggtacaataatgaatgaggaagtaaaaatgggcaatgtcttcataaaatttactttcaaatctagatcagaagttcactcaagcctactgcaaaggcctgacactggttttgtctgtataaaactactctggctttttaccacactttcttcatcacagcttagtgttccctgcattctgatccttttgctcactaaagctcacttcaatctgtcaaaacatcaagggggaaaatccccaaaatgaaccgacgaataaacactcttaatgtgaacaatcatattcagaccagcctcttgtgcaaaaatacaagtcagtggattttttatccttacataactcaaatattgctatttttttcctgcctttactaaaatggcactttcgtttacatcaaccaattattttctacttgcttctaagtttctgagattgtatgctgtactggctattctttttgattaagctttacaatttccattccagaatatctggtctttgaccaactttatctaattttgtgaagaaatgtgctattaatcagtgaaaatcgcaaaaggaaaaagaaaaggaagcaatgaacaatagtagaatctcacttcagcatttgtataattttttataagaaaaacattcatttttattatgggatctaaaaccatgatcgtgtctgatactgtaagccttttagcgtactcaaatgggtcaacattcaatatggacagccagctagctcacaagaaatgaaatgtaatgcacaaatatgtttgactggtaaaatcccagaggcttggtaataaagtgcagcaaactttccttatattgaataagaactccagtaacctctggatatttttggtaaaaattaaagaaaaggtactgcagtcaagagacaggtaatctttaaacttcaaaagactggctgccagggaccacagtgaaaaattagacctggagccaatgaaaaacactagcttggaaggaatgggtttttccaaaaatgcaaaattagcatttacagatgcttaggatactatgatttgacaggcttacagtgataaaacaacaaagatgaacagttacaatatttatacgtgtagtgtgtaaagaacacaggttttttaattggcagcaagaaattctatgacagcttctgagacaagtaatcctatgccctatatccaccccatgccaatgacgaccagtcaaaatggtaacacagagtaaaaagtgatctactgtatgtgagtcagaaagtacttgaaaagtgacaaaactgtatgttattaaatgacaaaacatatttagaggctttatttaaaaatctctcactgttcattatcaaagttacaagattgcataccaatagacagactgtaaacataggaaattttcgttaaggaaagatgggtttactgtaattcaatcttttacaaaaaattacttgcaagttattgataacagaatttctcttttactttcttaattctcttgaaaattaaaccaatgtttccactttcatgagctaaagttcaaccatggtcaccttaggaaatacccctgtttatttgttaatcagaaatacaaatcgagtggcacatacttccattttcttcttaggccaaaggtttcagcttcattatattttacagaagaccttcagtggtccggtaagtctttcatgtcacagctgaggtttaatgatggcagtggaggaaagcagaggtgatgcaaagtaagaccagcccagttgccttatctgacatggaatctttttcctgtctggcttgcagcagcgaagtgtttctggtcaggttgcctccaccaaacctgattgaagcaaaagggtgacatgctctgataaatcccatttaaggatgattctgttcaggcaaatagttgatccttcaatctgttggctgtgggatgatactaatatgaagaaaattatccgggtagctcagatgttcactcagccactgcagaggtgtttccaacattggctcaattccatgaatcatcacttgattctttttttccccatctattccaagaaagaaacccaacaacaataaaagtcaaaacagttgaagaaaaaataatctggtgccttttgagaatccttagtgcattaaatggattttaaacatgttttgtcccctgaacaggaaatgtggacatggagaaagttcaaatgttgcagtatgtatcacccaaaacagaaacctgagggttacaatatattctgataaaaattctgttgctgtatgtgaaagtattacttctttcttaattactgtgcttacttaagattgacgttaatgaaactgtagtggcaaaaacagcccattgtaccaatgaccaaaatttattttagttatacattaaaaactgtaatatatggttattaaaaatgacaagtacatgaagtcggtccatacatattttgaaaatgtaaaatagaaatgtgactagaaatcaagaatcagatcagtatttgagatgtttagtaagacacaggtgagctttagttgttttcagtaaagcattcaagtatgtatcaaaatgtcttagagatactatttgaataacagttaaaattttaatgagaagggattacaaatctgactcagggattcctgttttagagtcataaagcctgactgatttttgttaacatccacttgctaattaaaagggggctgaaatttacacctttcttttaaattcaattgtattccaaattaaacttaagattttgtgtttttcatgattttggtgtgttgtactgacaacttttaaagtaaatataaagatttttgtcatagaaaaacaaagaaagcaaagccaaactcctctaatgaaaaagaaaaaaaaaatagaaccatcaagaaactttgtgttattcctttagcacaattctgggtttgtctcctttaccttctcttcaaaatacaatgtctaaacctctcagcttcctggtgacagaagacaacaaggaaacagggaatcaagcaactctataaaggagaaataccctacgttttcctttctgctctgttcaaaatgacttttgaatctgtaagtgctctaaggtctgggcaaaatgagctgatgatgtatggtgataatgacttggctggcacctgaaacaagagacccttttaaagaaatatttagacttcctgttagaggcagcacagtcccaggtgacagtcaacagaggacacaaaatactacagttgataaaagaatgtgaaaaataaaaactttaacatactaacaattccaaagataaccaaataaaacattccaaactcccaaatcactgtgccatagcttaaaacaattttgaaaaaaggtatcactttataatactactaacctaaaaaaatgctttattttttctttgttgcacctatacataatttgacacagttgtgaccatagtgttaatataatgatttgttttcataatgaaatattaagctatatacagaatactatagaaagcatagtaccagtactttgggaagattttttaaacattggtattgaaatggagaaaccctcagctatctggaatgattcattgcttataagttccagtttgctaaagctttactgtattaaatctttcttagaatatttgaaaacatttccggtataattctcttcatattcttatatttctttgaaatattttaatattctcagaatcttcctcctacttagcactgagtcaaaaaatgaaagaatagtggtgtaagagtaaaagttccttatctctaaagtttttccttaagccagtcacctttgtatactatgaaacagcagaagaaacaagtcacaactcaatatccaaagtactgtatctaaagcaatatttaaacatgggagcaaatacaatatggtaaacaatccactgatgatgcacagtgtatctgaaaggcaaaagaccaaccatgttacaaaaggattgctggagtttatgagttgtacaacagaagctggaggacaaaagcactattcaaacactgtgtaacaagcctaataaatccccttacccaaaccctgaataagtagcactgattctctggtttagaagctggggccacttttaatttttaacataaaagcatcactaactaaatttaagtaactaaggaaagaatctaagactgtcatatccctcaacagaacagtttaaggttttaaatatattattttgtcactgcctacatatgtccaaatatctcaccggcatttatgtattttgtttattttctgacttgcctcaataacacaattttaaacagagggattcttagaatagggcagcagaaacttcaaaccgaagtttctctcttatttgttactctgtccccagtgcctagcatggtacctgacatatacagtaattagataataaatattctcatagctggcataatattgttgctggtagaattatactgtcaaaattaatgtttttggaatgctttctgatagctagccctaccatggagaataactctacccgtaaagactgttttggttattaaaacaacaaagtaaaaaatgtttccagataagccaaatgtatatgctatccttaattcatggtaccataaataacaacaaagtatgaaggacattttagcaatatcaaaaccaataaaagaaaacaggccaggtgtggtggctcatgtctgtaatcccagcactttgggaggtcaaggtgggaggatcgcttgagcccaggaatttgagaccagcctgggcaacagaccccatctctacaaaaaataaaaaaactcaaccaaacaaagattagctttagctgggcgtggtggtgcatgcctgtagttccagctacttgggaggctgaggtgggaggattgcctgagcccaggaggtcaaggctacagtgagccgtgatggcaccactgcactacagcatgggtaacaagtgagaccctgtgtaaaaacaaaaaattaataataaaacagtaaaaaaaaaaaaaaatcagtagatgtctttttcttacagtacaaaggaaacacctgatactgttaaagtaaacaatatttttggtaaacatgtctttttgtttcaaaatgggaatctagaccttaatacttagaatgagaaatgtcactacaaagaaaatgactcaggagaaaaatgttactgtatgcctctcccactcaggtttttaaaaaaagctagcttgaagctttaagttaggcaaacatatgagaaaaatcaagtgaactagttctatatgaacttctttatatagggcactttttagagagtaatttttgttatgatttcaaacttacagtgtaccatttctaatataagatattcttttacataactacagtatagttatcacaataaaaaatactgatataccatgatatataaaataataaaatattcattgtagtccatattcaaatttatcaactatcccaataatgtatttttcttcaatctaggattcagtccaggactgtcttagtctgtctgtgatgctataattggataatttataaaggacaaacatttatttctcacagttctggaggctggaaaatccaagatcaaagtgctggcacctggtatgagcttcttgctgtgttctcatatggaagaacgtggaagtgtgagagacagtgaacccactcttgcaaatccttttcataccagcattaacccattcatgagggcagagccctcatgacttaaacaccccccaaaaagcctcacctcccaacactgctgcattggggattaagcttctaacatgtgaattctgggggatacattcaggtcatgtcaaggatgcacatattgcatttaatttttatgtctctctactctcttttaatctgcaaccgttttttagccttttctacatttcttaacctttacaattttgaagagtacatctcattattttgtataatgtccacaaagcacttttagaaaccagcatctacttaaaagtgaacataaaaaaaaagttacgttttaagaaaaacatattcaagtagattttggttatatgattagaatggtaagaattacatatagaaaaaaaataagaagaaaaaataaaaatcacattaaccacacaagtcattaatggaaatcacaaagttaaaataatggtaacttcttatgtatatattaaaaaatgatgcttacatatagacatagatacaatgactgttatcaatatacaataatataaatgagacataaaggagagagggccaattatgcaccactagttagcaaggtactaatgaaagacaaattgggggttaggcaacttgaattccagttctggcaacaaagggctctgagcaggtctcacgtcactttgaagctgtttctttatatataaaatgaagatgcctatatagatgtatggtttgaaaatctagctgaccattagaatcatgtgggaaattaaaagaatatatacatatatatgagctgagctcctctccagactttctgaatcaatttctggggtaaagtctttttttaaaaatgttccctagaatgaatcttatgatcataccagtgtagaatttttctacaaacaaaattttatgtagaaacccaatatacaacacaggtaaagatatggcagcttttgctaatgtgggattgagaccatctcctaagttctgcttgctgatttataacccatgatagcttctcatttaactctgtgggtcagtttgcaaactggtccagagtagaggatcactaacacgtctcccagttccagtatctgggtcttttacgtctaaacagcaaaatatttctttcagagtgtaaaccatcataatttattagttttgaattctcaagcaattcactcaaacttctgtttcctcatcttacagtgtgaacaaagaattctaatctccagttacatgaaggattaaatgggatatccaagcaaagtactcagcagcgaccctagcacaggacttggacacagggtactcaataacacgagtgactcttctccacccctctctcctgctcactctctaataaaaaataatggtgtcaaaaatgtaactgataaagtatgtgaggacagaagatcattttaaaaaggtcatgatttagtaacaaaaagtaaagagcgattgtaattctcttcctacacacgttataagaataagttcatttttttagtactagatatatcaaaagatatataaaaaccatggattcaattatgtgattggcatacaaagggctgtaagaatttggcctcatggtaatacctcctgaattattcagttccatttttatgcagtatggcatataattttaataaatgtattttttaaaagacaacaaaaacccagactcgatgattatgcaaattaaatgacattaagaaaaattcttaagtattagaaaccttcacgtttatttaatagtgctctcaacacatatattcaagtggagcacatcacctataagtcaaatgagccctagtgtactacagatatatcatttaatagactttaggtaaggttattttttttaaaaaagatgaaaacattcaggtaaaaaaaaaaaacctttcaaaatctttatgttatacattttaagtatatcatttgagaacttgcactgtgtgataaatttgagttctaaagatttctattactaatggctactaattacctttctcatcccaatctgggttttaggtcttattcaactaagccaatttcaacaaggaatatgatctataaatgtctttaaaaacaggtgacttgagattctagtgagatgcttgagtttccttcttactattaatatttaaaggaggcttaaagaaatggatgatgtatctttaagggaaattcatacatgtttttaacaagaaaatttcagtttaattaattttttaaaagctcatactttaaatatggagtagaagtctaagatcaaatgatataaccattgtgttcagctttgtagcttcatatttatattttataattcagcagaaaatgacttgatttgctatcttggaatgtgtaatactgaaggtaaaatttctgaaaaatacttaatactgcctagaagttttaaaaaatagagcgacgagctttctgattaccactagcctgaacaattttgttctgtctgacaaattctttaacctctgatatgttcattagtaaaacaccaactaattgaatccatcgacatgaaaaaccacaggctgaaatgtgaagtgcatacatcatgctgaaggattttgtctcagccacggaggtaatagtcagcgaggtcaggtcaaagagggttaaaccaagccaggatatagccaaagaaatacatcaaacgctgattttaaaagggcaattaatcttggacagaaatgcttcctggggaatgagatctcaatcttaagagcacactacatgatgtagcagtaaaaatgaacatatacaagcttacagggcttttatcctatgatcacaaacagaaggagagtgctgtttatcagaaaaatacaaacccatttaaaaatacttacattaacttcttccggatgcatactcacttagcagtacaggtcttaatgaacatgcaatatcatagtatataccaaataccagatataccacatatctctttccatgtatacattttatatctttattatattttcagagctttgactcttaacattttaaacaatttaaaaacatgtccatattaattctttcattgacttttgcttataatctctgtatttcttagtaaggaggacataaactaaaatttaaataatataaaaaatcccatatgatcagttgtaattataaaaagcaaagtgtattaaattaagtgattgtaaggccattttaaaactgattaaaagcttcctgacaataagataaaaatgtggtaaaagttaaaaattaaaccttgttcattaataaatacataaataaactttgaaaacaatattattttatctgctttcataaaatgacccagtaattctagttgggtgtaatagggtccattaatatttgtcaagtatgaactacagaatagctcaacttacttgctttatttaaaatatagacaataattgtactgtttacatatggtcagaatgaagccccatagtacctgtttcaatgaaaagataacttgtttttaactgtctgcatatactattattttggtaagagaattttgttttctagtgctaaagatgaaatagttgtgcaagtgtgtgtttctcattttgggaacagtcaggttaattcatttaacttcttgagattaagataacaataattcagaaggagaaaccagaagcatcttctgtcagtccagtaatgtcatcatttccagtagtggagaatgaaaataatcagcattattattgcccaaatcaaatagcgtgaaggtacagagatactagttccttctaattcaaattctaaatgaatatctaaagaattactgaaattgtaaaacccgcaatctgatgaggtttgggaattggagttttttttattcctgtggcatgagtttgcaaactgagtgcctattcttccgggggcagtgccatcacactgacaaatgtgattattgctcaaatattatctcaaatcacgagatactaacaagcttcaattttgtccaaatacttaaaagtatctgctttatacggtcagcatgagatttatatgtttctttttctaactgcttcatgtctgaaaaaaatttatcttgtcaactaattcactttattaacataatctaatcatatacagcaaaggagaaaaaaatgtgaatataccattttttcttttctttttctttttcttttttttttgagatggagtttcactcttggtgcccaggctagactgcaatggcgcattccaggtcactgcaacctctggctcctgggttcaaccaattctcctgcctcagcctcccaagtagctgggattacaggcatgcaccaccacgcctagctaattttgtacttttagtagagacggggtttcaccatgttggtcaggctggtctctaactcctgacctcaggtgatccacccgcctagcttaccacgttgttatacattacattagaagactgggaaatgaagtataattgggtaaagcttataggtgttttgtattctccaaggtaaaaataaatgttcttgatgtgttatttttaatgtacaaagaaaaaaatatttcactcaggtctggcacagaagcttagatctctgagtcattttaactacagctgaaacgacaaaaacaatttacctgagctcacctttggtcatttcctgttacctccaacttgactaattcccttagccatttacaaaaaaagaaaggaacacacaaaagagctcatcattagttactccacaagcagcagctcatcattagttactccacaagaacaatgacctaaagcacgtattcataaatactagtacatttgactttcatatgatgaaatcagacaaaattctttcatcactgaatcacttgtagggagtagaagacaatggtgccacataacttttatgaagtactttctcttttcatcatgtgatgacagcaagttcttatccatacacacccaatcttaaagtctttcgctttcaacttaagttgaatgcaggtgtgtcaaaatgcttcatgtttgacacatctgacaatactacaggtgaactgaaccaggcagtaaacagttttttactgaaacagtgactcgatgttttggatactctacatagatttttaaatgacaattttttttaatacgtaataaaaagaagaagcaaagataaaagtttttttctaaagaaaagatactgagatgtgttagagatgtggcttcctcctggtatgaaagataccatcaaaaatacctgaaaagaataggcattatctatgtcatttcaatgaagtgtgtgttctgcagtcaagagaagcatttgacagtttgcatggggagaagtctgtcacacagatgtactcacctacagcacctgaaatcacctaaaaggaaggtttgtggattaggttgtgtggctgcgctgcctcactgctcccctctaaaaaaaaaaaaaaaaaaaaaaaaccacaagggaagtcacactgtgtatcccctagaaaaggatgtacacgtagagcagcctagaaatttaacagaacaaagaatctcttttaaaagaacagcttcacaaatttgtgtgcctttcttgtgtagggtcacgttaatcttgtcttgtaacctgggtataagagcagaataaaggtgtattctgagagtgtcagttcaaagcacttgaatgcttttcatttacgtgtctgatgttcataatcaccatttaaaaaattcaacaagagtggtcaggattatatataggaacactaaaataacaaaacaaacaaaataaaaacagtagacactcaggttcctaagatcatatcagaaatattattaagagagaagagcatgtaggcagattagatactaaacacaaattgaagactaagatttgtgaaagtaaaataaagagtaaggaaaaagcaagtatttcagaatgttattttaaactaaaccaaaaagttaaaaagaaagaaaacaaaaacaaatggcagcatagtaaagtggaaaaaccaaaagaccaccaggagatggagacctgtgttctaaacctatttctgcaattaagtggttaagagacgtttggcacaatcatgcaaaaattaagagagtgaactttgggaggccaaggtgggtgaatcacttgaggccaggagttcaagaccagcctggccaacatggtgaaaccccgtctctaccaaatatacaaaaattagccaggcatggtggcacatgcctgtaatcccagctacttgcgtgaccgaagcacaagattgcttgaacctgggaggcaggggttgcagtgagctgagatggcatcactgcactccagcctgagcaacagagtgagaatcagtctcaaaaaaaaaaaaaagtagattgaaagttctacagttatacaattctttaaagaagtaaaatacagtattaacacccaactaatttcttcccactctaggcactccttaaccacacccacaaactagaaattggcaaccatgaaataaaaatgaattgaacaaatgaatccattaacaaaataaacaatataaaatttcaagtaagccctctttcctggattaaaaagcaactgttaactttagtttttacagataaaacacaaatgtatcaagggagaccccccacttatataaacttgggactagcaaatatggatcattttgtgtctgtgacaattgtgctgctgttaggggacagatcattacagaacacattacttccaaagttttgggtttcattgcagtgttctcattctatagtcaaggatgttataaaaaaggaagtttaaaacaacatattttaaaaagtagattgtcgaaaaaaatctaggaaaagtgcaataaggtagtcatttgaggctgggtgcagtagctcatgcctataatctcagtactttgtgaagctaaagtgggagtatcacttgagtgagaaatgtaagaccagcctgggcaacacagtgagaccctgccttttgttttcaaaaaaggtagttattcaaatattaaactctggcttaaatttcatttactcctaattgataaaatcatttgttatagtgtggttgcttgtccccgccaaacctcgtgttgaaattttatcaccaaagttggaaatggggcctaatgggaggtatttgggttggggtggggggggcgggggtggatccctcatgaatagattcatgccctccctgggtgtggaggagtgagttctcactgttttagttcccacaagagctggttattataaaaagcctggcaccaccctgctctctctggcttcctctctcaccatgtgaccaccgcacacaccaacttcccttcagcttccaccatgagcagaagcagcctgagggtctcatgagatgcccaatctccaggcagtagagctgtgagttaaataaaccttttttctttataaattacccaacctcaggtgtttctttatagcaacacaaacagactaacacagcatctagtttttaatgttctttaaagtactactacaaagtactcaaaaagggaaaaaaacacaatacagagaaatgagtaactgaaagccagtgctgccacggacaggtaagaggtttatggggtttatctctatcagcaataaaaacgattaacctcttcattacacttcaaatgaaaataactcatctatattccaaaatcctcaaaaacaaaaatagatattaaatagatcaaaaacaaacacccttataacagagaaaatgaactaaaaaagtaagcttattcttgaatttctgggaatttctcagaagttatgagttactaaggcaaaatttctgtagcctgagttcaaaaataaaaagtttacttaactatctctaaagatatacaggaaaatggcaacactggttgtctctagaaaggggaaccaggttagagtttggtgaacaggtagttaggaaagagactttttactaaattcctttatatatgctttgatttttaaaatatgtaaatgtattgcctataagaaaaaaagttttagttatttaactgaacacaatccattaaaaaaaacttgatagacaggaattcaccaaaattaaatgcttttatccttcaaaagaaaatgaagacaaggctgggcatggtagctcacacttgtaatgccagcactttgggaggctgaggcggatgaatcccctgtggtcaggagtttgagaccagtctggccaacacagtgaaaccctgtctctactaaaaacacaaatattagccaggcatggtggcaggcacctgtaatcccagctactagggaggctgagtcacgagaatcacttgaacccggaggtggaggttgcagttagccaagattgcaccactgcgctccaacctgggtgacagagcgagaccctgtctgggaaaaaaaaaagagagagagtgagaaagagagaaagaaaatgaaggcaagtcacagactaggagaaaatatctgcaaattgtgtatctgataaagaacttgtatccagaatatataaataatgctaaaaactgagtaataaggaaacaatccatgaaaaaaaacaaggatttgaatagacacttcatcaaagagatctacaaattataataagcacatgaaaacatgttcaataccattagccattagaaaaatgagaattaaaatcatcatgagataccactaggatggcaatacatgtgactgaggatgtggagaaactggaatccttatacaccgctggtgagactgtaaaatggtacagccactttgggaaagctcagtagtttcttttaaaataaaaaataaacttactatatgaccttgtcattccacccctaggaagctacccaagaaaaatgaaaacaaatgtccacagaaagacccatatttgaatgttcctagcagctctgtttataaaggtgaaaggctggaaacagtccaaacacccatcagctggtacagggagaaccaaaatgtgatgtatctacccaatggagtattattcaccaatcaaactatggacacttgcttcaatacggatgcaactcaaatacataatgttaagtggaaaaaaacagttgcacaagactatatgctgtatggttcaatttatgtgaaatataataggcaaattatagagacagaaaacagaccagtggttgtttatagctggcagtggagcagagattagctacaagtaagtacaaggagatggaaatgttctaaaaaccaaattgtggtgatggttgcacaactctataaatttactaaaaaatcattaaattataaaaaaattatttaactaaaactcttattgaaagctaaaattacacagtagtaaagatggattaggagtctaagatagtattataatcaacttaatgttaattgctccaagatttaatgatcgtaaataatatgtttcatggtaatgatagaaagaattcagtaactggattgtttggcaaacatttaccctagcactagagatacatggatgtgtgtaagacatcatcagaaaccttactataaaggctagtaaagttcaaggaagactttataaaatgtatttataacctcttaaatcctgttcagttttaataatttgggtagtcagtggtctcttccttcaatcctttctggcattggttctgacagtattattgtaggtgcccttccccttcctaatgaacctctgttcatttttaaagcattacatacatgtaggaatgctagtataagcaagcatacttgactaaggaaaattgcaatattctcaggctgaatgacacatattttgggctccatattctttgcttagtcatttaggctggaataccacaacattaccaccaaacccactgttcctaattctactacttaggcaaactatttccttagatgcaaaatgcttcatgaactgtgtggtatatgtcatgcaagtaatcctgcattcctccaattcagaatacattcgtaagaaacaagcattatctgttaaagtattaccttcatatatactaatgcattacctgtttccttcatggatttaaagttttttaaaaaaaatttctattatataataaatacaactctgcaatttttttttttttttgagacggagtctcactctgtcaccaaggctggagtgcagtggcatgatcttggctcactgcaagctccgccttgtgggttcacgtcattctcctacctcagcctcccaagtagctggaactacaggcgccccgccaccacgcccagctgattttttttgtgtgttttttagtagagacagggtttcaccatgttagccaggatggtctcgatctcctgacctcgtgatccacccgccttggcctcccaaagtgctaggattacgcgtgagccaccacacccgaccaactctatgcaatttttatgtcaatacagtaatatgccactgaaaatttcccctatagtttagtaagcattaatagggctgggattcaagagcagcaggacattttacacacacacacacacaatgtggtcacttggtattcatgaaggattggttcaaggatccctgaggataccaaaatccacccaggctcaagtcgcttatatagaatggcataatatttgcatataacctatgcacatgtgtgctttaaatcattcatctctagattacttgtaatatttaatgcaatgtaaatctatataaatacttatactgtattcttagggaataataacaagaaaaaaaagtctgtttatcttcagtacagacacaatcatccattttctttcccaaatgttttttatctgctgtgggcatgatggggagcccatggatatgaagggccaatgtgtatgtattatacacatatgtatatctcaagtattcaagtgtatatgtgtgtgtgtgtgtgtgtgtgtgtgtgtgtctcaacagtggtctctatcagttaatggattatgggcagttttattgttttctgcattttcttggtgttctttatgttgtaataaagaaaaacagaattcagaaattttaaaatttgtcccttgcttgcaggaaaacagccttaacctaagttacaaaattagcgccatgaaacaggtcaagtttttgaacgaacttgtagattgtcaaagcctaaaagaaaaaggttaactgaaaaagtagaaagtagtagaaaattcaaataaaatactcatccatttttcagtattatcaactttcaaatatcaaaaatgagaaaattatttttaccatttctgacttctttaaagttaataaacaaaatgcaagattaaaagtagtatttatcagaactgaatccataaattaaaaaccagagtaccagagatatactaagaggatgatttaaaaactgtattttatttcgccagtcgagtcatcattttgttagtcaataatttacaaaataatatattaaatattaggtgcttctgtttgaaaagacttttcgctgtaagatatgaaaatatcttcctgaaataacctgttgtttataaatgtggaatgcttattttacttcagtaacagaaaatgaaagaaatgttttaatgttgctgattgtattaccttcaggatcaatagcagaaggacaaacttctttgaggagatctcctagtgtgtgcaactgtccatctgcagccacaggacgaaacagcttctgaatgaaaggtctttcagtcgttgtctatttgaaaaaggaaaaaatgattcaagcaattaagtctttgttgctgccaattacaaatttatatatcataaactttatgttggcattaggtgccttttgatacggtgttagcataattacacaacatcacagatgtggtatcactgtgaaaaatgtttaacatgataaattcaggtaaatctaattctgaggaaacagacaaatccaaagttgggtgggacattctaaagataattggctgggacccttcaaaaacttaaagacattaaaaagcaaacaacacaaaaagatatcaacaaaagcattttttctcagtatctcttaaagagactaacaaagcaaatacaaaacataaaccatggctgaatactaaattgaagaaggacattttttagaaatccaactatgaaacacagttttgggataaatggggaaatacagaatggacaactgataatattattgagttaatgtcaaatttcttaggtacaataaggacaatccttatttttaagaaattcattgttcaagtgtttaggaaagaagtgccatgatatccaaaacttaatcttctttctctttttttggagacagagtctcgctctgccaccccggctggagtgcagtggcgcgatctcagctcactgcaacctctactttccaggttcaagtgattctcatggctcagcctcccaagtagctgggactacaggagtgcgccaccatgtccagctaactttttgtatttttactagagatggggtttcaccatgttgcccaggctggtctcaaactcctgagctcaggcaatctgccggcttcggcctcccagagtgttagggttacaggcgtgagccaaccgctcctggccccaaaacttaaccatctaatggttgagagagagacagagagagagagaaagagagagacagagaatgtgtgtgtgtgtgaagacaaagcaaaaataaaaaaatattaactaatggtgattctaggtagagggtgtatgattttagtagtttcattatttcaacttttcgataggtttcacaatttccaaaacagcagatccagccatttcatctgacaaaaactgttagcagcactacatcgtaatttattgctaataatctcattgttttactcttaaaattgtttcatttactaaatttccttagtgatgatggaggctttatcatgacagagtacagaggctctgaaatgagccagtgtctatgaagagcaccactgtttgcaagatctatgatcttgtacccagtttcctttatctgttaatttgggacattccatatctcttgagtttgttgtggaaataaatgagcaactttgccaaccacagagtaaataaataaatgttaaagagaataaaagcatttttacctcctctctccctcttaacggttatttcactttaagatggtaaattttaagctttctgagatgaaaaatcattaaaacttaacaagaacagagaaatgccatacatacatattttttgtttgcttgtttcctgagacaaggtttcactctgtcacccaggttgaattgcagtggtgcaacccccaagttgcaatcctccacctaagcctccagagtagctgggactacaggtgtgagccaccatgctcagctaatttttttacttttttgtagaagggggtctcactatgttgcccaggctgcctcatattttataagaatatgacttcaaacacttaggcattagcgacaaggttttgtttttgtcttttaatgacagaggtatacctcaacatatttgacacaactgttagagatttggtttaaaaagaaatagacatggatgaagctggaaactatcattctcagcaaactaacacaggaacagaaaaccaaacacctcatgttctcactcacaactgggagctgaacaacgagaacacatggacacaggcaggggaacatcacacaccaaggcctgtcggggagtagggggctaggggagggatagcattaggagaaatacctaacgtagatgaggggctgatgggtgcagcaaaccaccatggcacatgcatatctatgtaacaaacctgcacattctgcacatgtattccagaacttaaagtataatacaaaatgaaaaaataaataaaaataagtagaaaaaataaacatgtaagcatgtgagctgcctttcctaattctatgtttatgtattcactgaatacatagtattttaaaatagtaatccaataatatatttgagtgtttgtgacaagtatgaaaattgtaatttttaaaaaatcttgataatatgcattgaatatgatttaattcacttcactatttgaactctttagggattatttttaaaaatatgattgatatcctttgatatgttttggctctgtgtttccatccaaatctcatctcaaattgtaatccccacccgtctagggagggactgtaatccccatgtgtcgagggagggaggtgattgggtcataggggtggttttcctcatgttgttctcgtgatactgagtgaattctcatgagatctgatggttttaaaagtggcagtttttcctgcactctcatctctctttcctgctggcttgtgaaggtgcctgcttccctttctgccatgattttaagtttcctgaggcccccacaagccatacggaactgtgagtcaattaaaccttttgcctttataaattatccagtctcagatatttctttaaagcagagtgaaaacagactaatacattcttcaatttaaaaagccatactttctcatacaagttgaaaccaagaacaatatcatgcataatcaagtgattaactgtgtaaagataataaggttgaggagttcagagaagaaaagaaatgaatagggaactgtagtgataatttaaaatagccatccctcactcagggtttttgatcttcaggccatgaagaagcttttaatgctttttagcaaaggaagtaatgttggtgaaaggctttttctgacgactaatggaaagcagtgctatgtatggtgacttggttatgaaccaaaaccagaatgactggtgagaggctgactgaatacagcaagcttatgtgaagacaactggagctggtgcagtggaaaaggaagacagcaggactgtacccacaactcaaagaaaaaagtcagaaggtacctcccgcagtccaacctgaaaacaacaaagtcaaaggaatcttttcaagaatttggagctctcattcatatcctaattagtgtatgaaatgtgaggtggctttgctataatgaaattacctggaatatttctaacacaaagaaataataaatgcttgaggtggtgaatatcctcatttgatcattacacattgcatgcttatagcaaaagattacatgtaccccataaataattgcaactattatgtatccataataattaaaactaaaagattaaaaattacctgaaaaaaaatgctaaacaggaaaggccaactagtcttggttacatattaaaaaacagaaattcttctctaacctcactattggagaaatatcctgttatttttatatatcttttttttcaccctttcccaaatctgagcaagtattataaaggtataaccttcaacaatcttttatgatgaggtatttgcttactggggacaaagccccagtgctattacatagtgtagctaaacgctgtagaatggtaaaaacaagaaaatgctcagcaaagtgttgtttctcatttaatgaaaatcttattttaaaacacaaaaactcaatataccccaaccaaaaatctgatgaacattttctgtttaatatttattatacagtacctttaaaaacgtaatattcttattcttaaaaatttagtgtgctagcaaatagcaattaagtacctaagtcaatcaggacgacaaaaaaatactcaatttggggagttagttacttctatcatctgaatgcgtccctccaaaattcatgctgaaacctattcctcatcatggcagtattaagaggtgaagcctttgagaggtaattaggtcatgagggcagagtcctcaagaatgggatcaatgctcttataaaagaggccccagggagcttgtaaggcttttgccccttctgccatgttgggggggtgggggtgggggcgcagcaaccagtgctaactctgaagcagagagcagccctcaccagaaaccgaatctgttgaagccttgatctctgacttcccagcctccagaactgtgagaaataattttctgttgtttataaattacccagtctaggctgggcgtggtggatcacctgaggtcaggagttcaagaccagcctggccaatatggtgaaaccccatctctactaaaaatacagaaaattagctgggcatagttgtgggcgcctgtaatcccagctactcaggaggctgaggcaggagaatcacttgaacccagaaggcagaggttgcagtgaatcaagatcatgccattgaactccagcctgggcaacaagagggaaactgtctcaaaaaaaaaaaaaaaaagtacacactctaacatattttggtatagcagcccaaatggaatggactaagacaattacccttaaaataaaagctcccatagagagatcatgcattcaagtacagaggttcttaagggcaatgggaatggaggacatattcctgcaaacttttcaacagctctcattagcccgatgttagagctctgcaaagaagactaaattatactgagaaatatttttaaatctccacaaataggaatgctgtaaacgttgatttagtatatataaaattagacaagactaacaatatccaatgcaatctaaatcttaggttgacagacaagaaagccactgcaaacaggaatataccacaatacctgatcttgccacatatttgtaaatatgcaaagtatttcaataacttccaagaaacagtattactctcatgagaaataacatgatgtaagtcacctttgaaactgtccttgttactttttcaaatgtatgttagtcatttcttaacaccaaatgaaatgaaaaactgaggtggtaatggctggctgctcccatctctcctctactcatgtgccttcaccaatacagcaatcattttttcttatatgggaaatttacagtgttgatatagctcagagatatattgaagaaaagcagaaaaacgaaacttataaacattttaggaaaccttatgtattttcttaaatagttcaagtgtaaaacttagaattcttataaataatgtgtgttacagctatattgtaaatggtggctcatgcctgtaatcccagcacttcaggagaccgaggtgggaggagagcttgagcccatgagtttgagactcacccgggcaacacagagagacctcatctcttaaaaaaaaaagaaagaaagaaagaaatgaaatgcaaagaaaaagtctctatttcaaatgtagccagtagagccaataggttaaccaatattaacattaacgttgataaaacaagaaatgatgatttactataagctgaaaatcagacaatgtatggactttaagagtaacaggcacgatcatcacaaacttaaatcaggtttgagtcctatgagttatatacagttacatgatgcaacaaaagatgccagccagttgttaaagagtattagattcggctgggggtggtggctcatgcctgtaattccagcactttgggaggccgaggagggaggatcacgaggtcgggagtccgagaccagcctggccaatatagtgaaacctgatctctactaaaaatacaaaaactagtcaggcatggtggcacgtgcctgtaatcccagctactcgggaggctgaggcaggagaattgcttgaacccagggggcggaggttgcagtgagccgaaatcgcgccactgcactctagcctgggcaacagagcaagactctgtctcaaaaaagagtattagattcaagtcctgtttctgtcatttattatggaaccatggacacaactacctatctttcctgaacctcagttttttcaactgcaaaacaggaatatatacatatgtgtatatatacatctgtgtaaacacatatgtgtatatatacatctgtgtaaacacatatgtatatgtataaatggagataatacctacattatagtttctgagataataaaatgcacaacacaattctgacacataacaatttgtaacttaaaacataccatcaccagggccactagttttagaacactgtaatgcatagtctaatttaatactatgcaaactgtgttcactcaaggttttatttccttttaatttcattcatttactcttcagttgtttgtaagctaaaaagtccagaatcatgaaattcagaagtttacgttttaatgtttttctatatggcaaggaaaaaaaaaagggcaaagtcattttaacactactttcaaaatcagcctagaacttaacactaaaggcatgacccataaaagggaatactaataaatagacttaattaaaattaaacaacaacaacaacagctaagcttttgttctgcaaaagatcctgtgaagagaatgaaaacataagccgcaggctgggagaaaatatttgcaaaccatatttccgagaaaggtcttgtgtctataatatataagaactcccaaaattcaacagtttttaaaaaaagcaaataatccaattagaaaatgggcaaaagacatgaacagacattttaccaaagagaatatataggtggcaaataagcatatgaaaacatatctcacacatcattagccattaaagaaatgcaaattaaaaccacaatgtgatatcattacacacctaccaaaatatccaaaataaaaattagtggtaacaccaaatgctggtgcgcatgtggaaaaatagtccttcacacactgatggtacaaatgcaaaacagtacagtccctcaggaaaggagtatggcagtttcttacaaaactaaacatgcacttaccatatgaccaagtaattatactcttgaatattcccagaagtaaaaatgtcttctccaaaaaacttatacatgaacgttcatagctgttttattcgtgagagtcaaaaacagaaagcaatcccagggctacccattaaaacaggtgaatgcttataaactgactgtaataggtctgtcccacggaatactactcagcaataaaaaggaacaaactactggtatatgcaacaacttggatagatctcaagggagttatgttatgtgaaaaaagtcaatctcaaaaggttacacactgcatgactccactgatataacattagtgaaatgacaaaaattttagaaatggaaaacaaattagtagttgtcagaggttagggaagaaatgcagtaaggtaggtggctgtggctataaaagggtagcctaagagatccttctgttgaaacgggtatattttgaatatagggtgaatttacatatgtgataaagattgcatagaactaaatacacacacacagtatatgtaaaactaaggaaatctgagtaaggtttgtggattatattaatacaatttcctggttgtgatactgtactgtaattatgcaagatgttagaattgggggaaactagatgaagggtatgtagatctttctgtattatttcttacaattgcatgtgaatctgtaattatctcaaaataaaaatttttttcaaaatttcaaaacaactagtctagagctttgttaatcaaagttttctctgaggacctgtagcattttggttatcacctggatcttattaaaatgtagattctcaggctgcatattggaattcctgaattggaatccgcattttaacaagatttccaagtgattcatgtttaaagtttgagaagcactagtctacaacaatgacttttaacctttcaacctactctaacacacttgaaggccataacaaaattcacatcaataacagttgctcggttggacagtgactctcaacacaaatgagtgaggaaaggtggggactcaagactcaggtagcaggaaaagccccttaggtgatcctgatgaaatgttttctccatcctggctgaaaaacccagaacagtcaattaaggctcaaaacaaaagtaatgtttataatactggagatctttaaaaggcagataatatatactataacagagcaaaggtaattattacaatgtataaatcttataagaaccaaaatcagaattaaaatcactaagcacataatgaaaatcctttaaaaagtataaaaatgaatgtagtctaagtaaatactaataatggcagttatagtgagaaaagctctagagtcttttactcttcatacttcctagtcacaaacatctatttccaaaactgacccttcgtatttcaaataatttatggcctggtacagtaataagagcatgatatttaaagccagtcagaagacacatattctagctctggatggcacttgatgacgatggattcagcttatggttccaatcccagctctgtcaattagtacctatatgaccctagtcaaatacttaaaccttcttgtgttacttgtgtgtcaattgtatcatctataaaatgaggatattaacagtatatacctcatagatttttttgtgaaggttatacaattaattcatataaagtatttagaacaatgtctagcacagtgaattctcaatgagtgttataattgttctttttaaatgtgacttgactctcaacagaactctactgaattctaatatgtattctgtattgagctgtcaaaaaaaataaggattataataacatatactattcttgtagtcaaccctgttactatgttattactagtgtcagttttgttgttttggtcatacatattgttttacatacattaagaattattagaaatgttggtttattaaaaatgaccatttatggctagaagggtatatatctggctcactgactgtggagtcaatgtccataaagaggaggaagaatgccatcagagtaaaaggagattctattcactgaaacaaagtgataaaaagctatgaaagagaaaaacataaaataaccaaaggggtgaaacttaacagatgcccagtagatgcacaatgcactgggttgtaaaacttaaaatggccttaattaaaagccaagcacggatggaggtgctgggggagtctcctacggacacagcaggcagaatgtaacaatgacaaggggctcaagtttatttaaaaagagattggacaggccgggcgtggtggctcacgcctgtaatcccagcactttgggaggctgaggcgggtggatcatgaggtcgggagttcgaggccagcctggccaacatggcgaaacctcatctctactaaaaataaaaaaaattagccgggagtggtggcgtgcatctgtagtcccagctactcaggaggctgaggcaggagaatcacttgaacctgggaggcaaaggttgcagtgagctgagatcatgtcactgcactccagcctgggcaacagagtgagactgctcaggatctcccaaagacccaaatccctgtaaactgaatgcataatatcatttgctccagtgaggcttagatggacattctagtcttcttggttgagctgaagaaacaaatattatattgataatttatgtatgttgtatttttcaaggtatagcaacaagtttttattcatcagctactttgtgtgtgtgctttgtttttaagtcttttgaaacaggatggtgatttactacatttataagtaaaatttatttgatttacaagggttgcttaagtgtatcacaggatttcacttgttatatttgcaggtgcttaaaaaatcagctatactaaactataactggaattagcaaagttcatttattgattaatcaagaatataattagatttgcctaactatataagtagtactatgtgttatttaagaattaaatctagaaaagggatggactctggaaatatcaagaagtgaaaaagactgctctcatttttgtacaacaattactaaatttctaagtagcattaattgaactgaaaaggcattttagaaaaactagattttacaatttataactctaataaaacacaactaactatgagtgtgcttgttcatgcccaaaagctaccttccaaaattaaaaaccctattggatggctgggtgcagaggctcatgcctgtaattccagcactttgggaggccaaggcgggcggatcacctgaggtcaggagttcgagatcagcctggccaatatggtgaacccgtctctaacaaaaatacaaaaattagccgggcgctgtggcgggtgcttgtaatcccagctactcgggaggctgaggcaggagaatcacttgatcctgtgaggcggaggttgcagtgagctgacaccgtcccactgcactccagcctgggcgagagcccagagcgagactccgtatattaaacaaaacaaaacaaaactcaaaaaaccctattggcaattactagggccatcaaatcagtatattttcacttgacacacaattttgagataatgaaccgaacttactatttttgaaaatattacataataaatattagtgaagcttcattgctgaaatggtgacaaagatgaatagcaataaaacttttcttatagatctttagcaaaaacaaaaaaaccccaagcatactatggtacattactttagagaatcaagtagctgctagttgagtaatagtggtaataggcactacaatgatataaacaaattacaacaaagaatattgtttttatttcctgtccatgttttaaaaaagctttggttttacctatgtttaacaaaagcataggtacaacaacgactactactactaacatataagtagcctggatagaattatcttaatagtagtacccaagtgcaggatctctaagtaatgatcagaaggcaggaataaattttatcagaaatcttcattcattacatatttactatgcatttaccagggtatcactatgctaatggatacaaagataaataacatgcaaacaactgtaatacagtgttatgtgataacagaaatatgtacaaagcactatgaaaaaaattacaaagcttgagcacaaattttaactctggacttactggcatttagagcaaaaccaaaacaatcctaactggttaatttcattttctaagagttggaagctatatcagtaggtacaaagtaaaatatgctaattgtggtagaaagtaaaatattacaacagtagagaatttcaaaagaagataaaaataatggagggaatatagaaggtcttcaagcttccagcttgaaatacatatttttttttaaatagagaaagagataaagtcatttgagtattcagagggcagactgaatataatggtacttctgagaaatcagtggataaggagagaaaagtggactaaaggccatagcatatagagcttggaatgtcaaatgtagtggaaataacaaaggtttggttggaatcccaactcccaacaacgtactgtgtatctagagcaaattacatcaacctttgggagtactgtttctgaatctgaaaaatgaggaaaacttatctttgaacaattgatgtgataattaaatgagatatatgaaatatctaatgtaacaagtgcttaacaatgactagttcttttcattcctctcttgaaccattgtgaaacgtagaaccaagaaaggtaacagtatttagttgttacagaacccattaagagagaataaaaaataactggtattctaacttcagtttcctttgaagtcttgttaatgagaataaatattatgtggcacaaagaaaaagaaaacaggggtttacacaggatatgctgccagactttaccaacaatgacacatgatatctgcttcaactgtcccatgcatatttggcttaagatatattcatgcatatcaaattttacatcacatggttttcaaaagaagattcattaaaattagcttaagaatgtacacaatatacaatacctcattaaataaaaagaacagaccatttccaaatgaatgcttttagagctttacagtaaacagtcttttggtggtagaaagagggggaacagagaggggagtgggtgggagtctgtagcacttatcagactacttttatcctttatgtagagaaataggagagttgaaaataagcactttctgtacttatgttgagagtctgaagcccacttttaatagtcttgacaacactaaaaaataataattaacatttgaaaagctgtcattattatagtcagggacacttaatctccaaaggagaagtttcttaattgatactatgattaaataaaagcatccatcagaattatatccacaatctggtttggagtttatgttttgtcttatttaaattgttatacttattataattctgtctagacagtgccaaatgtactttgtcatacaaacacttgaggcaaattttcttcaaataagcgcaacactttgtttcctcttcgtatcctttgactgaataacgtgtggtacagagaagtaatacttccctttcttgggatcgagatcaatttgatgcttgttataagcccatttacagaacaaatggtattgcttttaaatttttatatgaacttatcagtagactagccaaaaaagaagcttcatataaaagtgctaggattgatattcttagtaataattaggtaaattctctaaaattttctcccaaaagatctgaaaaatcataccaagggaagtatagtttaaatttcattatatataatagctttaaaatatctttgctaattctacccaaagccacactaaaaagactaatacaaaaagaatgtaattaataaactattttcctctgaagaatcaaagggcacttctgcatatgaacatgttttatccttttggtgtacttacataaaataattaagaaacacttttaattagtataaacaaagaaatcaaaatagcaagaagaaatgtctgagtaaaagcagctgtgctgacctcaaaagtgaaattctgttctcttgatgcccagttaagtgtctaacccagggaaaagtgattctaaacctgggctaggagctagtggagctcttcaaacagtctcacctaccctcacccctcaaggaatggtctatgggttctgtggtgaacgctaaagtttataacatgggaatatttattattttgtttctaacacaaataatttttaaaaatttattctactaaagtaacatcaaagggaaatttcataaaaattcttttgaaatttttagaagtagcaaataaaggcaagtgataaatattttacagatttcaccacttacgtaatctgatcaacaaattttaaaaacatagcacttgaatactattaaaaatatattaaaaaggtaacatagtaaaactataaaattctttaaaaaaaatataagaggaaaccttcgtgaccttggattaggaaatggtttcttacatacggcaacctaaaaatacaagcaaccaaagaaaaaaacagacaaactggacttcatcaaagttaaaaacttttgttcttcaaatgacatcatcaagaaaataaatcccacagaatgggacaaaatatttgcaaaccatatctgataagagaccactattcagaatatgtaaagaatttgtaaaacttataaataaaaagttaaagaagtcaattttaaaatgagcaaaggatctgaagacaattctcctaagaaatacgaatggctagttaaatgcatgaaaagatgtttagcatcactggtcattaggaaagagcaaaaaccaaaatgatatactccttcatacccactaagactgctgtaattaaaactatagaaaataagcgttggcaaggatgtggacaaattggaaccctcctcatacactgatggtagaaatgtaaaatggtgcagatgctttggaaaacagtctgacaataccccaaaggtttaaacgtggaattaccatgcaacccagcaattctactcctaagtatctacccaagagaaatgaaaatatatgttcaccaaaacatttgtacataaatattaactgcagcttttattcataatagccaaaaagtggagacaatccacatgtctatcaattggtgaattgataaacaaaatgtggtatcttcatacaactattactgggccataaaaagaatgatgtattgatacatgctacaaaatgaatgaaccttaaaaacaatatgcaagcaaaagaaaccagacacaaaaggccatatattacatgatgctaattacataaaatgtccagaagggagaaataaattagtagttgccaagggctggagggagggggaatgatataagtgactgccaatgggcatggggtttctttttagggtgatgaaaatgttctgaaattttatcacgggaatggttgcacaactctgtgtaacttagaattcagtgactcctaaaaccaatgaatagcatgctttaaaaggtgacctttgctgagcatagtggctatagtcctagctacttgggaagctgaggcaagaggatcacttgagccaggagttccaggctgtactgcactatgatcatacctgtaaatagccaccatacacaccagcctgggcaacacagaccatgtctctaaataaataaacaaataaataaataaaagggtgacctctgtagtattgagattatacttcaagtaagctgttattaaaaaaaaaaaagttatcatatgggtggcaggggaaatcattctgggatgatggctaacttcatcagtatttgatttatacctatgcatcataccttatgtttgttttatgcattttgtgggttttttaaaaaaattatatttcataaaaacaaattttaaaaaaattaaagtcaagaaccccaaaacaacaaagatcagagatacatttctaccttatcaattcagaaaaattacaagtttttttcttaaaaattgtatagcatcatggtgattttaagttacctgtaggaatttaaataactttgtcttaactgttcaccaaaactcatttaatattcatgttctgatactgaaaatgaagctgaaaagttttgaaattacaatatgctagtttaaaaaggtttactaaaatacataatttcattataaggagtaatatgaaataaaagtatcaaatatgggaccattaaaaatgtccttactaacaaattgctacccacattgtggactcactgcgtccactgtttgcgagcttttccagaacgctcgccaccagttagggtagccaagaactcctcatcttcactttcttcctcactagcttggaacctctggattcccacccacactgctgtgacctgaatggggaagagaaacgccatagtaagggaactcttccttttatagatttctgaattagaatctggcattacaaaagaacaatgttataaatccaggtcagagtttatagttctatttcactattacttatatggcttgtcctaggaacttaactattatttacaatgtaagtacctatttccacaaaaaaattcaaaattttggaatacaatatctgaagagagaatggtctattgaatccaaagtaggctgatacatcccaacagtatttcagattgagataataataataccaccaattcatcaagtcaaattatatgcttattttccacaatggaagttttaaaatagtataaacattttaatatatagcaggcttaacttatgattattaaacagggttctaagaaaatagtatacatcaaatattaatgtgcttcttgtataatttaggtgacaatttatccatctgagaaatgcaaaagagactttggtaaggggttgagtaaggagcattctgtgtcaaagaattcactagcaaaagagggtatactgtagttacaagctataatcactgtacttattttaaatccctcttcagaaccaggtcttaaaagatgataaacatggcctcatgaataactatcaaccaaactatagaaaagagtgcaagagtgtggtgttctaacttaaaatatggtgttttattcaaataattttatttaaggctccaaaagcagcagcctcattccccagaaatcatagttaaatgaaatcttccttactaaaggaaaaatgaatcacaatatttaacgtgaacattttaaaaacactctaaagcaacaaaactattcaattgtatgtgatatggcttagaaaggcatgtaggtaaaaaggactaaaaactctaataatggttgggccaaaagtaaatttgttagttctactccattaagcattcctcaagcagtgtaaaaatcagagttcaagttacactttgatgtgtagatcctttgaaagccactctaccctgttttatatgaagcatccgcagctaaaatgaacacctagtgaagagtatgaatgctgcaatacataagcagacgtcagaattgtcccaagctgattctaagttactttaaacatgtatgcagagtcagaatatgacttacttcttagaagtaacagataattacctttggcataatgaaaaaaactttaaatgtaagttaatacaggtattttccctttagcaaagctttgcttttaaaagaaaacttcaaaacttaaattaaaataggaaatgctctactatgtagtaaaaatactttttagattactgaagcaaagaaaaggaaggattctatgagggaggaaaagtgggagaaaaatgtaaagaaaaaaaggaagaaggaaagaaaagagaaaaggaggaaagaacacaaggacagaaaggcctattgaaatatattatttctttcaaattttaaacgagcagaataaattcttttgttttataactatgaaataatctatgttcctcttatctatgcttggaaaatttagacaaaatgttaagagtaagtactacattggatttccgggtcttcagctctgaaaacaagctgtttcttaacatacgtcaattttctatatttcatgtcatttctatttgcaaatgttataaagttcaatatgatgtaaaacatggttaaatgaagttcaaaaataagtataacatacattagtttggctattccaaatttcatgcacattaactcagccacacatctaacacagtcagccctccctatccaggggttctgcatctgcagattcaactaaccatgggtcgaaaatgtttttgtaccaaacatgtacaggctttttttcttgttatcattccctaactacagtataacaactattttcacagtgtgtacatgtgtatgaaatattataagtaatctacagataatttaaagtatacaagagggtatgcataggttatatgcaaatactacaccattttatatcagactctcaaacatcagtagaatttggtaacccagggaggtcctggaactaatcacccagaggtatcgacagatggctatatataaatcactcagtgaattcaggattcacattatttcacaactagtataattttatgttgttcacataattgtgtcacaacatatacatgcagacaggtgactttcatgaaaagattacacccaagatagacatatggtctactcaaatacggtttccaaatgtgtatccaatcttgtttaattataatcaaactcaccattccattgataagcgacctctaccaacctgcttatcccctccaagcaatataacagtggttctctgaaccaatattgaccctcctttaaattgatagcctttttttaaaaagctaaccattgagaagtacatactgttgaagacagaacatattctgtaaaatgctcccaagatatcaaagtcagatgatacaactgaatgtttatgctagattatatttctaagctgagaattacattttaatataccataagcaatctgcaaaagaagcaacttgcctaaagatttcaggagtttcaagtatgcatatgtcaatatctgtatcaatatgtaatatcaatataatcaatgcacacaacaatacgtaactgtacttatatcatctccttagcactaattattacaaacaatctgcatgcactgcaaagcaaaagtataatataaaatcccaaaaaaccttgaaaatttaataaaaccaaaaaacaggcatcacacacaagaactgaggcgtatacttcattaatgagtatgatatcctgatatgaaatgtcaaacaaaattacccaggctcaggttagaaataaagataggacattagtctttgtatttttaaattgattttttcttctaatattccttaatgataaccctatatattacctacttaaaattattagcaaatagttattttaaaagtatgagtaattagaccaaaagcaactctcatatttacccaaaagaaggaaccactaccaagaatcaaagcctagtaattctgttcttaacagacaggtgttgtgtattctggcatgttacatgaaaatcacttatgagaagaacagaaaaaaaaattagaaggtagttttcactatggaaataggtaagtgattaagcagattttcttacaccatgaaattgtcagcagactcaataatcaccctaaggggcatcattctggatgccgacattctctatgatggaaagggactgaaagtaaaatgcactaatgacataaagaaaccaatatccaatagtaaagttgaagaaataaacattctttggacaggaactaagctgaagtttgcaactaccaagaatgtattatgccagcagtaaattaggaaactaaagcccatgtcaaccaatgaaaaatgggaggactgaaatcaatcattaaagcagcagcaaggttctaactattctaaggtataggctacctctggcgtatattatcagagttgacaattcttccaagaaattctaacatcaactgtaatctgaggtcctttaaaaaataatataaaccaggcagtagacttacattttgtaatattttcttctaagagctgtacattaagattttatttgtgatataaatactatcaaataattagctatagaacagctctattttcaacagttataacattttaagccatctcacatttaacctaaacttttatcaaatgtcaaaactgaggccgggtacggtggctaacacctgtagtcccagcactttgggaggccaagatgggcggatcacttgagcccaggaattcgagaccaacctgggcaacatggtgaaaccccatctctataaaaaatacaaaaattagctgcgcctggtggtgtgcgcctgtagtcccagctactagagaggctgagggaggagaatcaccagggcctgggagatcaaagctgcagtgagctgagatcgtgccactgcactccaccctgggtgacagagtgagaccctgtctcaaaaaaaaaaaaaaaaagaaagaaagaaaaaaaaatcaaaactgatcacttgaggtccaacttatgtttactatatctacttatattcccaaagacatcttaaggagagatgaaatcataaaaaggtgaggatgagaaagaaaatagtaagtcagtaaggtcaatttttacatatattaggctagcataataaaaatatgagtgtcttattattatttttttttgagacagagtcttgctctgttgcccaggctggagtgcagtggtgcaatcatggcttactgcaatgtctgccttccaggttcaagcaatccttgtgcctcagcctcctgagtagctgggattacaggtgtgcgtcaccctgcccagctaatttttgtattttcagtagagacagggtttcaccacgttaaaccatgagtttggccaggatggtctcaaactcccaaagtgctaggattacatgcgtgagccactgcgtctggcctaaagtgtcttattataaccaagaatttatttgtggagagaggtaaagaaaactcatttttagtgaaataattaaaactgcatcattcacaatctatctttcaaaatgaggtattaactattttggcttctaaaattaccccatatactacatgcatgagcatgggaattgaagttattttattcctaagtttgagacttcatgttttaatgtgatcactaaaaatttcctaattgatgattaggaaaataactttctgtaaaattccagaattttagctgtttcaatctcttcatattaaggggagaacattatgtttttactttctgtgcatgcactttctttattagaagaaaatggactgagggcagtaagcaaccgaaaaggaagagtaataagaagcctgatgtgtgtgaaaactggagaacagtctcaaatcataaaaagttatgacagaagaggcataaaaaataaaagtaatgaacttaatatatgaaaggtaataatgattaagagcataggctataaagccagactggactccctggattcaaatcctggctcttctaattactaggtaggtaaccctgagcaagtttcaatgaccaatctttttctcaattacctcaggtatataaaggggacagtaacagcatttaacccagaggacaataaggattaaataaatacatgtaaaataatttaaaacagtacctggtattcaataaagcgcaataaatgttagctgctattattattcatctaaactttactttcattaccagcaatattttttaatcttaaaaatattgaataaaacaatgacctagcttagtaaataaattcataatgagaaaatgttgatttcatttaataataactttagtagtttgggataacactttgcatattttaatttccccagctataaataactcaaataatttgccatcagatgatctgttattttgaagttaacaaataaagcatttcctaaaaaagttctaatacataacttttgctctcatcttatgttttaaaaacaaaatggcaaatcatctgcatcaaatagttcctactcttataacatgacaattgttttaaaatatatctgctggaaaaagcaactgaagtcctagaaaatagaaatgtaattttaaactattccaataaagctggaggaggaaggggaaaaacatatctgccaaataagcttataattaatagttgttttcagttttcaaaaatccacataggaagcaatttaagcctaaattgcctaagtctcaatctcagcgtagtagatagcttagggcaatcaaaacttgctgtgttgggctgccccctacaggactcaatttacctatttcttttaaaaggtgtgtaagtaggaaatatgattcaagttttacattaacaatattaatgctaaagcagatgattatcattcacgcattcactataggaggaaacagtctctgagaaccatctatagagatacagagagaaatgaaacaatccttgtccttgaggaattaatagtttactgcttacagagaaactacatacatggtgaaatatttaaaaatagctcatgatatcctctatgatattatgtttgctatagaaaaagaacaaggctgaagatctaagatccaagttctactgttggctctgccatcaaacaataagctaaacaatgtacaagtcagttttggggaagctgtcttattcccaaaatgaggaggttaaattagttaattcttccagcctctatggctctaatattccacagttacatttgtcaaaacaaaaggtagaaggaaatgtttcaaaaacagacttcgcagaaagaacatctatatgatatgaagggctggggcatatgtgaagaaatcaaggaagacttcttgaggaaggtgacatctgaagtaactttagaagcactctgggagccaaggctattcccaggagttaacagagtcagataataaaagatcaaagatgtttaggggaatagcatgcagtgttatttggttgcagtctagctatattttaggaaacatcaaattaatatcagtataaaactcaacagaatggagggagaaaaagcaggtagaaaaatctaagaaccactaaaatagttcatctagaagataaaggacccatgagctaaatcagtgcaaatggcaagaagggaataaatgaagacagttctggtccattagaactgcaactcaacaaaagtgatcaaaagagttattccaaagtattgacctggtaacttgaagaaaagtaaagaaagaggaaactggacactgaaacagaagaagtagattatgtatttggtagtgaatggaagtagattggtgggaccagttagaacctcacagagaagaactatgttaagaccagaaatacggccaggtgcggtggctcatgcctgtaatcccagcactttgggaggcctgggtgggcggatcacctgaggtcaggagttcaagaccagcctgacaaagatggagaaaccctgtctcccctgtctgtactaatacaaaattagccaggtgtggtggtgcatgcctgtaatcccagctactcaggaggctgaggtaggagaatcgcttgaacccgggaggcggaggttgcagtgagctgagatcgcaccattgcactccaggctgggcaaaaagagcgaaactcttgtctcaaaaaacaaacaaacaaaacaaaacaaaacacagaaatacatcaattaaaaaagtgagctattcaccagatatgttccactggtcataaaacaaaagaatacaggaggcatgacaagccatcatcattgctgttaaaataactcacagcaaaattataatgatttaagtcaataacatctaataattccagctatagtgtgcaatttaatttattatgtgccaggcacaatagtttattaaaggtattacctctaattttcacaataaccctattttacagattataaaatggaggcccagagatgtaaggtgaacgagccaaatcacctagttacctggaatataaactcagaactgcctaaatcaaaagctctcaatcttaaccacatgctatactgatgcatgtcaaagattcaattcattcagatttttcaaggttatcggaaaacctatgtagataaaaatttccaaaataatcaaggatatgtaacttttacagaaagcaatcactgatcatctattgcaatactcatgttcttaagcaatatactgagttgaaatttttatattttataaataattagaaagaatacattttttaaaactttaaaaaacacctcagtttttattctcttccccaaatttcaacaaaatccatttatccaaacttgaggttgaatcattaaagtggtgatatcatcagtaatagcagagtgaggaccctgaatatactctcctccataaaagcaacaagaacacaaaaattctcaaaatgaactttttctgaaatctttcaaaagccccactctcagaaaactgtcattatttgatctgccagttccctagaaaaacctccctcataggacattatttgacttgactcagagctcactcagtgcaaacaattttatcaccaggagagtttgtggaaaatcagtggcaattgttaaacatcacatctgccatgagatagcaataacagatgggacaaacaagctaaccaaaaaattaaaagaaaaacctgggaaataagaaatccaaagggggtctgaaaagttctaacatatttctgataatccagaaagccatacacatgtatagagctgtgtacacgctcaaaaaacatctacgaaggccctaaactctcacctatgggaaaccctgaggctctgtacaagaagaaagtaaaatccagttataaattgcttgccgtatcattgaaggcaatgccccaacattcacacataggcccctggcaaagattggaagatactctagttctaggcattcaagaaaatctcttctaatcatcagatgatcactaaactcaccaagcagtaactttaggggcctgtgtgataaaaaataaaaacctgaaagaattagttcaggaaagaaactaaacaagcaacagcaacaacaaaaacagaccttgggaaaggggggaagcatctggtttccagagttattctgttatactatataaaatattcaggtctcaacaacaacaaaattacaaagacatgcaaagaaacaagtataagccacaaactggggggaaaaagcagcagaaactggccctgaaaaagaccagatgctggacttactggacaaagactttaagagagttattttaaatatgcgcaaagaactaaaaaaaagtttatctaaagaactacaggaaagtatcagaacaatatttctgatccttcagaagaaccactttttgtcactacagattagttctgtctggtctagaacttcttaaaaacagaatcatagagtatattctctttatatcagctctttttactcaacacaatgttgtgtgagatttatccatgttgttgcatgtatcattcccaaacagaaatagaaattatagagataaataggagttacaaaaaagtaccaaacaaaaattctggagttgaaaagcacaaaaactgaattaacttgaggggctcaacagctgatttgggcagccagaagaatgaatcagcaaatctaaagataggtcaattgcgagaaagagagggaagaaggaaggaaggaaggaaaggaggctcagagacccaagagacaccatcaggcataccaatatacatataatgagaggcccagaagaagatgcagaaaaagggtcagagtatctgaaaaaataatggccctaaacttcccgaacttgaccccaaaaattaatctacacatccaagaagataaacaaactaaaaagaataaaatcaaagcgatccacacctaggtacatcataatcaaatgactgaaatataaagagagactctcaaaacaggcaagggacttatgtacaaaacatcttcagattaataacaaatttctcatcagaaatgatgttgtcaataggcaatcagatgacataatcaaagcactgaaagaagtagaatgtctgggacctggaatgctggtggacacctgtaatctcagtattttgggtggccaaggtgggaggatcacttgaggcaaggagttgaagaccagcctgggcagcagaaagaggctctgtctctacaaagaataaaaagattggctgaatgtggtggtgtggacctgtagtcccagctactcaggcggctaaggtggaaagatcgcttgagcccaggagttggaggctgcagtgagctatgactgtgccactgcactcttgcagtggagaccctgtctctataaagaaaaaatgtcaaccaaaaactacatgcagaaaaactgcacttcaagaaatgatcagtaccttgaagctctgaaggtgcttaagactgtagatcaataccatagaaaataatttagtatttaggaatgtaagaaaattaagacagccttgtttgataactacacataatactgtaactgttcttgcactgttctggttattgtcaagctatgagcacaaactgatgactgaaatacagaatacagaacaggatataaaatcttatcaggtaaagttaggcaagcaattactagttgtaattcaacttgaaggagaaggaataaggaaccaactcaaaccaggcagcaatgaattgtaaaaaagcttaaggtaaaacaaacagggaaataaaacaactcagaacctaagcatatcgtaagaacctaatctaacaaggaggggcttaaactgattattttacagcttgggtgcaattatcccacaaaaaactttcaggagtttcaccagtccataaactatttggttattagaaaatagctttattgggctaccctctttgggtcccctccctttgtatgggagctctgttttcactctattaaatcttgcaactgcactcttctggtccgtgtttgttacggctcgagctgagctttcactctccatccaccactgctgtttgccgccatcgcaggcctgccactgacttccatccctctggatctagcagggtgtccgttgtgctcctgatccagtgagacgcccattgccgatcccgactgggctaaagacttgccattgttcctacgcggctaagtgcccgggttcatcctaattgagctgaacactagtcactgggttccacggttctcttctgtgacccgtggcttctaatagagctataacactcaccgcgtggcccaagattccatttattggaatccatgaggccaagaaccccaggtcagagaacacgaggcttgccatcatcttagaagcagcccgccaccatcttcggagttctgggagcaaggaccccctggtaacaatttggcgaccacaaagggacctgaacccgcaaccatgaagggatctccaaagcggtaatattggaccacttttgcttgctactctggcctatcccttagaattggaggaaaatactgggcacctgtcggccggttaaaaacgattagcatggccgccagactttagactcaggtatgaggctatctggggaagggctttctaacaaccctcaacccttctgggttgggaaccttggtctgcctggagccagcttccactttcaattttcctggggaagccaagggctgactagaggcagaaagctgtcgtcccgaactcccggcattagccggttgagatcatgtcgcagccagaagtctctactcaacagtcgcccatgcgtgcgctcctaccttcccttctgtcccacacctcctgggtcccaaccacgactttcttgaaagtgtagccccaaaattctccttacctctgaatctacttcctctgatccctgcctcctaggtactaatggttgagactttcatttcctctagcaagttgtatctccaaagggatctaaggaagctctatgctgcgcccttaggcatctaggctataaacccagggagtcttgtccctggtgtccctcctgatttaggtatacagctctagacatgggcagttatgtgggacctgttccccaccacccttgccagggccccaagtttgtaaatggctaagagaggaaacagagagagacagagagaaagagacagtgagagacagacagagacagagagagagagagacagagaggagagagagagagacagggaggacagggagagagacagagaggagagggagagagacaaagaggagaaagaggcagagagacaaacagggagtcagagaaagaaagacaaagatagaaatagtaaaaaaaaacagtgtgccctattcctttaaaagccagggtaaatgtaaaacctataattgataattgaaggtcttctccgcgaccctataacactccaatactaccttgttgtcagcgtaaacaagggcgtagcctgaaaacactaagaccactgacaacccatagccttcctatcaaaaatccttaacatccagtgacctgcggatggcccaaatgcattcaatctgtagcggcaactgctttgctaacagaaaaaagtagaaaagtaacttttagaggaaacctcattgtgagcacacctcaccggttcagaattattctaagtcaaaaaagcaaaaaggtagcttattaactcaaaaatattaaagtatggggctattctgtcagaaaaaggtaatttaacactaaccactgataattcccttaaccctgcagatttccttacaggggatttaaatcttaattaccatacaaaggtccgaccagacctaggaggaactcccttcaggacaggatgatagatggttcctcccaaatgactgaggaaaaaaccacaatgggtattcagtaattgatagggagactcttgtggaagcagagttagaaaaattgcctaataattggtctcctcaaatgtcagagctgtttgcactcagccaagccttaacgtacttaccgaatcaaaaagactatctcaatcctgactcaaaagcttacttataccctctctgaaacgaatttgcctaagaactgttgtttatgggaatgcatcttgatggagcagctgggttgttatgaaatactcaggaactcagcctagctctaggactcacccctgagcacaaaggcaatgttgggcacgctggtaaaggaccactagaatccagcagcccggacccctttctttgtgatcaagaaaggcgggaaaaggggtgagggctgctacatcagtgagcataactaatccgataagcagaggtccatgggtggttacacaccccggaaaggaataagcattaggaccatagaggacgctctaggactaatgctcatcggaaaatgactagtggtgctggcatccctatgttcttttttcagataggaaacgttcccctcaaggcaaaaacacccctaagatgtattctggagaattgggaccaatttgactctcagatgctaagaaaaaaaagacatattcttctgcagtaccgcctggcaacgatatactctttaagggggagaaacctggcatcctgagggaagcataaattataacaccatcttacagctagacctcttttgtagaaaagaaggcaaatggtgtgaagtgtcatacgtacaaactttcttttcattaagagacaactcgcaattatgtaaaaagtgtgatttatgccctacaggaagccctcagagtctacctccctaccccagcatcccccagactccttccccaaataataaggaccccccttcaacccaaacggtccaaaaggagatagacaaaggggtaaacaactaaccaaagaatgccaatattccccgattatgccccctccaagcggtgggaggagaattcggcccagccagagtgcacgtacctttttctctctcagactttaaattaaaatagacctaggtaaattctcagataaccctaatggctatattgatgttttacaaggtttaggacaatcctttgatctgatatggagagatataatgttactgctaaatcagacactaaccccaaatgacagaagtgtcgccgtaactgcagcctgagagtttggcgatctctggtatctcagtcaggtcaatgataggtcgacaacagaggaaagagaacgattccccacaggccagcaggcagttcccagtgtagaccctcactgggacacagaatcagaacatggagattggtgccgcagacatttgctaacttgcgtgctagaaggactaaggaaaactagaaagaagcctgtgagttattcaatgatgtccactataacacagggaaaggaagaaaatcctaccgcctttctggagtgactaacggaggcattgaggaagcatacctctctctgtcaactgactctactgaaggccaactaatcttaaaggataagtttatcactcagtcagctacagacattaggaaaaaacttcaaaagtctgccttaggcccggaacaaaacttagaaaccctattgaacttggcaacctcagttttttataatagagatcaggatgagcaggcagaatgggacaaatgggataaaaaaaaggccaccgctttagtcatggccctcaggcaagcggactttggaggcactggaaaagggaaaagctaggcaaatcaaatgcctaatagggtttgcttccagtgcggtctacaaggacactttaaaaaagattgtccaaatagaaataagccgccccctcgtccatgcacctcgtgtcaagggaatcactgtaaggcccactgccccaggggacgtaggtcctctgagtcagaagccactaaccagatgatccagcagcaggactgagagtgcccggggcaagcaccagcccatgccatcaccctcacagagccctgggtatgcttgaccattgacggccaggaggctaactgtctcctggacactggtgtggccttctcagtcttattttcctgtcccagacaacggtcctccagagctgtcactatccaaggggtcctaggacagccagtcactagatacttctcccagccactaagttgtgactggggaacttcactcttttcacatgcttttctaattatgcctgaaagcccaactcccttgttagggagagacattctagcaaaagcaggggccattatacacctgaacataggagaacacccgtttgttgtcccctgcttgaggaaggaattaatcttgaagactgggcaacagaaggacaatatggacgagcaaagaatgcccgtcctgttcaagttaaactaaaggattctgcctcctttccccaccaaaggcagtacccccttagacccgaggctcaacaaggactccaaaagattaaggacctaaaagcccaaggcctagtaaaagcatgcaatagcccctacaataatccaactttaggagtacagaaacccagtggacagtggaggttagtgcaagatctcaggattatcaatgaggtcactgtccctctatacctagctgtacctaacccttatattctgctttcccaaataccagaggaagcagagtggtttacagacctggaccttaaggatgcctttttctgcatccctgtacatcctgactctcaattcttatttgcctttgaagatccttcaaacccaatgtctcaactcacctggactgtttcaccccaagggttcagggatagcccccatctatttggccaggcattagcccaagacttgagccggttctcatacctgggcactcttgtcctttggtatgtggatgatttttacttttagccgccagttcagaaaccttgtgccatcaagtcacccaagtgctcttaaattttctcgctacctgtggctacaaggtttccaaaccaaaggctcagctctgctcacagcaggttaaatacttagggctaaaattatccaaaggcaccagggccctcagtgcctattctggcttatcctcatcccaaaaccctaaagcaactaagaggattccttgacataacaggtttctgccaaatatggattcccaggtacggcgaaatagccagaccattatatacactaattaaggaaactcagaaagccaatacccatttagtaagatggacacctgaagcagaagcggctttccaggccctaaagaaggccctaacccaagccccagtgtttagcttgccaacggggcaagacttttctttacatgtcacagaaaaaaacagaaatagctctaggagtccttacacaggtcgatgagcttgcaacccatggcatacctgagtaaggaaattgatgtagtggcaaagggttggcctcattgtttatgggtagtggcggcagtagcagtcttagtatctgaagcagttaaaataatacaaggaagagatctgtgtagacatctcataacgtgaacggcatactcactgctaaaggagacttgtggctgtcagacaaccgtgaggaaagtaactaaaatcgtaaatccccatggccctcccttatcatatttttctctttactgttctcttaccccctttcactctcactgcaccccctccatgctgctgtacaaccagcagctccccttaccaagagtttctatgaagaatgcggcttcccagaaatattgatgccccatcaaataggagtttacctaaaggaaactccaccttcactgcccacacccatatgccccacaactgctataactctgccactctttgcatgcatgcaaatactcattattggacagggaaaatgattaatcctagttgtcctggaagacttggagccactgtctgtcggacttacttcacccatactggtatgtctgaggggggtggagttcaagatcaggcaagagaaaaacatgtaaaggaagtaacctcccaactgacccgggtacatagcacccctagcccctacaaaggactagatctcttaaaactacatgaaaccctccatacccatacttgcctggtaagcctatttaataccaccctcactgggctccatgaggtctcggcccaaaaccctactaactgttggatgtgcctccccctgtatttcaggccatgcatttcaatccctgtacctgaacaatggaacaactacagcacagaaataaacaccacttccgttttagtaggacctcttgtttccaatctggaaataacccatacctcaaacctcacctgtgtaaaatttagcaatactgtagacacaaccaactcccaatgcatcaggtgggtaactcctcccacacgaatagtctgcctaccctcaggaatattttttgtctgtggtaccttagcctatcgttgtttgaatggctcttcagaatctatgtgcttcctctcattcttagtgcccccatgaccatttacactgaacaagatttatacaattatgttgtacctaagccccacaacaaaagagtactcattcttccttttgttatcggagcaggagtgctaggtggactaggttctggcattggcggtaccacaacctctactcagttctactacaaactatctcaagaactcaatggtgacatggaatgggttgccgactccctggtcaccttgcaagatcaacttaacttcctagcatcagtagtccttcaaaattgaagagctttagacttgctaacctctgaaagagggggaagctgtttatttttaggggaagaatgttgttattatgttattttagcggaagaatgttgttattatgttaatcaatcctgaattgtcacagagaaagttgaagaaattcgagattgaatacaacgtagaacagaggagcttcaaaaacaccagaccctggggcctcctcagccaatggatgccctggattctccccttcttaggatctctagcagctctaatattgatactcctctttggaccctgtatctttaacctccttgttaagtttgtctcttccagaatcaaagttgtaaagctacaaatcgttcttcaaatggaaccccagatgaagtccatgactaagatctaccgtggacccctggaccggcctactagcccatgctccaattgtaatgatatcgaacgcacccctcccgaggaaatctcaactgcacaacccctactatgccccaattccgcaggaagcagttagactggtcgtcagccaacctccccaacagcacttgggttttcctgttgagtggggggactgagagacaggattagctggatttcctaggccgactaagaatcccaaagcctagctgggaaggtgaccacatccacctttaaacactgggcttgcaacttagctcacacccgaccaatcaggtagtaaagagagctcactaaaatgctaattagacaaaaacaggaggtaaaaaaatagccaatcatctatcgcctgagagcacagcgggaaggacaatgatcgggatataaacccaggcattcaagccggcaacggctaccttctttgggtcccctccctttgtatgggagctctctctgtcttcactctattaaatattgcaactgcaaaaaaaaaatagcttaattgaagaataaattaatacaataaaaggaatacattttaagtatacagttcaaactgtaacagtgttacagtttcaagaggaccccttcaacaagatattgggcatttccatcatgccctaaaagttccttcttgtcccttactggttgggtccatctctactacaccctcctgacctggcccagaccttggcctcagaagaatcatttttttgtcactacatattagttttgtctgttctagaacttcttaaaaacagaatcatagagtatgttctctttgtattggttctttttactcaatgtaatgttctgtgacatttatccatattattgcatgtattattccttttaatcctgaatagtatgctgttttaggaatataatgcaattgtttattcatttacctgttgacagatatctgagctattatgatggatattatgaataattctgctatgaacacttctgtacaatgttttctcggacatatattttcatttttcttgagtggagctgttagaactgttggatcagaaagtaagcatatgttgaattttgaaagaaactggtaaactcttgtctaaagtgatttgtaccattttacactcctactaataatgtatgagagttatatttgctccacagcctttttactactttgttaatctttttagtactgtcaacctttttaatttatccaatctagggaacgtgaagtagtatctcactgttattttcattttcctgatgagtaacaatatcgtgtatcttttcatgtgcttattagccattcctatatcttttgtgaaatagttaacttaaatttgtaactaaaggtgctttcctgagtttcaggtagtaagcctatttccctcaagtgaataaactacagtcttggaatgaaaaattaaacacagtggagacattttttgtataagttgttttactctgtgtatgtctggtttgcttagtctattattatatgccccatgaaagcaaacacagtgcttatttcactaatgagtatcactagcacatagaactgtgcttgcccaaagcatgaactcaataaatatgttaatgtgtatgcatgcacatacatctacatgcatgtacatctatacacacatataaacatatattaatttttagacccacaaatctaagaaaactaattcttgagcctctggtttgaagaattctcaaattattaacatatctttatgttccactccacatccactgtacctgaaatagccctactgttctactttggtaaatcaggcaaatttaattttttaaataattaagattccaactaattttaaaatataatttgaaagttaacaatgaaatacattacataaaaagaaaattttaaataaaagcaaaactaaacccaataagaggaaagaaagttgggctgtatttctttaatcctttaaaattcaaatcacacaatgctccaatgaaatcttcattaactgaaccaaactatgcccatgaaagatctcatatgcaactgctaaaacctcaataaacatattcatcttcttgcaaaaaagatatttctttataatatgcacatgcagtatatactattttgaggcagatttgtactttagtccttgttccattgcttaccggctggctgtcctttgtctggtcattgacctccaacttaaaaaataatacttgccttgtctaccccacagaagtgttatgaaagtcaaacaaggtagcataaaggtattttacaagatataaagtgctataatacagattttaaaaatcactctacatcccataatactttgttgtacaattttagagcaatagtagaaaataacaattattgcctaattgaaaatccagtcccgaattccataaaatgtatgatatgaacattatagtacatcatattacgagccccaaataatcactgcttatatagttggttaggatttccttagtttgttcatatagtttatatatttatgcagtccctattttgtgagaggcattgtgaggagcataaagacataagcacagtacagagccttagcttctctacatttactaaagaagacttcttcttgggtatttaatcaatatttaaagtattctgggaagaaatgaaattaacttcatagactgaccttagattactatcattacaaaaagatgcctgagtgatctgtctttaacataccagtatttatcttataactgttatatttacttgaatcagaagtgaagtccttttaagcactaagcatccattctatactttcttgtctttacatatgagatacaaatcatatttttaaaacttttatttacttttattttttagagacggagtcttgctctgtagcccaggctggagtacagtggcatgatcttggctcaccacaatctccacctccacttcccagggttcaagtgaacaaatcatacttttaagcacagattctcaacatgtatcctagcatgctactgccataactagggtgtgaattaagtattaaagacagcttaccccaaatattactgtaacatatatctctaaatgaaaaagaacatattaacaactatacttggatgggattctgggagctaacccatccctctctcccctttcctccaaattccatctcctattaacacaccagctctcctgagctaagcagctcctggggttggggaagggtgtacatggagaaagctagaacctctacagtgttttcctctctgggaggaactagcaggcatacgaacagaaaaagctgaataaaaggctgaatcctttctattcctgaggcagacagagagaagaccagggaacaaagagacttcgaccaagagccctgccaggtattgatacctttgatactgagaaaatatctgggatatgaaatacaaatgctaaataagtatctttgaaataggggtaaaagaataaagggtcttgatgagtaaaatgggtagtattttttaataacctgataatgagctttaggaaaagggaaggtcaacgttatggaatgaaaacacagaggtaccaaatttaaaagcataaaaaaaagtggagggggggaacccaataacttcatcaaactagcaaataacttagtatcatttctaattagaaacgctagaaggaaatcacttagatctgataaagactaggctataattctaactgatgaaacacttaaactgtatcaattaataccagaaaacaaacacagaaaagtctactagaaccatcattattcagcacagtcttggtaatgcaatactataatagcaatgcaataaagcaagaaaaaaaaaagtttgtaaaaacacaataggatgagatttttgtttttccaatgccataaataactagaaatggaaacaaaataaagaaaaacaaaatctacaaaacacctggaaataaaaagaaaaatggtctatttgaagaaaaccttaaaatctatgcagaacataaaacaaaatctgaataaaaagaaatatcatgttcttgtctgggaagacttaatatcataagaaagtgaattatatcaaaatttaaatcgaaatttaatgtatttccatctctaatcagacaggacactatggggaactgaataagtgattttaaaagtcatggaaaattaataactgagaataaccatgaaaagtatgaaaaaaggagacaaatgaattgctccaacagatatcagaacgctaaaattaaataaaaatactactaggataagaaaatacatatactgatgtaatgaataaagaatccagaattagattccagtaagtcaaactactttactataaaccaggggtggcatattcatccagtgggaaaaggacagtaagaagtgagtaaactatggcccactggccaaattgtggcctctgcctatttttgcaaataaagttttactgggacaaagccaagcctatcatttgcaaattgtctataaatattttcatgttacagaatcacacagtttcaacagagaccatcttgtctacaaagctgaaaatatctactatctggcccttgaagaaagtttgccaaaccttagtttatataataaaagatcagctatctcatagacacctatctcacacaacacattgtgggaaaggaccttcttttttttttgagacggggtcttgctctgttgaccaggctggactgtagtggcatgatcatggctcactgcagcctcaacctcccaggttcaagtaatgctcccaccacagaatcccaaacagctgggagagatgtgtgccactacgcctggctaaggggcctttttaacagagaaagaaatccacatactactaagaaaaagaagggcatatttgatatatatttatattttttatatagatatcataaaaatcaagatgaattatacagttatattttgcaatgtgtttgacggtaaaagtttaatatctataaaaattattttataaaatatctttaatatatttatagatattataatataaaatatctataaaattattttataaaataaaaagttaagaagaaaagataggcaaaacaaaatacagtgcaatttacagaaaaccaagtccaaatggtcaacaaagataaaacagatttataaactcactaagtgtgagagaattattagttaaagtaaaaatatctctctatacccacaatactactaaaaatcagagttataatgccctattgctggtggagatgtaaggggagaagcatgctctcatatactgttagtgaaaatttaaactaatacatttttgaaaagtaagctggcaattttttttttaatctctaccttttgatgcaaaaactcatttttgggtacctattccataccttaaaaaaaatacatatgcttactgtagtactgtttataatggtaaaaactagaaaaaaagaaaacttgatagtgaatactgaacaaattacagtgcatctacagattaaacataatgcagccattaaaaaagaataaattaggctgggtgcggtggctcatgcccgtaatcccagcactttgggaggccaaagcaggcggatcacttgaggccaggagttcgagaccagcctggccaacatggcaaaaccctggctctacaaaaaatacaaaaattagtcgggcatggtggtgggcacctgtagtcccagctactcaggaggctgaggcaggagaatcacttgagcctgggagacagagattgcagtgagccaagatcatgccacagcattccagtccaggtgacagaacgagactctgtctcaacaaaaagaacaaattaaaccctacaactcatcaacaaaaatacccaaacccaattcaaaaatgggcaaaggacttgaatagacatttcttcaaggatgataaacaagcacatgaaaagatgcagagcactattcattagtgattacatcccacatgcattaggatggctagtatgaagaacagaaaataataaatattggtgaagatctgaaaaacagaaacctttgtgcactgttggtgggaatgtaaagtggtacagctactacggaaaacagtatggccattcctcaagaaaataaaaataaaattatcttatgataggaatatgcatttctgggtaaataccccaaataactgaaaacagggtgtacacccatttcaacatttacatgtcaattcaactgggccagaatacccagatatttgttcaaatattcttctggatgcttctatatatatgttttttggctgaggttaacatttaaattggtggattctgagtacagcagattaccatccacaatgtaggtgggcctcatctactcagttgaaggtcttacagaaaaagactgacctcccttgagcaagaaagaattcaggcaacagactgcctttggactcaactgcaactcttccttgagtcaacagcccatcccatcaccctggcttggtgagtccagggtctgatgaggtaggctgcagactcaaggaagagctgccaaaaccaggaaagccaattcattaaaataaatctctctctacacaaacacacacacacactaccaccaccaccatgatggttctgtttctctggagaatgctaatacacccctgttcatggcagcattattcacaatagccaaaaggtggaagcaactccagcagatgaatggagaagcaaaatgtggtatgtatatacaatggaatattattaagcctttaaaaagtggaaattatatctatctatatctatacacacatactcacacacacacacacacatttatagaagacagggtttcaccatgttgtcaaggctggtctcgaactcctgggctcaagcaaaccgcctgcctcagcttcccaaagtgctgagattacatgtgtgagccaccacacccagccaaaaaaaggacattctgacacataatacaatatagataaacaatgaggacatcatgatatgcgaaataagcctgtcacaaaaaggcaattagtgtatgattcctcttgtatgaggtacctatggatgtcaaatccataaagtagaatggggaaacagagagttgtttaatgggtatagagtttgttttgcaagaagaaaagagttttggagaatgaatgtacaacagtgtgaacataattaacactactgaaaatggttaagattataaattttatgttacatttattttaccatgattaaaaattaaaacaaaataatattaaggaaaaatactataaataacaacaacaaaaaaaacacctcaagcaacttacattcacctgggaaacagaatacatcctattctgctagagatatatctgcagttcaaaatttattacaaatgatgttgtgtatctttttgaaatgactgaaaaactaaattaaaagcaataatattcagtttactaaccagtaagtccttctttcatggttcctgacttttctgtaagatgttattgcaagatatctactaaaatggaaaacaactgaaaaggcaaaattataatttcttatcaacatcgctaaaaccctggaggggaagaatcctaacaaacatggccataatttgccacatatttctactgtcctcacttttcaaaatccagaaatcaacatttctggaaacaaaacagagtctaaaatttggctccttcttcagtttagaaggtgccaagttaatccctgacatcctagtttccattttcaaaaatgtactttttctctccccaaaccggtatctagattcttaaatatttttagcacatagaagttaaatagatttgcttaaccaaaatagccagtaaacctcccaaaagaattaaaatattaatggcgctttaatgatacaaatgaacaactttacattcaatcgtcaatgggaaaggaagcagaattctgaggattatgaaagtaaacaaaacgaagttcaaattctactttattttacttttttgtaactaatgaacaacttcttccaaagacaagtaggaaatacaaaaattagccaggcatggcacatgcctgtagtcctggttacttggaaggctgaagtgggtggatcgcttgagccgggaaggcagaggctgtagtgagctgagatcacatcactgcactcaagcctgggtgacagagcaagaccctctctggggaaaaaaaaaaaaaaaataggctgggcgcagtggctcacacttgtaattccagcactttgggaggctgaggcaggtggttcacctgaggtcaggagttctagaccagcctgaccaatatggtgaaaccctgtctctactaaaaatacaaaaattagccaggcatggtggtgggcaattgtaatcctagctactcgggaggctgaggcaggaaaatcgcctgaacccaagaggcggaggtttcagtgagccgagattgcactagtgcactccagcctgggcgacagagcaagacttcatctcaaaataaataaataagtaagtaaataaaattaaaaaatatataaaaataaaacaaagataagtaggaaccatcctttttttttttttttttttttttttttaaagatagggtctgtttctgatgcccaggcttgagtgtagtggcatgatcatggctcactgcaaccttgacctctcaaatacaagtgactctcctacctcagcctcccaagtagctgggactacaggtgcttaccaccccatccggctcatttaaaaaaatttttttgtagaggtggggtctcactatgttgtatccaggctggtctcattttaactttattagaaaacaagcattgttttatcagcttcttgtttttttaaaactaaaaataacactgctaggttgtttctatgaagattctctaaatttatttataaccttaagaataacatgtagaacaaagtagatgactgaatgatctttgttgaataaatatgaatggatattcaaataattaaaaatctcttaagatctcccattctttacaggatacagagaaaactcgttaatatggcctgacttttacctttgcagccttatccaaactctgtggtcaagacaaacaggttgtccttatacttacaacgtccccctttgcctacaaagctcttctcatgactctttgcctatcttaagttcacctatctgtcaaatctctgggaatgcaacatttcctcaaggtagccttctctcctcccaaactagaacaaattcttcctggggcattaggtttttattgcactgtatgtctcttcttcacagcaatcacagttccaatgttatatttgtattcttagttgatttgtttctttccacctttagactataaccttctaaggggtcacacataatatcgatcatcagttgtatcccttgtgcatagcacagggcatggcaggcaaatatgtgtgtaaataaacttgttgaatgaatcaatgagacacacttttcttacccaaagtataatggcaggataacatttatcaatctattgcttcttgaaaaacagatatgatgtgcttaattttcattttacatctcaaataccaatgcctaaggaattcacagtcattttacaaatctttttgacaaatgccttcattaatcaccacctgtttacaagtgctaaataacattttggttacattctgtaacatttcctgcacttaatgtcatctctagaatactggctaatatgaagcacctggacttcaggaacacaaacctgaaactaacacaccaaactaaactgttatgtaaatgacagaaatgacacattttggtctgcaacatctctagatggcttttggaccaattcaacttttaccactaaaaatcggtcacctgactatagtcattttgagctcatgataaatgaattacagatgaaaaataaatagtttgatgacaatctttacaaaagtttatcttcaaagaataccaccagtcacaggtattctaggctcctatcaacttatttggtcagggcagacttcacttttcatgataattatgttctgaaaattctacaaacttaatgattacaaacaaaagtcatagtttgctcataaatcaggcctaggtctggattctagttcttccatttttcatttgttcactgaggcaagtgacttaaaattccctagcctcagtttcctcacatgtaaaatcagataatgattcctattcctaagatggttttgaggcttcaacaagataagatgggcctcactcaagcatgctcagtactctgtctctctctctccggttatgcagaaattctattaggattctgcaaagtaaaataaatatttcagtaaaaattatgccctttattaatgaatctagattttcagattttccttaaatttacttagtaacttaagggctcaaatattatagagatttgtatctagtattttaaagaaatgaaaggtgttaatcaaaatgctgcacaaataaatgctacatttaacaaacagaatatcacaaccatacaaactaatcagatataaagaagtcagcaacagaaatctgatgttgcctttagatcacacaattaggcaaacaaaaatagagttccatcctcctttggtcaaggccatggttgaagactgaataccaaatagggaaataggaaaagccaggaaatggcaaattagcaaaaactggactccttaatttttatattcattttcatatctcacttctaaaactttaattaaattcaaataaaaaccaaaatggaactgagataaagccaaaaggaaagttatgtaggtcaaatgagaacctatattgtccttaggctctttgttgctttctgtttaaggaaaaactgcccaagtgccttgacacattaaagatcaagcaggaggttctgccgagagtccccatctggcagccaggttttgtcaagcaaattttgagaattctctaccctcccactttctatctaattatagcactttataaaaaccattctctctctgtctctgtctctctctctctctctctctcacacacacacacacacacacacacacacacacacacaccctttctctctctctctctctgaaacttatctgtattataataacacaacactaggtatggattaatctgacaattttcccctaaaacagaataaattcaaaaaggaaaacctttcctctgtacacatgcactatattctgacaataataattcctaaattaagtataatacattttccctacaggagtttaaagaagttacagtaaagaatctcttgtataaatatatatgccagaacttgacccaaataagtgctgagaggtataaatctcaaaacagtttccggactctttgtgaaatgtcttcagagtctgcgatatattttcttcaactaaattatacaagtaagatattttgctgggctgtgggaatgccttacggcatgttactgtggagctcatggtaaaatagaaagaatataaataattaaaataaaattgacaaatgataaatgatttaataaattagaaattcaaatgccgggcacttttctagaacctggacacaaagcatgaacctaacaataaccccgccttcatgaaaaatatggactatttgaaaattatacctgcaacactaaataaatattcttcattcttccagtatattgagatgtttactttcaattagacaatttgctttcctctctgaacacatagttatgtgatggctctataaaagattttaaaataactatagaaggaactattggtaaagactgtgggatactaaaaatggctacaaagaaagttatgacaaaacctctgagtttgaatggaagtcctactagattagagtctaagcctgtgacattatgcttctggttcttgttcttaaatgcttttctcattaatagtatgtaacttacttcctggaatgccattcattaaaaaaatatttaatatttgctaaatgtcaatatttatgccagcacttttaaagtacagaaacatggagtttctttacctcatgcaaatatgctgtgagaaagacttaagagcctattgcctactttgtggtacaacactgaagactcaccatccaaaacaaacagacttagtaaattcttgtgatttgcagtagttctgttctataaggttaccacaaacactgaaatcatcgctcctgggggaatacaaggttatgtttccgtgagccctcggtcacaacatgttcattaactgatcaatacataaccttgttctatgtgtgtttctgtttaaaaagagcacttcagtgctacatttggagtctgttttaaacagcaaaatcactaataaaaagcacaaaaatgtaaaagcatggcactacatacactgtgacaagaaggcttgtttatagtatgacagctgagacaagaaggtagagcctcgctttgatcaacctctgctgggaaatgagcatcaggtgaatcaatttttcaccactctgaatgaccgtaaaagtgctccaagtactgactttggggttacacataaattttagtaagcatgtgaatctgccaatatgaaatctacaaataatgagtaccaaatgcatatgagtcaaatatttcagtgcggtatctgacttgattgccactgaaagacacagtttggaaaacccctaataaataccgtttagttactatgcagacaaagagttctacactagagtgcttcaattaagatgtctgaggctttcataaatggatgttttttaaaatgttatttcctacctgatatattctaaaggggatataacgaaatccattttcttctgcaggatattccatgagtttccgattgatggcccaaaactggtcaaatctgtctgtaatgatataaattatttgttattaaaaatgaacaacattataatggaatacctcacatgaagagatgaaagttttaaatatccctctagaagtttctgaaaggacatcacatatattttcttatttttattaaacttatctttccataaacataaagcaaatataaaattaatttttttctacattattgcatcctctccctagatattcgcacagccatttttttctcataagaaaaactgtaaacatataaacatacgactacttgtgttatcaaggcaaaaaacacaccaggtagaggatagatgtcttgactctcctggtactacttctaattgctgagctacaaaggtacagcttcaagtagcctaaatgttaactagaagttgtgtaaagaaataaagtcgcagggtgcagtggcccacgcctgtaatcacagcactttaggaggaggctgaggcgggcagatcacctgaggtcaggcgttcctgaccagcctgaccaacatggagaaaccccgtctctattaaaaatacaaaattagccaggcgtggtggtgcatgcctgtattcccagctacttgggaggctgaggcaggagaattgcttgaacctgggagacagaggttgtggtgagccgagatcacgccattgcactccagcctgggcaacaagagcgaaactccgtctcaaaaataaaaataaaaataaagtcaaaatactgaacacagtaaacattaaataccaaagatttttttaaaaaagctttgaaagaaacatggaactggcacttatgaagtgccaactgcagcttaatctcagaccaattaagctctttttaaaaacttttcaatttcaaattttttaaataaacaacttgagatataatttgcataccataaaattcaccccttttaaagtatacaacttagtggttttcagtatattcagagttcagaacattttcagcatcccaaaaagaaacctgtaactattaatagtcacttcccactcccccttgccccagcccctgaaaaatcactactttctatctctatagtttgcctattccagacatttcatataaatgaagtaatataatatgtggttcttttgcatctgggtttttcgcttggcataatatttttggtgtccattcatgttgtagtatgtatcagaacttcatttgcttttacggctgaataatattccattatgtggagttaccagatttttgttctctcagttgactgacatttaagtagtttccgctttttatctattataaataatgctactatgaacatttgtaaacacattttcgtgtggacatatgttttcagttctcttgggtatgtacctaggagtagaactactgggtcattaggtaactctatttaactgatacatggtaactgtgttttgaggaactgccatactgttttccaaagtgagtgtactaccttacatttccaccagcaatgtatttggattccaattagtccacatccttgccaatgcttgctactactggtctttttaattataatcattctggcaggcatcaagaagtatctcattgtggttttgatttgcatttccttaatgactatgctgagcatcttctcatgtgctcaatggccatttgtgcatctttgcagaaatgcctatcaaatcactttcccttttaaaccagttgtctttttattgttgagttataagagttctttataaattctgaatacaaaccccttatctatgactcacatattttctcccgttctgtacattgttttttaagcaactcctttttttttaactcacccagaatcccaccttataataaaatattttatattcagaaatttgtatcaaaatcttatctctataaagcaaggaaatacatccagaattacagttcagcttggtatttttctattactagacctgtttgaatccaatctactggcaatctattgattctgcttaaaccatcctaactgtatatttttaaaaaatttcttcttacacccctgtcctaaaagactgtgacaggctttaggccttccttactctaatcttcaactccaatgtgaaggaagactcgcagtatattagaaatggtgtgagagaaaattctgaatccagtaagtccagcacaatttcacagatgataactaaggcccagattattatatgtttaattaataaccaagaccagaatcttggtcttccgattcaaagtccccaattgcttcaacagttgctgccacgaaactttatcttaatgtgaagaatactactttgacatagtcctctcacatatgaagcaattattctgtcaatgcttaaaaaagtgtctttctaccatcaagtatcaagcaagaatgtgacagctaaatataatgattcttcatgcatacttaaaattttactttgctgccttgtcatgaaatctcaagcacctagcatggtgcatgcatagtatgtgctcttgaatcaaagaatggatagaacactatgaacataatttctcataaaagtaaactggaaaaagaaacatgattgtgccagttatcaattgtatgactctcttctccaaattcacccttcaatatatgcatcgctatatggtcacaaatcctttaagcatctctactgcaacaactatcttaagatttctcagcagaaaatgctaaaagaagttgtaggagaaacggttctgcccaatgtccagatacgcaagtctctcagcaaggtggcagcaggagcctggcccagggttaaccagccctcaagacagaatctagcactccaaaggcttcctgcttgcataggcacactaatgggcgcttgcccttatcaacatctcaatttgcttgctctggaggcctgcatgggctgcccatctgtggtttcccacccagctgccactccctctgcacaaccatgccacatgttgttgatcacctgcattccaggttgccctgactgccaatgtactacataccaactctggcctggcgggaagagggaacttttctactaattcaatgagctgaatatacctcctccagtgaagtctgagccctagcctttgcaggtgggaccccttacaagtttggtcttcctctctcagccctaaggtaaaatatatagttttcttatattttatagacactcttttatcagagtttattaattcttcacataaaacttagcctgcttaacccactgattaggcccaaatacaactatgtttaaaaggaagacacgataaaaaaaaaatctgtattaattgatattaactttaatcttcttatagaaacgctatattcttatattaaaaaggtattttcccagcaatagctaaaaacaccctaatcagagagagagagagggagggagggaggaagggagggggagggggagagaaagaaagacagaaaaagaaagagaaaaagaaagaaagaaagagaaagagaaagaaagaaagaaaagaaagaaagaaaaagaaaagaagaaaagaaaaggaggagagaaaatcagtgttgagattgaaggaataaccaagtgtctttcacaatggatttttttgttccttttaaaaagagacagagtctcgctctgtcaccccagctggagtgcagtggcgagatctctgctcactgcaacctccacctcccaggttcaagaggttctcccacctcagcctcccaagtagctggggttataggcatgcatcatcacgcccggctaatttttgtatttttagtagagacgggatttcaccatgttggccaggctggtcttggacttctgacctcaagtgatccatctgccttggcctcccaaagtgctggattacaggcatgagccaccgtgcagagccaaacaaaacaaagactaagtaggagaaaattaaaactagcagtcacttagcttattcacattgggaggaagataatatatatacttctcgccagagctacaagcaatattactgatgttagtttctttttataaaacttaacatttaagaaggctatcaaatcaaaagcataaaactgaaggactgttctacagaaatattcaatcaattaaaaaaaaaaaagatgaaaaataccattcctcaaaaatcctgatggtcatccatttttcctctctctctctgctgaattaagcttttatattggtcttgcaaattttaaaacacctggaaaaaatgttattttttttttaatttcagagctctctaaaatgcataagataccaagttaatttgtattctttgttactcacatggacaaactgcaggaaaaagtgataactttaaaggatttacctattcttccacttaagctttacgagaggtaaaaactcaaggcaaaataattcttatgccacaaataacatgtctaaaatcccccacgggagacatggaggacatataaggagagtgtagggattgctactcaggctcaattcagctggctaggaccctcatgcaggaaaccgatgaaatggtctccacatgcatacactattcacctcctggtctttaacatctaagaagccaagggagagcagagttacagcatttcaaataaatgtcggattgtgacagcacatagaagacagactgtaagcttgtctttggaaggaaaagcaaatggctgaaaatcactacagaagggaacccactcttcacaaaattttccatctgtcaacagtattattcaaatcagtactacaagtgatcatgtaataattgtattgttttaatcagaggctttcaaggtatgtaacagaaaacacattcaaatatagacccatatgaattaatttcttcatacgtaatatgttaaacatctctgtaagacaaaacaggagaaaaataaaaatgaacaagtagtaattactggtaggctgccaaaagcaggttttcagtaagtgacctgtatcttcaaactcatctgccttatgagccaggtcaaattaagagaatcagcccttgaaaattcatcatgaacacagaagtaggtgggcccagtgggctagcctctgcgtcagggctgagcagtgccagtcctggaggaagttcatccttcatcctgtccataaacacacatcttggcagaaggtttctacccagggaaatctgtggtttcagtgaatcacaaaagcaataaaatccaaattcctggacaattgtgacctggacagtaactgtctgaaaattaactgagagaagacatttactcctttaccctacaaagtaagtgccacagtcttagaaaattggcatcaagaacagtaatcaatatatatttagactgcaattacttctctccgtgttcaccactaccactttcacctctctgagccaacacaatagcctcctacttggtcactgtcctatgtttatcccctgtgcacagcatccagaaagctcttttaaagtataaatcatcaacgagtaaattttcaaatattttctaatgggccataaaacataatgctttatgatgcacattaatgatatggttattttaagttatatactaaaatcatttttaaaaatatgcaacccactgcatctccttactgcctgcatctggggcagactgctccctgaccaaactctacatgcaggcaaccataaataatgtgagtaacaaaatacctcttcccctagaagcagattcctaccaggcccattccacccccttggaaagttattgctgcatttctctgagatctcactgtctaccttactaacttactaagttactacctaccttacttactaagctctaagtcatgctatttttcttttcggtccctagtaaataccaaacttgctcccatttcagttttagcagcctagaatccccactttcctaatctttacataactgcttctcatcattcaagtctcaatagtgttaccccctcagaaagatttctttcataatcctaggtaagacagtcccactttccaatcattccctataccatcactctattttattctaaatacttatcgttacttcaaattatgcaatttacatgtttaagtatgtactgtcgctctccctcaaccaaaatgtaagtcccatgagggcaaagactttatcttcagccctagaaagttctacgtacttcagccctagaaagttaatgtactatgagtatgcacatagtacatactcaacgaatgtttgttaatcactaatagctaaatgaatgactaggcaatggagacaataaaaacaagggaatagcaaacaaagtgtggcatagtggaaaaagtagacagtctggagccacactgcctgggtttgtttcccagctttgtcatttatttaatagttgtgtgagttttagcaagacacttactgtgcctgacacaaattaagtgctacataagtgtttcctattatcattatcttttaggctgcctcagattcaacaagagaaggcactgagcttctagattctaccaggtaagaagtgtcaggaccagtatggaaaagtggccctgccaaaaccccatcattacagaactgctggactgttcagtctggctcagagccagggagtctgcatcactcacatcaaattctatgtgaatgttgcctgttggagttatgcaattgagcagcctttgctagccataattgggagaataaaagccctaacacagtatagctgcaatatttacaaccaaataccctctatgtcccttttgcttcctccaactttttcaaccaccatataaggttctatcttctcaccctgtgggcacaatttagttgccatttacctcccatcaatttcactgcattcatctccagccatatcatgtaacggtgggaataagaatggtggtccaagaacatctgggccaacatctgaggagtcctccagtcttgacaagcaagtctgagttccaactctatcgcttaagacctagataaccattcctttccaaccccttcttcttctaacatgtcttaatatagtaggggagaggacataagcatgatgggggaaggggttcttgttaatctgaaaagatgagaggttcacaattgctacaccttattacagcatagctttataaatggagtcagtaaaaactagctacctcatgaaaactctgtaaatcgttaaaaactactgcttggaaatttaaagaaaattaatcttattaagtattgagaaaagcagactgtaaattccaatttcaacatcaccagccaataaaccatgactgtaagttacaacatctttaaacgtattccaagagtcaatcccagtaactgccttcatttttaagtagacaggattcaattatcgtattctaaccaattaagaataatttatttcaaatgtatttttaagccaggtaataaaaaagattcaaaactcaaaaatttcataatgtaaaaaacaaattattctgttgttctatgtgcttatattaaaatttctaataataatgatcttcaactatactcccattttcccttcatccatgacaatctttaaagcagcttgtcaaaaagagatttacagagctacagcacagtggtaggccaggactaattatctaaatgtattcctgttacaatcatctatagatttataaccaataacctcctgttctattactttttaaaactactgtatattaagaaaatgttatttctcttggccgaaattagtttattactttcctagatgcagagggccagaaacaaatttaatatgcaattgagttcatttttacttcactcagaaagcaagccaaagtcataaggtaaaaacaaaaatattttaatttttgaaagactgacaaaaagatacccccattatgttcactgtaatctttccaacatttattatgtaggtaattctctctttaatacaaatcctttatgcttctggagagaaagtgtaaagtagaaaacactattaatctgttaatgattatccactgacaaataacacaagctttcaaaacaaaggggccaccaatggtcactggagatgcagtatgcaatgcaacatttcttaacttttgcttctcaccaggataggatcatctgaagagcttttaaaaaatactaatgtgcaggacccactccagaccaattacctgatttccctggcatctgtacttttgaaagctccccagatgattctaatatatagccagcgttaacaacctccagatgtaacaaaaaacatagtcatgcttcatttaacgatgaggatagattctgagaaatgcatcaggcaatttcatcatgcgaacatcatagaatgtacttagaaaacctagagagtacagattactacacaactaggctatatggtataacctattgctcctaggctataaacctatatggtatgtgcaaaccaggaaaaggtacagtaaaaataccatataaaatatttttaaaaggcacccctgtatagtgcacgtaccatcaatggagcttgcagggctgactctgggtgagtcaacaagtgagtgatgagtgaatgtgaaggcctaggacattactatactctactgtagactttgtaaacactgtacatttaagttacattgaatttatttaaaaattaacttaagcttactatagctttttcactttataaacattttcaacttttgagtcttttgtaataacacttagcttaaaacaaacacgtacagccgcataaaaacattttttatatccttattctatgaaacttatttaaaaatttatttttttaacttaagactttttgttaaaaactaagacacaaatacacacattagcctaggcctacaaagtgggaggatcatcaatatcactgtcttccacctccacatcttgtcccactgcaaagtctttaggggcaataacatgagtgaagctgtcatctccaatgaaaacgatgccttccagaatacctcttgaaggaccttcctattttacagctaactttttctaataagtagaaggtgaacactctaaaataatgaaaaaagtaaatagtaacatagtcgtttatcattatcaattactgtacataattatatgtgctagacatttatccaactggcagcacatttgtttatgacagtatcaccacaaatctatgagtaatgcattgtgctatgatggtacaagggctatcaggttactaggccataagaatttttcagttccattataatcttaagggaccactatcatacatgcagtccactgttgactgaaacatcataatgcagagcatgattgtacattcacttcagaatcagggatctaggttcaaattctggttccacctcttggtagttctgtgaactcatttcctcatttgcaaagatggtaatatttatctaattcttgtgaggaatcactctaggcctgggatatcacaggaatttagtaagcctaataagctcctccattctatttcaaatctacctaatctgtacatggtagctacatggaaaatacctctataaagaagttcccaatttgcaaacagttcatattgtgaatctggagtttaattaaaacaggagatagaaaaaacagcatgctcaaacaagtttttattttgtaggacctgtgtagagtgaaatctatcaaaccccttgctcccattatgcacttaattgagtaacaggagctgtagagaattaaaaagcaaaaaccaaaataaaacaagtacacaagagattgttcctttcacttaacatgtagttggggaagccaaattgacacaagttatcacaatttctaataagtctgatgaatcctttattttgcacttgtaatgcttgatggctcaagtccttcccacccacccccactccccatctcctcaaacggcagagatgaccaagtaatacaacataggtagatcccgtctctaacaaaaaaaaaaaattagccaagcattggtggtgtatgccagtagtaccagctacttgggagactgatatgggaagactgattgcctgaacccaggaggtcaaggctgcagtgagccatgaccttaccactgcatcttagcctgggtgacagagcaaggaggccctgaataaaaaaaaaaggctagtcaaaagtgctattaaaaacaaacaatactagagtgagaaatagggaaaagctgttggttctcattacagtgggaccagtgatgacttttatcaataacttatacacttgtaaagaatttagcaatttaaaaaaccctaggattttatattgtttaattttcacacaacttactgatatagctctcctcattgtagagaggagaaaattgcagctcaaagcagctacatgacatgcccagggtcatcaggctagtagctgctagtgggtgataccatgacacagaagatttttagttacatttctataaataaaacagcttgtttgctaacattcaatgttcagccaattcaggataacttatgactgagatctgggaaactattaatgaatggcatgttcatattatcaaaaattccagggttctatgcttcaaaaattatggtaacatctggtatagtaattcaacaaatctcatctcctgtagtatttagagatgacagaacagcacagctagcagtagctgctactacagaaataaatattacttgtttcaacatgttcattaagccataattcttcaatgagtacatgaagaaaggcattgtgataatcaattgaaaatattactcagtaactattctttaaaagaagacaaggacaataatgagtgaaactgaaaaatctcatcttagttcaacttttagctactggactgttcaagaagtattttcctcaaaactgttatataacaactaattcactgcaaaacaagttggctgaaaattatatatatttctcaaaacatatggcccacccagaattttacaaattatactttattacctataattggcttattgtggactaaatattattgttttaaatgtatcccataacttttagggatacgtgatatacatagtgtatcctgttaggtccaaaacttcaatcaggatttccaggaatcctaacagtaaaaataagaataaagttattaaaatttgaaattatcctcccagtgtttctcaaattttttcatttacagctcagatatctgaattgcattactctactgagtactaacacctgaaaataaataatgctaaaaatactggtgagaatgagctgtattataattgtaaagcatttcccctttcaacaagtccatgaagttgttttccttctcttctcacttcctatatttcccttcatcaccttgtctcttctgctcctttcttacattctaggtagacaaatattaatcctttttcatctttcaaaaaatatgtaaaagagttatagagttttttaaatcttacataaaaataatgacttttaaatacatgaaaagtacatgcaggttaaaatacctgtgggacaaaatctaagcattaacaaaaacaagaagatagtttaagaaaaaatagttgcaaaagcactattcacggtagcaaagagttggaacccaaatgtctatcaatgatagactggattaagacaatgtggcacatataaaccatggaatactatgcagccataaaaaggatgtgttcatgtcctttgcagggacatggatgaagctggaaaccatcattctcagcaaactatcacaagcacagaaaaccagacactgcatgttctcactcataggggggaactgaaaaatcagacacttggacacagggcagggaacatcacacactgaggcctgtcggtgggtgggggcctgggggaagggatagcattaggagaaatatccaatgtaaatgacaagtttatgggtgcagcaaaccaacatggcacatgtatacttatgtaacaaacctgcacgttgtgcacatgtaccctagaacttaaagtataattttttaaaaaagaaaaaatagccacaaaatcttgacattctgagtgtggcttggaatttgaaatttaactacaattagaattatgaaaattaactccaatttgaaatgctgtttgggatacttttatatccttctaacgggaaagagagaaatacactaaatgtaaaagagctccaggaacttaagcatagtctggatactaaagggatactgtgcgaagaaatgcttcttaagtagaaaagcactttgaagacgataatcaggactaaacatgctttattttagatgaacaaacgtgttcattttacccctctttttcataagttgcttattttttccagtgtttgggtaaaaaccttgcaattctctgaatgctaattaaaataccagtggcacagatagttttagtcttaaatgtgattttcacataaaaggattctgaacgttacatagcttctaaagtagtaaaagagaaacagtatccaatgagtaacaagaaactagcactgcaacagaactgcactgactttcttgattcaggagatgacattattaatatacagaattttaacagccagaattcatcactatagccactaatcagaactggtctatacaggccaagttcaagaacataaaatgtcacaggggtcaggtgtgggggcttgacattctcaatacaaatgatttctaggcttttgtttaaaagcatgtgacacctggaaatgcgtaatacatgaaccagcattaactactgattgttgagttaaaatgtgtatctagccatccataccctagaaaggtaataaaggaatggaacagagactaggcaagtttaaattagagttaaagagtgggaaagaagagttgttaaaatatgcagagatagatcaagtgagctagagctgaaaggaaaatacacagaacacacattatttcaaaaaatgtaagcagaatgtcttactgcaacgacagcatactattgattcatttgtcatttagtagtcacctcagaaaaagtaaataatcaccatcatccagaaacagttatggttaagtttgcaatgagaagtttacatagttcaccaggcaaaacagttcacacctacaatcccagctaaatccctttgtttaaaaaagaatatagttacacatgcagccaaataagtcattatgacaacaggacatactagttctcaagggaagaattgctggaatagatgagaaacttcataaatgggttagcccacactgtgaactttgaaacatatctggcacagctgttgtgatggcagtgataattcacgtgaagtacccagaacagaacttggaatgagttaaaatgcactcaacaagtggtcactgctactttaaatgagaagcagttttacctattaactccacatcatttccctctagagtagtggttctcctaagagtatggtggtaattagggtgataatggtagagatgaaaagtcaataaataggggtttattttggaggtagtattgacagagcctattgttaggctggatgtagaagttgggttgaaaaaaatgaaacaattattaccgggggagcgggcagtgtgctactggcatctagtctgtagaggccagaagtgctgctaaagattacacaatgcacaggacagccccaaccctcacagccacatcaaagaattatccagtccaaaaaagtcaacagtgcagaggttgggaaaccctgctccacaggagtggttcccaaactttagtgagtcaaaaccttctggaagacttgctgaaacaggctgctgggacttacccagagtttctgattcagctgatctagggcagagtctcgctctgtcacccaggctggagtgcagtggcaccatctcgactcacttcaacctccgcctcccaggttcaagtgattctcctgcctcagcctcctgagtagctcggattagaggcgtgtgccatgcctaatttttatatttttagtagagatggggtttcaccacgttggtcaggctggtcttgaactcctgaccttgtgatccactcacctcggcctcccaaagtgctgggattacaggcatgagccactgcacccggccggtctagggtatatttctaatcagttcccaagtaacactaatgcttttggcacactttgggaaacactgatctacagaaaggtggtaagaagctaacagacaaaacaaaaaaggattagaaaagtaagtacatctaaagttttccattctcttaaagaaaatcataaagttcttaaaaagttttccattctcgagttgataagatggctgaataggaaaagttccggtctgcagctcccagcgagacaaacacagaaggcggcaggtgatttctgcatttccaactgaggtacccaggtcatcttgttgggaccggttaggcagtggatccaacccatggagggtgaccagaagcagggtggggcattccttcacccaggatgtgcaagaagccagggagcctccctcccccagccaagggaagccatgaggtactgtgctacccggctgggttactacacttttcccatggtttctgcaatctgcagatcaggagattccctcatgtagcctacaccaccagggccctgggtttcaagcacaaaactgggcagccatttgggcagacaccgagctagctgcaggagtctttttcgtacttcagtggcgcctggaaccccagagagacagaaccattcattcccctggaaagggtgctgaagccacagagtcaagtggtctcgctcagtgggtcccactcctacggagcccagcaagctaagaaccactggcttgaaactctcactgccagcacagcagtctaaagtcgacctggaatgatcaagcttggtgcggggaggggcatctgacattactgaggctttactaggcagttttcctctgacagtgctaaggagtctgggaggtctggactgagcggaattcaccacagtccaacaaagtggctgtggccagagtccttctctagattcctcctcattgggcagggcatctctgaaggaaaggtaatggccccactcatgggctaacagacaaaacccccatctccctgggacacagcacctgggggaaggggcggctgtgggtgcagctccagcggatttaatcattcctgcctgctgactctgaagagaggagctgatcctgacaagacggattctcccagcacagaacaccagctctgctaagggaccgactgcctcaagtgggtctctgatccccatgcctcctgactgggagagacctcccaacaggggtcagcagacacctcaaacaagagagctctggctggcatcaggccggtgcccctctgggacgaagcttccagaggaagtagcaggcagcaatctttgctgttctacagcctccactggtgatacccaggcgaacagggtctagagtggacttccagcaaactgcagcagacctgcagaagaggggccctaacaaaaagaaaatacaacatcaacatcaacataaaggacccccacaaaaaaactccatccaaaggtcattagcctccaagatcaaaggtagataaatccacaaagatggaaaaaaaaaaaaaaacagcacaaaaatgctgaagattcaaaaaaccagaatgcctcttctccaaatgatctcaattcctctccagcaagggcacaaaactggatgaagaatgaagttgatgaattgacagaagaaggcttcagaaggtgggtaataacaaactcttctgagctaaaggagcatgttctaacccaatgcaaggaagctaagaatcttgataaaaggttataggaaatgctaactagaataacccgttttgagaggaacacaaatgacctgatggagctgaaaaacacagcacaagaactttgtgaagcatatacaagtatcaatagccaaactgatcaagtggaagaaaggatatcagagattgaagatcaacttactgaaaaaaagtatgaacacaagattagagaaaaaagaataaaaaggaacgaatgaagcctccaagaaatatgggactatgtgaaaagaccaaacttacaatcggtgtacctgaaaatgatggggaaaatggaaccaagttggaaaacacacttcggggtattatccaggagaacttcccccaccaagcaagacaggccaacattcaaattcaggaaatacagagaacaccactaagatactcctaaagaagagcaaccccaagacacataatcatcagattctctaaggttgaaatgaaggaaaaaatgttaagggcagccagagagaaaggttaggtttcctacaaggggaagcccatcagactaacagcggatctctctgcagaaaccctacaagccagaagacagtgggagccaatatattcaacattcttaaagaaaagaattttcaacccagaatttcatatccagccaaactaagcttcataagcgaaggagaaatagaatcctttagagacaagcaaatgctaagggattttgtcatcaccaggcctgccctacaagagctcctgaaggaagcactacatatagaaaggaaaaaccagtaccagccactgcaaaaaacacaccaaaatataaagaccaacactatgaaaaaactgcatcaactaatgggcaaaaaaaccagctagtatcatgatggcaggatcaaattcacacataacaatattaaccttaaatgtaaatgggataaatgctccaattaaaagacacagactggcaaactggataaagcgtcaagacccatcagtgtgctgtattcaggagacccatctcacatgcaaagacacacataggttcaaaataaagagattgaggaatatttaccaagcaaatggaaagcaaaaaaaaaaaaaaaaaaagcaggggttgcaatcctagtccctgataaaacagactttaaaccaacaaagatcaaaaaagacaaagaagggcatgacataatggtaaagggatcaatgcaacaacaagagctaactatcctaaatatatgtgcacccaatacaggagcatccagattcataaaacaagttcttcaagatctacgaagagacttgaactcccacacaataatagtgggggattttaaccccccactgtcaatattacacagatcaacgagacataaaattaacaaggatattcaggacttgaactcagctctggaccaagtggacctaatagacatcaacagaactctccatcccaaatcaacagaatacacattcttctcagcaccacatagcatgtgtattctaaaatcgaccacataattgaaagtaaaacactcctctgcaagtgcaaaataatggaaatcataataaacactctcacagaccacagtgcaatcaaattagaactcaagatgaagaaactaactcaaaactgtacaactacatgaaaaccgctcctaaataactacttggtaaataacgaaattaaggcagaaataaagaagtgctttgaaatcaatgagaaaaaagagacaacgtaccagaatctctgagacacagctaaagcagtgctaagagggaaatttatagcactaaatgcccacatcagaaagctcgaaagatctaaaatcgacaccctaacatcacaatcaaaagaattagagaagcaagagcaaacaaattcaaaagctagcacaagacaagaataattaagatcagagcagaattgaaggagatggagacatgaaaaaccctcaaaaaaaaaaaatcaatgaatccagcagctggttttttgaaaagattaacaaaatagaccactagctagactaataaagaagaaaagagagaagaatcaaatagacacaataaaaaatgataaaggggatatcatcactgatctcacaaaaatacaaaccaccatcagagaatattataaacacctctatgtaaataaactagacattctagaagaaatggataaattattggacacatacacactgccaagactaaaccagaagaagttgaatccctgactagaacaataacaagttctgaaattgaggcagtaattaatagcctaccaaccaaaaaagtccaggaccagacggattcacagctgaattctaccacaggtacaaagaggaactggtaccaccattccttctgaaactattccaaacaatagaaaaagagggactcctccctaactcattttatgaggccctaactcattttatgataccaaaacctggcagagacacaacaaaaaaagaaaatttcaggccaatatccctgatgaacatcaatgtgaaaatcctcaagaaaattctggcaaaccgaatccagcagcacatcaaaaagcttatccaccacgatcatgttggcttcatccctgggatgcaaggctgattcaacacacacaaatcaataaatgtaatccatcacataaacagaaccaatgacaaaaaccacatgattctctcaatagatgcagaaaaggccttaggtaaaattcaacatcccttcatgctaaaaactctcaataagctaggtattgatggaacatatctcaaaatagtaagagctatttatgacaaacccatagtcaatatcatacggaatgggcaaaagctggaagcattccctttgaaaacggccacaagacaaggatgccctctctcaccactcctattcaacatagtactggaagttctggccagggcaatcaggcaagagaaaaaataaagggtattcaaataggaagtctaattgtctctgtttgcagatgacatgattgtatacttagaaaaccccatcgtctcagcccaaaaactccttaagctgttaataaacttcagcaaagtctcagcatacaaaatctatttgcaaaaatcacaagcattcctatacaccaacagcaaagaagcagagagtcaaatcatgagtgaactcccattcacaattgctacaaagacaatgaaatacctaggaatccaacttacaagtgacatgaaggacctcttcaagaactacaaaccactgctcaaggaaatgagaggacacaaacaaatggaaaaacattccatgctcatggataggaagaatcagtatcatgaaaatggccatactgcccaaagtaatttacagattcaacgctattcccatcaagctaccattgactttctttgcagaattacaaaaaaactactttaaatttcatatggaaccaaaaaagagcctgtatagccaagacaatcctaagcaaaaagaacgaagctggaggcatcatgctacctgacttcaaactatattacaaggccacagtaaccaaaacagcatggtactggtaccaaaacagatatatagaccaatggaacagaacagagacctcagaaataccaccacaaatctacaaccatctgatcttcgacaaaccagacaaaaacaagcaatggggaaaggattcctatttaataaatggttctgggaaaactggctagccatatgcagaaaacaggaattggacctattccttacaccttatacaaaaatgaactcaaggtggataaaaagacttaaatgtcaagcccaaaaccataaaaaccctacaagaaaacataggtaataccattcaggacataggcatgggaaaagacttcatgactaaaacaccaaaagcaatgggaacaaaaaccaaaattgacaaatgggatgtaatcaaactaaacagcttctgcacagcaaaagaaactatcatcagagtgactaaacagcttctgcacagcaaaagaaactatcatcagagtgaagaggcaacctacagaatgggagaaaatttctgcaatctacctatcagacaaaggtctaatatctagaatctacaaggaacttaaacaaatttacaagaaaaaaagaaacccatcaaaaagtgggcgaaggatatgagcaggcacttctcaaaagaagacatttatgtggcaaacaaacatgaaaaaaagctcatcttcactgatcattagagaaatgcaaatcaaaaccacaatgagatactatcttacaccagttagaatggggattattaaaaagtcaggaaacaacagatgctggcaaggttgtggagaaataggaacacttttacactgttggtgcgagtgtaaattagttcaaccattgtggaacagtgtggcaattcctcaaggatctacagccagaaataccatttgacccagcaatcccattactgagtatattcccaaaggattataaatcattctactataaagacacatgcaaatgtatgtttactgcagcactatttacaatagcaaagacttggaaccaacccaaatgcccatcaatgttagactggatagagaaaatgtgtcacatatataccatggaatactacgcagccataaaaaagaatgattttgtatcctctgcagagacatgaatgaagctagaagccattatcctcggcaaactaacacaggaacagaaaaccaaacaccacatgttctcactcattagtgggagctgaacaacaagaacacatgggacacagggagaggaacatcacacacacgggggcctgtcggtgggttgggggcaagcagagggggaacattaggacaaatacctaatgtatgcaaggcttaaaacatagatgacgggttgataggtgcagcaaaccaccatggcacatgcatacctatgtaacaaacctgcaccttctgcacatgtatcctagaacttaaagtaaaataaaataaaagttttccattctctgattggtgcgtttacaatccctgagctagacacaaaggttctccacatccccactagattagctagatacaaagtgtcgacacaaaggttctccaagtccccaccagagtagctagttacagagtgtcgattggtgcattcacaaaccctgagctagacacagggtgctgattggtgtgtttacaaaccttgagctagatacagagtgctgattggtgtatttacaacccctgagctagacataaaggttctccacgtccccaccagactcaggagcccagctggcttcaccggggctgctggtggagctgcctgccagtcccgcgccgtgccccgcactcctcagcccttgggtggtcgatgggactgggcgccgtggagcagagggcggcactcgtcagggaggcttggccgcacaggagcccatggaaggggtgggaggctcaggcatggcgggctgcaggtcccgagccctgccccgcgggaaggcagctaaggccaggtgagaaatcgagtgcagcgccggtgggccgtcactgctgggggacccagtacaccctccgcagccgctggcccgggtgctaagcccctcattgcccggggccggcagggccggccggctgctccgagtgcggggtccgccaagcccacacccacccggaactccagctggcccgcaagcgccgcgcacatccccggttcccgctcgcgcctctccctccacacctccctgcatgctgagggagccggctccagccttggccagcccagaaaggggctcccacagtgcagcggtgggctgaagggctcaagtgcccccaaagtaggagcccaggcagaggagacgccgagagcgagcaagggctgtgaggactgccagcacgctgtcacctctcattagtataatctgtattgcactgcgaaataactgcctaaatgtttcaccaagttttattatccatgatactcactgccaagtctacccaaaacactgtagaaggctatagtccaaattattacaaagttaatttattcacttaaatcaagtaatttcaggagcaatccttctccagaagcttagcaaattttttactgctttatattaaaatgcaaatgcatgaactctaaaaatctcaccattatttttaattacagaaagaacaccaagagactgatttaaaatatataatatatatagtaaaatgcttgtttgttccatagtaaaacttaattgaatgctcaagcaggttacaaatttgctttaagcaactttctcacgaagttgtagattcttaaatgccacacacagagtttcaggttggaattattcaccttcctgcaaaacgtactacaggcaaataataataataacaaaaatgacctaattagctcagctatatgtacaaaaaaagcaaacataaatgaggtggctccatatttcattgctttgtatgactgtgacacattcactgccatattcctgaagctaaaattcctatactaatttgcaaagtaaacacagtacgaaactagaagctgcagcattagattctagtctattatgcattctccatctgctgtcccacactcacaatatttaattttagcaaaatctaattcagtgtatctctacatgaatgcctcattagacatctcaaacttttagcctccaagatggcctctcaaataggctttacttcccatctcattatctaatatttcatatctcagtataaagcaccactctccatgcagctgcccaaatcataacccaggaataattccttccttgtttttaacccatcctctacatccagcctaacaacaggctctgccaatctacctctaaaataagccccaaatttactgacttttctccatctctcccaacatcaccctaaatatcaccatattcttatacctaagactattactagagccactttcattctggactcctattccattctacattgaacagctcttatatcatattctacatctcatcactcccctgcttaaaagtcctccaatagcttaaaatccaaattgttttccttggcctacaaggccttagataatttggttctttctcatctctccaaactcatctcgggccacacttcctcctcagtcactacacctaagacatgcttatcttcttttgacttctcaaaacatacctattgtggactgaatgtttacatccccctataattcatgttgaaatcctaacctccaacatgatagataaagtggtggggcatttgggagctgattaggtcataagggcggagtcctcataaatggaattactgtccttagaaaacagaccccagagaaagctctgttttagtctgtgaggacacaaagagaagatagctatgaatcaggaagagggccctcatcagacactgaattgcaggcaccttcctcttggactctctagccgctagattgtgaaaataatcagacgtcttccctaatcaccttaatgtaaacaggtccaattctaattggtcaatattctcagcactttattgctttcaaaatagtataaacgaagctttgtgtactggcaatatcataaccaatgaggttcatccaagacatgataattgctaatggcaaacagcataaaaccaactgccaaaaaaatgctttgcatcccacaagaactagatatagacaagtgccatttttgctacacagaatgctttaaaaaaaaaaatggtgggaaatagagaagggtatccttgaagaaaaacctgtgtttatctacacttttaaaagctatgcataggattagttctctggaagtgcctagaatattcccactttagtgcctttgctcttgctgttccctctgcctaggaagtttttaatcccagataaatatgcatgatctcctaaactgcttcaggtcttcatttaatgtcatccaatcagtgaggacttccctgaccatcctatttaaaataacaacgccctttcccaacaaagtcctttctcatcttcctttgctttttctctcatggcactcatcatcataggacacataatacatatcaccactggtatagaccactggtctgatatgaccactggtatagactcccacttggtccttttcaattcccatttgcttctttctaattcattaaccatactgcagccaaagggatgtcttaaaaagggaaatctgattctgttataggtctgcttaaaatgtttcactggtctcctaccatcccactctctgttcctcctgccagggattaagttcaatattgttaaaatggcctacaaagccctgaacaggcagcgtctctgcctgacttccagtttgacctccttaccactctcgatcttgatcaccacattctagtcagttctcagaacttagtaggctctttgcttctgaacctagcccagatcattccctcagcctgaaacaactttcatcacaaccacaccactctctctagcccttcctccttcctctacaactccagttataaatgtaacaattacgtaaaagtgatctgtttaatgcctggctcctctgctaccctacacattcagagggaagggatcgtgcctgtcatatttaccccagcgtcccctgtgcttagcacagaggctggcacatagtaggttcttatactggctagctaatccacactactacggtccgggcatgattctcctataatgaagactgaatttgcagccatgaagatcaaagacaatgaatgttgtttccaagacttgattaaacatgagagtataaaatctgtgagaaatatttgtggcaatggaagaaagaaaaatttccaaaaactcacacagacaaggaatgaaaaataatagatgaaacaaggctggccatatactggtaacagatgagactgagtgaccgatatagattcattctactattttctttgctcttatttatacaatgtaatctcagtgttccaaagactgataaaaatctgaattttgctaaagactgtaaaaaaggaagcttatccaatatcagtctttcaatgagaaaaaaggttcaagaagagtagttatgcctcctacagttctacttaggaatctacttttacaccacctgcaactacaacagaacctgacactgtaacaaaaaacacagaaattaaagactcaaaatagatacacaggtagtagctgcatcaagtctaaaaactcttgtttctgttttagtagtttttctatgttaccacagttatttctggaaagttatctatttccttctacctagtaagtcctgcttaaaaagaccgagaaggagggggatgggagaacaataaatattattcacccaggaagtccttttgaaatgaactgaaaacatctatcatcagaattaaggtgtatgtgattattgctttacaatccttgaatttgagtcttatgaggcattaccaccttcgtatttgtaataaaactccagctttacagacatcacctaggggaagggaagggaattggggaaggggtagaaaagaaaagaaagaaaagtccagcttagagagaaaagtgacctgccatgatcatacaactgataagagacacagcaataaataaatagatcaggtctggtgctccatctcaaaacaataatttctcagtctacttattctactataagcagaagtagtaaaaacaaggcaatgcaatgacaacccaccagtctatatcacacaaacctccaaagagctggaacggctgcatttaacttttatgttacctaccaaacaaaagtattttccaaatgtcgtgacttgttataaaattaccattagctaatcaccatctcctcttaaaaaccagttttaagttaaaatggcacactatcaaataattattgtctctaaaatattaattagttgaaaaagcctaaccacattttagaaacactgtacacttttaacatattagcagttaaaccttgcgtttatttgcaggtctacagaacgtatctaatgccaaccctccccgcctttttgggattgtatactccgaaaagcaagaaactaagtcatggtaaaaacattttttatagatttcctcaaatcactagcttataagaaaaacaacttgatattaaataggtaatagcctgcacttgcagtaacaactgctcataaataaaaatgctactttcttttatttcttgtggccattaactttatttcacagagaggttaaatatttttatatataaaatgaaaactcataaaaaaaacactgaaaggcacagtatgtcctaaatgagttttcttggtttcataagcttttcttatttctctttcacagagttctgagaaattaaaattagcatttgaaagtattcaaaaattgtttaaactgttgtttagctgttataatctacaagtgcagttctaaatgaaataaatgtgccatctattatgtcacaatattgagaaatttacaattgcactaacagaaaggtttaatatctctgacttcacaaattaataaaaacttcttttggaagaaaaaactctacataaaatccaattccataaataaattcaaacaagacacttcctttagtttaataggaaactacttatgaaaaattgttaatattatttcctgttagtattagaaaggaataaaataaagaagtcatgcagttaatatttagtttctctactctctgccaaagaccacactaggtgctggggatacaaaaatgtaagatgtaccccaaccaggctaactgataggccagcaaaatacataaaccatataactataccagagtgtgataaaatacaagagaaaaaaatgcctaaatggacaaaaggtcatgaaagttgaaagcattaacagttctgcctccacttttctataaagctctgtgaagacaggagccatgtttgtcccatcagtgctggatgatcactagcccctagcataatgtcagatatacacaaggtgctcaataaatatctgttgactaaaacaataaaagaaggaaagcttcttatagaaagtgacaactgagatgagcattaaagcatcagtaggagttaaagggaaaaaagtattcctgataaaagaaacagaatagaaaacatccaccttttacccatttacattaattaacattcagcattttactccaaaatatattttctacaagcaacatttaccaagctaaagatttccgaaatgaatattctcattctgaataaacagaaaataaagtaccaaggactccagtatccacagcatacctctcattagactttgctgtggagatctctcacaagactactcagtcttagaagtatgttagctcaattacagtagtgtaagcttattcataatcatcacaaataaaaccaaacataatagctacaaaaataatttataaccaaaaacaaaatggaataaagtatattttaaccaaacattattaagttggatttaatcaaacgtcactttaaaattaatttaataaaatttaataaagaaaactttacaacagtcacataagaaacaatatgagccaaggcagaaatagaaaaaaagtaattttatgccccaaaaaattgtaataaatgcagttattagactaagtcagctacattatgttatacccagttctgaatgtgtaacattttgagtcagacttcaggtcaaagataaacatgagctgtagcttggttaaccaaccttttatgggctgacaagcattttcttaaaaggccagacaataaatatgttaggcttgtgggccacatagtctcctcataatgatttaactctgctaccgaaagtagccaacgacaatacataagtgaatgagtgtggccgggttccagtaaatctttatttacaaaagcagatggctggcccatgatcgtatttgccagccctctcctggaatctaaaagtgacttctcactaactcttttcatcaagaccgctttactccctttcaaatactttcacacaaactgtattagtgtttcataaggcctctacagatatcaatgaagcaaacctaacagatattctcttgttttatagattaagaaactgggccgggcgcggtggctcacgcctgtaatcccagcactttgggaggccgaggcgggtggatcacgaggtcaggagatcgagaccatcctggctaacatggtgaaaccccgtctctactaaaaatacaaaaaattagccaggcacggtggcagccacctgtagtcccagctattcgggaggctgaggcaggagaatggcgtgaacccgggaagcggagcttgcagtgagccgagatcatgccactgcactccagcctgggcgacagagcgagactctgtctccaaaaaaaaaaaaaaaagaaactgaagctcaaagcagttgacttgacctaaggactactaagacctgaaactaaaaaccaggcctttgttgttcttctaacacttaatcattatcctccatacccaatcttccaatgccccaaataaaacatttaaatcagttttagaatcctctgctgaacccctgagttctttttaacagactcagccattcacaatagactctaagaacacctacttaactgtctaattaaattattaacttcaattgtgaagttaactcaaatccttctctctttacacgatcctcatctttttctatttaggctatcttcttatttacaagtctcctaaaatatcatttaatcttcaaatcaccagcaagaaacaaggcactacaccttcttaaggaggtgtaaattattgtaatcatttaataagaatttgtgaactcagtaataaaaatgtggtacggggcctagtgcttaactttgcaaagcttataacctagttgagaaatgccagatgtataaatatgaaactaaggagtgactccatgtaacctaggtaaaatctaaaaattttaaaacaaagaaatgagaaatgaaaaaatgtaatttacagtatacactgtcataaaatgcatgccttacttgctcttgataccacagaaatgccctaattttgtaaaaggaaagtttaacaaatactaaatacctacaaacacccatttgatgtggtaatagcatagtccaaaagttaaaactagatcacagtttttaaaaattatggcaggtgaaggttttcttctgttttattctagtcattgccatgaaagaacatctactggactaactccctggccaaaaacactgttgaagacacaggaattacaggacatgccctcactttgcatcataggatgggactgcagaagtaatcatgcaagttaaaactaagcaaagtgatcttaataactaatggggacaattacgattgttccacaatctttaaaaaattttgtcaaaacattaaaaactcttaccgttggttataaatatacactagaggctgagcatggtagctcatgcctataatcccagcactttgggaggccaaggcgggcagatcacttgaggccaggaattcgagaccagcctggccaacatggcaaaaccctgtttctactaaaaacacaaaattagctgtgcatgttggcacatgcttgtaatcccagctactcagaaggctgagacatgataatcgcttgaacctggaaggcaaaggatgcagtgagctgagattgtgccactgcattccagcctgggtgacagagtgaaacttcgtctcaacaaaacaaaacaaaacaccacaataaatgtatactgaacaataacaagttaaaagaaatcctaatatttatttagtacttataatttaacacattagaaacactgagaactgttttatttttaaattttattaattatttttttttagagacagggtctcactctgtcactcagagtggagtgtggtggcacaatcatggctcactgtaaccttgaactccttgggctcaagcaatcctcctgcctcagcctgcctaggactgtcggcacatgcgaccatgccctggctaatgtttagatttttttgcagtgatgaggtcttgctatgttgcccaggctggtctccaactcctagcctcaagtgatcctcccagttgggcctcctaaagaatgctgggattacaggaatgagccaccacacccagccaaaaatgttttatttctttgtaaaaacttaagaactatagtttgaagagtgcttgctttctcaacatataacttatgggcaagcatctttcccatgccttggtgaactgaagtcatttttctacattttaatcaacttctaatattttattatttgtatttcaatgtcataaaatatctgagagttcctttaatatgaaattttttatagcatcacttcctttgggacatcttcatccttttgtcacaactactttccttatttatgtcaataagttcacctttactgcatataagttcctcagtaagttcccctggctgcataatctagtctcttgaagggcagccatgtcaacatttccaaagtcagctattgcttccataactccatttctttctattcaaatttcattcccaacattatcagtttgtttctttgttggatttacatctctcttggccaattcccttttttcaattatccatttttataaaatgttacatgggcttattgctggagacaaggaggcaacacgactatgtgctttgctatctgtgggtaaaatgaataacagacatagagaggccaatcactgacagacatggaaagaagtgacataatttatcaccgatcataagctcatctgttgttatgtaatgattcctggactaaactagcaataaagtttgcattttatgtaattatctgcggttaatataccacagtaattgaaatttgaaccatacagttggggacctggtgttacttaactaaaccatgataactgaaattcatgcatactggaaccatggaaagggaggactatctgtacataaaataactgtttgaaggcactagagggtgatcaatgcaggcaagatcacagagttatttacattctccaaaatatgagggatacagagatgagcaccacattccacttagctttttccttgggagtattttctaaaccacagcaaggagaaagggaattgaagcacaaagcaagtctactgtcctgagaaagcagaggttggagttcaatccccacacgtggaggtatctttgtacatacccagaattttccactgtgaccacagaagggtcatgactaaggaataaagaccacatccttagagtaatggcatttccttcagaagctatacccaagtttatatgacatatgccatatgttaggggctgagcaatcagtctaatgctagagaatccatgaacagaggacaccaaaagagcagaatgtaagggatgactaaaagtagcttctgtgcaaatctgggcacagaggctacaatttaaacttgtaccaccaattctaaaatgtatcaactactcacagggttatggctgtatcatattttataaagtggtattctaaaattaaacactattatacttaccattttgcaatcccatccagagttgcttgtgatcttttttctgcatttcattgattacttgacttttatgttttaaagcatcagcttctttcatacatgacataaaatgagcttcaattgcatccttagatggacagtgcagaaggtctttttctggaaaactctatcaaaggaaaaaatatacatataaaacaggatacacacattacaaaattaacctcttaaaagagaactatatcccccagtttttcaatatttctagtaaactatctcttagcactgaaataacccaaaatactttaaaatttaacttaaaaatctttagctatttggcccattttgtacttttcccaaataattcttatgtgttttataacaacatgaaaaaaaggcatcaaagggtaataatctgaaaaatagcttttcaactgaccataccaatattggcaaagatgtggaatggagccctcacacactactaacagaaatgtaaaatagtataaccactttggaaaagtctggtagtttcttaagaagagtaaacagacacctaccatctgacccagccattccacaactaggcatttacctaagagaaatgaaagtattatgtcaaaaaaaaaaaaaaaagaaagaaaagaaaaaagtattatgtccatatgtccatttaaggacttgctacatgaatgttcacaatagttttatttgtaacagccccaaacagaaaacaaatctaaatatcaacaggtaaatgaacatataaattgtggcataaacttattcactttgactaggttaagcttactataagtcaattagacctcaataaagctgttaaaaaagtagattttaaagtcaaatagctaaatttacattctataacttcactgattcttttaggcagctaaagcaatgatcattggacatatagggagttaggtaaatgagacgactgatgcacttttcactgaaaaaaagataataacagctaacagttactgaacacttactgtgacaccgtattaaaactttttatatggattatcttatttaatcctaacaacacttgaggtaaacattattattattgctattttacagataaaaaaattaaagcttagggaatgtctcaagtcgcaagtgtcattcagcttgatagtcatggggctaggatttaaggctaatttgactcaagtcctacattttaaccactgtacaatatcacttcctccaaagacttaaatatttaagataatcattatattcaaacattattttacaaagttattatcctatatgtcctttaataaatttaaaaggagctaaaaatggcaaaaaaacagcatttagttatagcctactccggttactgtattcacaaacaacattcaattaaccctgtcatggagccttcataaaaagaatgaaatgaaaagataaagaaagaagctcctgagtgactatgaaacactgatggaaagcaggaattaattgaaagtgattaaagataccattcctcatctctctcaataaacttttttaaaagtcaaacttatgattcacatacagtgaaatgcagaaatcaagagtacaattaaatgagttttgacaatgagtaactgtcagcccaagtatacagcattaccatcacccacaaaagttcctctgtgccctttgcagtcagttccctcattcccttcccaaggaattactgataatgacataacaccagattagttttgcctgtaataaaatctcatataaacagaattgcagtattatgtaacttagtatctttcacttagcatatttttgagattcattcctgttactacacatatcagtaattaattcctttttgttgctgagtagcaggccatttaatgaatacaccacaatctgtttatctaaaaacttgttaatagacactgggattgtttctagatactggctattatttaaaaagctgctatgaacattaatacacaagtcttttatagacacgtcttcatctttcttgggtatacagctggaaaaagaaatgctgggtcatagagtaagtgtatgttctaactttacttaaaaactgccaaactatttttcaacatgatgtacaattttacactcccactagcaatgtataagagttctggttactccgtgtcctcaaacttgctactgtcaatctttttcattttagtcattctagtgagtgtaatgtaatgtctctttgtggttttaatttacatttccatgatgactaaagatgttgagtgccttttcatgtttgttggtaaattcatatatgttctgtgaactaagtttttttgcatttgtttaaaagcaactaatagagaacaagttgagtataatgtgaattttatggttgcatatgtaaatactgttcacaagaattgctaggtgaacagaaaatttcacctagctaaaccaatcagctaggaaaacatacaatgcacacatgtgcacacctccaaaatggaccagctacttcaattcatgttatgagctgtactcatctacatcaggtgctacaatttcttgtccgattccagaaaatcctcctttcacttcacctgtcacggcgcaagtcttctatgtccatttctgcaagcaaagttccagtctttgcaacatgaaatgccatatttattgtagtatttatgcatttctcatacattttacctgtgtaaaactgtggtatggtttttactaggttcctgtttttttatcagtgtaagtttgtggatgttgtgcccctaaccctttgccccagaagtaaccctttcctccaaaagtcctgtggtttttactgtacaatttttaatagcaaagttaagaacacatacgatgcattatggaagtgcttacactgagcagacattcttgcctttttcctgatcttagtttggtaaaacattcgataaaccatcatgtagcatgactttaactgtaggcttttcatatctatcctttgtcaaattaagtaaattcccttctattcctaagcttgctataagttttgatgacaaacacgtattaaattctgtccatgaatgactttttctgtatctattgatttttctattttattctgtgatttacatggattgagatttttttattttgagagggtctcactgtgccacccaggctggagcacagtggcacaatcacaccttattgcagcctcaacctctggggcccaagcgatcctcccaattcagcctcctgagtagctggaaccacaggtgtacaccaccacactcagctaatttttttaatttttttttgtagagatgaggtctccctatgtcgcccaggctggtcttgaacttctgggttcaagtaatcctcctggttcagcctcccaaagtactgggattacgggcatgagccactgcacctggcctacacggattgagatttgaatgttgaatcaattttgtactcctaggataaactcaactcagtcatggtgtgtaccatcctttttaattattacgagattcaatttgctagtactctgttgaaggctcttgcatccatgatcatgaaatatactggcttataattttcttttaatgtctttatcaggtttcagtatcagggttattctggcctctaacacaagttggcaagtgtctcatttctggaaaaagtttgtacagagtaacaaagcttgtaaagtttgtaatattatttcttaaatattttattttatttttatttttagagacagggtctcattatgctgcccaggctggagtgcagtggctactcacaggtgcactcccagtactaatcagcacgggagttttgacctgctccatttctgacctgggctgtttcacctttccttaggtaacctggtggtctcttgctcccaggaggtcaccgtattgatgctgaacttagtgtggaaattcaatcggcatagcacactacggcccagaactcctgggctcaagcgttcctcccacctcagtcttctgagtagctgggacaacaggcatgtgccaccgcgcccgactagttcttaggtattttatagacttcaccaatgaaacgatctgtgcagggtgttttactctctgaggcttttaaaattacaaatcaaagttacttatcaacagctattcatttctgttatttcttatgtcggttttggtgacttgtgttttcattgaatttgtccatctgtcaaatttattggcacaaagttatttattcaattaatataaatgcattatataatgtgcagtcttttgtgtcttctttcacttaacatggtattttcaaggttgtagcatattatcagtaattcactccttttcatgaccaaattatactccattgtaaggatacatacagtattttgtttattcatcagctgatggacattgggttatttccactttgcctattatgaacattcatgtataagcttttgtgtggacgcaagttatttccctattttgcatatcagaattacatattcagttctcttgggaatattactaggaatagaactgctgtgtaatgtggtaagtatatcatttgatgacataccaaactgctttccaaaaaggctacaccattttacattctcatcagcaacgtgtgaagggtctaattaacctataccctctccatcatgtgttactgttttctgtattttgttgtttttttttggagacagggttgcactcttgtcacccaggctgggttgcagacatgccatcaggaatcactgctcctcccaggctcaagagatcctcacacctcagccttccaaatagctgggactataggcacatgccaccacaccaggctattttttaaaatattattttagtagagatgagttctcgttatgttgaccacactggtctcaaaatcctgagctcaagtgatacaactgcctcatccccacaaagtgctgggattataggcatgagccaccacacccagccttgtacatcatctttttgatgataaccaatctagagggcgtgaaggggtaactcgttgtgtggggttttttttgttttttttttttgcttttccctaaaaaccagttatgctgaacatcttttcatgtgtttactggccatttatagaactttacagaaatgtctattcgaatcctttgactaatttttaattgggtttctttttattatcaagttatttccatattccgtatattaaactgttattagatagtatatgatttgcaaatattttctccctttctgtaggcaacccacacacagtcttgattattatagctttgacactgaggagtgtaaccattatttcttaaaaatatttcttctgacccattctctctcctctccttgaatccaattacatgcagactgcctgatattatcccagaggctctgtttttcctctataccaatttccatctctctattctccaaactgggtaacttctatcgatctgtctttgagttcaaagaaccttacttctgccatctttaatttgctgttaagcccatgtagtaaattcctcatttcagatatttttctaagcagttctacaattttgtggtttttttaagttactgaatttataatagttgctttaattcatttttccggtagtaccaagatgtggattctcttaggtcagtttctattgagagtaaaatttttttttatttgatatggaccatattttcttgcttatttgcaagtcaagtagttgttgattgtatggtggacactgtgaatatgttgtaaggattctagattatactgtcttcctttaagatgctaagttttgttctggctggcagttaacttactggcagctctccttaatcctaaaaaggcaggtccagagcaactcttactctagggttaaagactggcaatagagattggcaaactttctgtaaaggattagacagtaaatatttaacactgtgcaggtcatacagtctctatcccaaatactcaactaggctgttgtagccgcaaagcagtcatagacaatatgtatatgaatttccatgagtggatgcatttcaatgcaactttatttatggtcatcactaaatctgtatttcatgcaattttcacgtcacaaaatatttttttaaatttttttctaaccacttaaaaatgtaaaaactactcttatatcacaggccatgcaaaaacagtcagtggaccacatttgccaactcctgctctgatgtatgatccttactccaaaatcatggcctttctggcatctcaagtaactgcctagtatgtagccagatgtctctccactttgaatgagctggaatccaacatttcccagcatcataagacgttcagtatcttttgtccactcttaaccctacaacatccactatctactagaccttgcagagtatcagctatgcatgtgcaacccaggcctcagccaagcacccagggagaacatacacgtacactttggctcctccttctctgataccctgcctagcaagttccaaccacttcagcagcccagaactccaatttgtgcatcctcagctcaactgaacttctttgctctgcttgagctccactctccgtaccaccgtcaggcaaccgttccaaagcacatggggctcaccttgtttgttccctttctaaggttcagtgctaaaaacagctctatttcatatttttggtcctgttttctaattgttgatgactagaggaaaactcaaataccagttactctgtcacggctaaaagtatatgttaacatcaataaatatctgatgaataaatgactaaacaagccttacttcataaagttctaagtttgcatgaccctccatgatttccaccacctggtattcctatctttctataatcccttcccccttgcatgtgggcagaacctgtgacttgcttctaactcaaagaatgcggcaaaggtgatgggatgttaccccagtgattaagtcatgttatacagtaagattctgtcttactaccagactacctctagactttctttgttgccctgaagcaagtaggcatgttgggaaagtccacatgacaagaacttcacatggtctttaggtggtcaatgcagcttattactgacagccaacaagaagataggcccctcaatcctacaaccataggatatgaattctgccagcaaactaagtctacaagtggattctccctcagttgaacttccagttaagaacgcagcccagccaacaccctgatggcaccctcataacctaggcagaagatccaggtataagctatgcccagaatcctgacccacagaaactgtcagagaacaaatgttgttttaagctggtggtaatttgtcagacaatagtagataactaatacaacatactattgatagatactataaaacagctaccaacatttatagctgggaagtgcaggcagtgatagaagcaaaggagagaccatgaaatacactcaagaacttcaggaaagaaaagctaccacagacctatgtcaacaacacataacaggaggagggacatgataaattccttcaaagaaacacagtggctcttggcctagcaagaaaaaacttgtccatcagaaaagaagcttgctcagtcacacaaaaatactcaaggaacagtcaggaccaatgcagggctttttcaagcatggtaagcaaaacaggatttgcctgctgtgcttgaaagacagttggttcaaaaacctaacttgtgttatctctggcattcagcagagttcagcacataagcacttatctgaatgttgatcttattttacttaacaaatgtgagctcttacccttaatcattgctgtcaacattcaaaattaaaatgtctcctctcctcaaaaccaaaacgcaccaaatcagcaccatgttaccaagaggaagaaagaaaaacaccaaggttttataggatttgtttactctattaaactttatttaggatttgcaacagaactgggcattttaaagaccccactattttcacctgatgtcattaaacttttgaatcacattaactccttttttaaaaattccatgcactgttctcaacatggacaaagagagaaaaaatttttttaattttaaaaaatctacatactgtaagtaatcttttaactgtaatgtcgctttgcaagcagcatgcctatagaattaatgaaaaaaaatacagagagaaaacgcaaaggtggcaaaatgttaaaaagcagcaaatccaagtgaaaggtattatgagtattcactggaccacaattaacttttttttttttttttagatggagtctactctgttgcccaggctggagtgcagtggcatggtctcggctcactgcaacctccgccccccaggttcaagcgattctcctgcctcagcctcccgagaagctgagattacaggcacctaccaccatgcccagctaatttttgtatttttagtagagacagggtttcaccatgttggccaggcaggcctcaaactcctgacctcaagagatccacctgcctcacctcccaaggtgctgggattacaggcatgagtcactgccctgccgcacaattaatttttctaatatatgtttaaattttttaatataaaaaactggggacacagaaatgagataattttcttggtagtctcaccaagtttaggaatcaaaatgtccttaaaaaccaatgagaaaagcttgaagaaggtaccattttcattgttttggtaaacaaaacatacatccaaatctatatgttataaagcaattaacactctacaattatatttatctcccagaaaatagaaaatacaaaaatgcctataaaaatattaattttctgattcacccttaaaagcttttggttctacagacaattaccattaacttttagatcttcattgttctctaactcttgttaatcaacatgtggtctggtggaacaatatcatagcattacctatgcacttgtaagaaatgcagaatctctctgaatccaacccaatgctgcagaatcagaaactgcactttagtaagagacacaggtaacttgaaagcacattaaagtttgaaaatcactattgtagacattaaaatgcatttattataaacattataaacctatacaaatcacaaacatcaaagtcagttaaaaattagaggaaatatgtctgtttgaaaactgtttaacagtgtttttttgaagagtttagtctgaactactgatccaaatgtgtgtgtgtgtgtggcagaggcaacaggatctcttagaagctttgatattgcacaaaaaaatctaatcaaaatctattacaacctttgaaaacaattgtaaaagaaattctaagaagtctggttaaaacatcaacattatctggcatactcaatacaacaccacagaagataaatgcagagacaccaagtgacacaaaattgttactcaatacatccaatctgttgaatgtataaactattttctacaaactttaaaaaccacttcctcactaaaagcattgattttctgcctgaaaattaacacttacccagtttcattataatcaatcaaaaatctataaggcagtacaatagaggcaggcctacatcaatcagtacaagctatcaattaaacatgtgaagacaacctttgaagtaacctaggtcctgatgctcccctaaatgaatggaacttagtatatacagaaaaaaaaaaaatctgggcaataactttcctctaacaggccaggataagaataagtaagaacagctgaaagaaacacactgatagcttgaacaaactctaaatgttctctgtaatttccttattaactgtaagattcttttttctatttgctaataaacttttctactgggaagaaaatgtatgacctactaaggatcccaaagagtttatatttatgtggattatattactgatatttacactagaaattagagctgaaacatttaaaaaaaacattaattcacttaaaaataccaagaataaaaccactatacattaacactaaaattgtatttccacaaaaatcaactatgtttcccagaacaacaacaacaaaaaaaacaggaacactggcactaatttgtatttttgcaaataactttaatgccttaatagacaaccaatggattaccttaaacttgcttctatgttcaatattctacaatatgttgttttggttgaagtatataaagaaaattcaggctcacaaagatatgtagtttaaaagaagtattttaatagcctttttggctttgtggatattcttcaatactacaccaaatttaacaagttcagtttattatattattattattttgagacagagtttcactctgtcacccaggatagagtgcaatcactgtgagtggtacagctcaatgtaacctcaaactcctgggctcaagtgatccttccacttcagcttcccaagtagctgggactagaggtgcatgccaccatacttggcttattttattttattttattttatttattttatatattttattttatttatctattttattttattttatttattttattttattttattttatttttagatacagagtctgccctgtcattcattctttcattcgttcatttatttttagagagagttttgccctgtcacccaggatgaagtgcggttgtctgatcatggctcactccagcctcgaattcctgggctaaagcgatcctcctgcctcagcctcccaagtagctaggactacaggtgcacaccactgcgcccagctaatttttaaactttttgtagagatggggtctacgttgcccaggctggtctcaaacttctgggctcaagcaatcctcctgcctcagcctcccaatgtgccaggactgcaggtgtgaggtatcatgcccatccagtttattgtaataataatgtggaatctgaaacattaccagtgaacattttctactctgttacattaagatttcttattctaatgttgcactttgaatggatctttttacacatgcatgatcttgtaacatcaagcactggtcatctggaaatgttcactgatttacgcattccaaatgttgaccctttcactatgaaacttttaaaacatcagatgttaaaataaccaccgatctcatcagaaaattatttaagaataaagctttcaagtttacagtggcatcatgttttccaaaattcaaattttcactaaaaagttgaaattttaccactgacaacaaatactatcacttgttttccctgcagtgagaggttcactttattctttttcaagaaaatgtctaacaaataacaaagtctcaacaaccacagtttgtctgtcaatcattctttcaagtaaaataatggtgtttcataaaaataagtggccagttcagctggcaaccaaaaaattacgcaagtgcttttcctcaagacaaccatatttggcatgcaacagaggagctttatgtgtacttcccattccatcatacaggatactaaaaagacatgtacttaagagtcaaaattaataataattaatactttgtactactacatccagaaaagtcttaaactggtgttctttttactctaagtgtgtggttataaagaaaacaatgacaactagtacagtgaggtacaatgccctgctttgtgctaaggcacccacagttttaaccaccattgttgttgcattatcagtgtaaatgttaacacaacgggaagggccaataacatcctgatattattatatcatggaaacagatttgacctgatgaatccattgaaagggtttcaggaacccgacacacagaaggatctccatatttgttgaatgaatgaatgagtgaataaataaacaaggagacagctatattttaatctagatttcaaagtattttagagcttatttttcacacacaaaaaaatctaattattggaattaccttccaacattaacagaaaagactcgttaggcaatatagcacccctacccttaatatgtttgaagtagttttatctccacacctctctaaacttaaattgttgtatatgcaagcattccttgctttgcatgtaacatggtaaatgaaattcatgcataccaacactatgtgctctatctgtactgttctttggtaactaacgtgtttaataacatggtattgtgcaaagcacattataataaatgtacacggaaataagctctaatgacccacaaactcaaattcagtaaaacaggaaggaaaagcatcacatgaagaatgaatgagcaacctttgggcagtaactatgaatggacaccccgatgggaaagaaactcagacacctaaatgactttttcaaactctacatgcctctctccaataatgtattggagagaggccaaggcaggtggatcacttgacttgaggtcaggagttcaagaccagttcaagcacctgagaccaacatggtgaaatcattgctatttgagaatgaatcactgttcgtgatcaactaatataagagaccgacatggtggaatcattgctatttgagaatgaattactgttcgtaatcaattaatataagtgtttccaatcacaaaaaccaaatggtgtttgtgaattgggggaggggaacagagcagaagcaaggtggctaagggaatgagggaccagcacttcataaaataatgagacaaaattaggtcacactaaattcagtctggtcttaaaaactacaggaatgaacatttttcaaaacagaggtagatcaaatctttggaattctatctcctaacccttctcttaattcattcaaaatagccttagaattactcaacagtattaggttgtcccctctgtacttccatatccacatctacatgcaagatttttgttttttctagccgacttttaaaaattaacaccaactttcaaaactttaaattttattttttatagaggcagggtctcactacattgcccaggctggtcttgaaatcctgggctcacctcggcctcccaaagtgctgggattacaggcgtgagccaccaaggctggcccaaaaactcgtaaattttaaaaagtgtattcagcactaataaagaaaagcagttcatatattaaaagtttaagtgtttctgccaagagttaggaaaaaattgaaaagtatcttatagacaaatactaatcgaagcttagcaactaaaacagtgtcaggggaaaagcaataaataacttcacttaaaaagaaaattctactcgaagtctatttattatgtatcacaaatgggacgaaggagaaatgcaatttactataccttaaaatgtactgtgatgttccaaggaagagctgaacttgatgcaagaagatcaaatagcaaaccaattggataatgcctaaaaatgaaacagtatattttgagaaaataaatatttaaagttataactacaaggccaaaataaatttccaacacatattttaacaccaaatgtcaggggctttaatcacaaatcacaggaagactacattctacagttacgtgcctaggctagtatgatctactttccaggcatcaggtggtttccttctaaccactccattcccatagaaacctcaatatgcacaataggattgtgggcaaaggcattctttatcagccatgtgaactgttatgtcacagtactgttgcatctaattgtcatccctgtattcataaaggacagttgatttttgtaaatttatttaaatatgttttttacttttagaacttaaaattttaaaaaactgtaagaaccaagatgagcaactaaaacgcatgcaaatcacctattctgtggttattaccattaacattatagcatatacatttccagtcttctacctacacatacatatctaaatacagattaggactatcctttacaaactgtactataacttttttcacataatataatgtcaacattttcccaagccactgaatattcttctgaaacctaattctaaatttaaaaaaataagttccaaaataagagaacatttcctaatataaccattacccacagtgaagtaaataacttagcaataaataaacatgactaatacaaatgttgtagatttcaatggacaaaccttaagtcatccttttaaaaaatctaaagtaaattagcttacttggttaatcagaattaaataatacaggttgagtatcccatttccaaaatgcttgggattagagaagtgtttcagatttcagcttttttttttttcttcaaattttggaatatttgcatcatattcttaccatttgagcatcacaaatctgaaaatctgaaatgctggaatgagcacttcctttgagtgtcacgtcagtgctcaaaatgttttggattttgtagtcttagattctggatttcaaattgtgggatttgggatgctcaccctgtactcacaacaagggcaaaaagaagactacttggtgttatacacagtcctgtctttatctgtataatctattaatgagttactcctagatttaagagctgcaaaatttgaaaacacatcaaatttatctcaaaatgagtaactctgaccaagattcaaatatcagttaatattatttatgcttgtgctactctgggcacgatgcttatgggatagccctgcactgcaaggagcagtacacatttgcttatatatataaacatagatatatgtttatatatataattgtatatataatttatgcttgcttacttgtatagaattatggaaaagtcatcagtttctagagatcatgtatttatttggtaggaatttaggatgggctgggtactgtaactcaagcctgtaatcccaacactttggggggccaaggtgggtggatcacttgacttgaagtcaggagttcgagaccagttccagtacctgagactgacatggtgaaactctgtctctacccaaaaatacaaaaaaaaaaaaaattagctgggcatgatggcacacacctgcagccctagctactcaggaggctgaggcgggagactctcttgagcccgagaggcagaggctgcagtgagccaagactgtgccactgcactccagcctggacgacagagtgagaccttttctcaagaaaaaaaaaaaaaaaagaatttaggatgaacgcccggtcggtaaaaataaagcagtgggggtacttttagtcttatatgcattatatctcttaataatatcccttaaatttctctctaatcaatcctttcatatccagaaactaatactgaagaaaattctggaaccaggaaaaactctcgcctcagtcaaaacctaaaattaaaaaaaaatatacatacacacacacacacatatacacacatatatagtactatagacaagttatagatttaatccaattctgatccttctctctaaagtattaaaattgaacaagctctaaataataccttatacttttacaaaacagaccttttaacgtcttcaatttattttttagaatatctctcttaggtatctgcaacagggttaaagatgaatgtaggcacttaattaaagttttattcacttggatttcattaaaaagacttaacatttcaaaagtgacaccatattgctttccaaattctaaacagcactgaaaacacaaagaactccgctaggcaaaatagtctaatctattagataagattcactcgagatcacataaaattactagcaatccagtgttttacatattccctgccattaacaaatgtgtgaaacacttttgtgaatttgtaagcaaattctaaaacaaatatatcttaaagcaatctataatataaaatcaagtaatttttttttttttttttgagacagggtcttactctgtaacctaggctggagtgcagtggtgcagtcagagctcactacaatcttgacctcctgggctcaagcgatcctcccacctcagcctcctgagtggctgggactacagacatgtgccactatgcccagctaattattttattttttatagagatagtgtccaactatgttgcccaggctggtctcaaacttctggactcaagcaatactcccaccttggccacccaaagtaatgagattataggcatgagccactatgtccagcccaaataactctttaaggaaatatctggatcagaatacaagttaaacataagactcaatcataaattatttttttaaccctcaatatttaaaaaacgagaaaactataaatattttaaaaatgagaaaattataaatacacagaagcttgaacaaagtacataataaacaactgctgaatgcataaatcgaagaagtccacagactaaccctaggtacaacataaagatctaatggagccaattttaggttctgagtttcttttttgagcagttccaactattttaatgattgacacttcatgacttttattcattcttaaaggtattccaaagaacagaaaaaactcactttaaaaaaaaaaagataaaacttactccatgtagtaattaccacatggagctactggacacttttataaatctaagatatattttagggtcttaatgatcttattgtttcctatgtatcaaaacattttactatttcatcactctagaacttatttcatcattatttgtcaattattcccaataagacactaaaacagtaagaatttgaaaaaataacatgatgcctagaaggatgatagaagaatgtacccttctttcattttcttatgtgttgcctaaagtattgaaacatctttcaataaagtgtaaaataagcatgcaggctgggcgtggtggctcacgcctgtaatcccagcactttgggaggctgaggcgggtggttcacctgaggttaggaattcaagaccaggctgaccaataaggtgaaaccccatctctactaacaatacaaaaattagctgggcgtggtcgcatgtgtctgtagtcctagctactcgggaggctgagacaggtgaattacttgaacctgggaggtggaggttgcagtgagccaagactgcaacactgcactccagcctaggcaacagagggagacttggtctcagaaaaaagaaaaaagcaagcagactccattctggaatcagtttttagctatcattaacacagttgaaaattccaagtttctcattttctaccaacaatggcagagaaaaaaactgacagaggaagatgtttcacaattattagacaaatcaggacaaaatacaaagagagacagcagtactctagactttaatgacaatagtgaaattgatcatttaagtgaaatctcaaactctgagtctttagatgatatcttaaattttccatagctcaagaactaatagaagaacaatatatttctaaagacaaaaaggaacacatggtaatcttaacagcttagtcatcaacagaaaaaacttcattacatgatattttatgacaaaaacctggaccatttctttttactaaaagaacatgtgacaatattatttcatcttttatgctatttacacaaatttatttgatagtaggcaaatgcaaaagttctatttatataaaaagaagactgaaggaattagatcacatagaaatgaaaaaaagtactgggctgctcagtctaattggtgttgattcacataaaaaagaaaatatttcataatgaaatcatgagctggcaaagggtttatagatttcttcaagtattattaacactattagatgcaagaagggccagaagtaataaactagaacctctcagaggtatatttgaatgtataaaaattaatgagcaattagttgcattcaggggatgttgaccattttagatacctttaaaactagaaaaatatgaaatgaaaatgtaaatttgctgtacttaaacctgtattaaaatttctaataaagttgttatacactattcctttattctaaattctctaaattatttgcaaaatgacttaaacacacacacacacacacacacacacacacacacacacacacacacacatatatattttaaagttcattggggctgggcatggtggcttatgcctgtaatcctagcactatggaaggctgaggcaggtggattgcttgagcccaggagttcgacactagcctgagcaacatggcaaaaccctgtctctacaaaaaaaattagccaggcatgatctgtactcaacagagggagaccctgtcaaaatctatttttttttttttttttgagacagagtctcgttctgtcgcccaggatggaatgcagttgtgcgatcttggctcactacaacctctgcctcccaggttcaagcgattctcctgcctcagcctcccgagtagctgggattacaggcgcgtaccaccacacctggctaatgtttgtatttttagtagagatggggtttctgttggccaggctagtcttgaacttctgacctcatgatctgtccgcctcggcctcccaaagtgctgggattacagtcatgggccactgcacccagcgctagcctgtcaaaatcttaaaatttttttttaaatttcattggtcccagatggtaaatgacgacaactcctttgtcttggcatattaagaattaggagataaatttaaacatatgcttccttaaaattatatttaaatttaaattagctgggcgtggtggcatgcacctgtagtcccagctacttgggaggctgaagtgggagaattgcttgaacccgggaggcggaggttgcagtgagccaagatagtgcgactgcactccagcctgggcgacagagggagactccatctccataaaaaaaataaataaagtattaacataaaaacattctaaatattataaaaatgaataatcatcctgttatgattttttaaaaataaaaatgaaccagaaaaacgaaggagtaagataaccatttacttatttctattgtcaaattccataattaacatgcggttcaatacaaatttttatgttagaattattttcatgcaaagatattaattccaaacaaatatgctatctgaattcactggttcccagattgcttatttctaatgaatctactgatattcaacacaatctataaaagaaaacagaactggcaaaaattaaaggtactgagtttctcttacactttaatctgatttacatcaaggatttcaaaagtactaatttgtacaagtcttctaaacagatattatatacagttttgtgagaagccttctaacccacaacacagaaaccacatataccctaagtaaatcataacgtaaccattggctattatgttgctacttctaccatctaacttaaatttaatagaaaagcaagtagtaaggatttgaacctggaatacggtccacccttggtacgtgtggggattggttcctggacctagctggataccaaaattcgcagatgcttaaacccttatattaaatggcatagtatttgcatataacctacacacattctcccgtatactttaaattattgctagattacttataatacctattacaatgtaagtgctacgtaaatagttgttataccatattggactttttgtgatttcatttttattgttgtattattattagttattgcttttttcccccaaatattttcaatccatggttggttgaatccatggatgcagaacccatggatacagaacaccaactcttatccagaactgtattttctgtgtaaataagaggacccaactagctaaagactcagtgtattgccctatagaaaatgactgcataagaacagtattaggtctatttttacactttgttctttttcttctttacattgctctagtcttccatattcaattctcgaaatgaatatattttaatatttctttgctttttgttttttattcattactccatttatgtgtgtgtgtatgtttgtgcatgtgtgcacattggcacatggtgtagcaataatggatattctcagaagggacatgattctagtataaatatctgtactcagatagcaaactaatacaagtattctaaaatcagcactgaaagaattttccccatactggagaactactgcccaagttcatgtcactaaaataaatgcctcctattcggaaagttgctgcattctgattcactggaaacgggattacatttcattgtaactgcaagcatgtaactacaaatgcaaaccaaagtaatttgatgattgctgtgaatactgacttactctatatgtaggacaaacacaaacaactatagagtagcaatgtgtttcacagctttctaagcccattcttatatatgaaaaagttcaaaaataatgaagggataccacatatataaaatctatgtaagtcacatttcaaaaatctagtttacagaatacattgttaactcctttatgcctagttttccattattggaacgctaagcttgtgggagttatgtaaactgttcaaggtcactgacaaggtctgatttttcacacacaaaaaattttaatctcctgcataaatgggttaagttccagaaattcacaaccttaaaaagactggaaataagacagaagaatctgttagcatttatgattaaaatgttaaatgttttttaaaaaattatacacaggttttcactaaagcattttgctaaaatctacttttgaaatcacaaagagtattaaattctgagtcattctatcatgtctatgtttaagatcaacatcaatacagccatgggacatttaacaacatggatatgttccgagaaatgcattgttaagcaatttcattcgctgttcaaacatcacagtgtacttacacaaacctagatgccatagcctactacgtacctaggctacatggtgtagcctaatgttcctaggctataatcctgtacatcatgttactacactgaatactctagacaactgtaacacaatgataagtatgtatgcatctaaacacagaaaggatactataaaaatacagattatcatcttctgggaccaccatcctaaatgcggtccatcattgaccaaaatcatgtagcccaagagtatgtatttttttttacaattcaaaaagtaatttcaacttcttccttttaccacctgtcctgaaagtcaatttgcagagaaaaatttcccattaaagttatttattttacagttgacaaaatgagaagcttgttctaaatttcgtgcttgaaggtctaagatctaaaccaaaattagggtttacttacaaagtattcttcggaaggaccaagaactggtctcttaacataattctaatataaaactaacaaatataaaatgtgaacaccagttgtggtaataagaaacttcaccccttaaaatacaatgttagagcaccctctgctgactaacatctcagtctgaagaaagagactctattttgagttaggccagcactttccatttcccatgtaatttttaaaagctaaagatgcaaagataaagctctaatcagacataacctccttgtaagctctctacaaatcgacaacaacaaatgtattgagtattcattataagtataccactgttcttaaatttttttaattctaatttggacaaattgatataagcaattagagagaacagataagatgggagaaaaatttttaaacaaaatgttagcaggtgtggtaaaaagagccctgaactgatactctcaaaatctgggtcctaacttatttgaacaagttaccttacttatttgagtctcggttttccaaataaaagcaaggggcaaatttagattcattcattcattcattcactgaacaaacatttacttatcccctcctatatgctgctggtttaagtacaaagaaaaatgatccaaaatctgaaccttttttaacactgacatgatgctcaaaggaactgctgcttattgaagcatttcgcatttcagattttcagatttggaatactgtaagtatataatacaaacattccaaaatctgaaaaaatctgaaatctgaaagactctggtcccaaccattttggataaaggatacttaacccatattaactcacttaattcttgaaacaaagttacgaagtacaaggtaccattatcattgctgttttacagacaagaaaactgagatacaaaaaggtcaaataacttgcccaaggttataccgctagtaagtgatgaagctgggatttgaaatctggtttctgactccagagtcagcatccttaataaccattatgttacaatacacagttataacatgacaagaatataggaagtacacacgtagtgtagagatggcacaaacgtagaaatgatcactttgggctaaaaagaaccacaaaaaaggtcatagttaagctagatgttagaagtatgagctacaggagggaatatatgaatgaataattaattacaaccaaaacaaaggatgctggaaagagcaaaaaagatttatcaaattagatgagcaaagaaacggaagcccaaaacattatcccacattcattaaaacaagtagcttagtacacctggaaagacctggaaagaagtgggatcatggacaacctttacacacacatcatgctttagtgtttggctttatactgtagatgatggtaagtcagaatagggttcttgaggacaataacaatgttagatctgcatttcagaaagaaaaattatggcactggggaagataaactaaaagtaatagtattaaaagcaggaagacaaattaagaggccactaaaacaatccatgtgagaaatcagatgggcctgaatcccgaaaaacaaagcagggagtttaaggcatacttagaagccagaatcacaatctagaggctagatgatgagggaatcaagagtggagacgaacatcaacaaatttaaaagatccaaaattacagtgagctctttttttactacaatagaatcaaactagaaatcaataatgaaaagataacagaaaaaccactaaatgtggaaattaaacacatttctaaaaaaaactaagattccaaaagaaagcctcaaaagaaaattttaaaaatacacagacccgaatgaaaacaaaaacagaacatatcaaaatttatggtctatactaaagcctggctgaaatagatatttgtaacactaaatgcttgtacaacattgtgaatgtaattaacactaccatggttaagatggtaaattttgttacatgcattttactacaatttaaaaaagaaattaaggtaagagctcaaaaaaataacctaagtcccttttcaagaaactagaaaaaaataataaaaccaaaggagcagaaggaataagattattaaaaacaaaaaacagaaaccaacaaaattggaaattttaaaaaggagagaaaaatccatgaaccacaacactggctcttcaaaaaaataagtaaaattggtaaacctctaacaaagctgacaaaaatgaagacaacactacagatcctaaagtcattcacagacaaggaaatactataaacaactctatgttcataaattaacaacttagaaaaaacaaaccaactccccaaaacccataaactaccaacactcaatgaagaggaaataggcaagctgagtagatctatatatatcaaagaaattgaattggtaattaacatgctccccaaaaagaaatctccagacccaagtggtttcactaaagatatctatcaaacacttaaagaattgacagcatttttacacgaccttttccagaaaatacatcagaacagaacactttcgaactcagtttataaagcccgtataaccctaatgctaaatcagacaatagaaaaaacagaaaactacaatccctcttatgaacataagacacaaaaatcctcaacgaaatattatttggcaaactgaatccaacaatgtataaaacttattacattccgtgaccaaataagatttattaaatgtatacaaggttggtccaacatcaaaaatccataaatgtcatctattatagcaaccagctaaggaagaaaagtgatacaatcatataattagcacagaaaaggcatctgacaaaatccaacatctattcatgacaattgtgaaagactaatacattccccataaaattaagaacaccagaagatgtccactctcaccactcttatccaacacagtactagaagttctagctactccaataaggaaaaaaaaaaaaagaagaaaagaaataaaaggcctacagattggaaaaattatataatttctatttgcagatgtcaagactgtttacatagaaaaccccaaaggatctaccaaaaaaacacctagaactagtgtgtgagttcagcaaggttgcagaacacaaaaatcaataacattttccatatactaaaaatgaacattcacgctcgttttggcagcacatgtactaaaattagaacgatacagagattagcatggccctgcacaacgatgacacccaaatttgtgaagcgctccacagtaaaatttttttaaattataaaaataaaaaataaaggaacattcagaaaacaaaattaatttttatcttttacaatatatgtggcttgacacagaaagacctctaggtgttttcagcagcttttctcaatatagtcccagaatggaaacaatccaatgtccatcagttaatgaataaacaatttgtggtataaccatacagtgggatactcagcaactcagcaacaaaaaggaaaaaaccactgatacacgcaaaaaggatgagtctcaaaaacattactcgaggtaaaattcagacacgaaaggctacatactacatgagcccatttatatggcattctgaaaaaggtaaaacaactgagatggaaatcagatcagtaattactgtgagttgggggaaggaagaggtaactgtaaaggagtaccagggaattttgtgaaattaaatatcttattatcttgattttgtaagtagctacacaactgtacacaattgtttgaaaactcttcaaaccatactccaaaaaagatgaattggccaggcacggtggctcacacctgtaatcccagcactttgggaggcccaggcaggtggagcacctaagctcaggagttcaagaccagcctggccaatatggtgaaaccctgtctctactacaaatacaaaaattagctggcgtggtggcggaagcctgcaattccagctactcaggaggctgaggcaggagaatcacttgaacccgggaggtggaggttgcagtgagccgaaatcatgccattgcactccagcctgggcgacaagagcaaaactccgtctcaaaaaaaaaaaaaaaagatgaattttattccacattaattatatgcttgggattatttttcccttctcacacagagtctgctagccaagtagatgaacaaagaatagtaagaaagaattaacagtaaaggaaaaataatttgttttaagaatactccattctgctattatctataactaactttactatatgtactatttctttaaaaaatctttaaaaccaagcatttgtttaaaaaacaaagcccccggtactcttcatctatgtcctaccaacaggaaaataaagtcatatttttcccaactgagtatgatgaaagtcatgatttgtcaaggactttagtttttttttcttgtcattgagaactgtcaccttatgaaaagacaaacttaattgaattcagggacagaatcagtgacaaggttataaagagagaagaaacatcaatttctgttctttcttccctcacttatgagttgtctcaactggcgactaatttcctttcctacctgaacttatttaaaactccgaagaataaatataggaaggacgttattattcaactcaaataaatgcttctctatccttaagacacttgtatggtctcaaaagtccaagtcttccaacacttcagtggtagctgctttcctccactgatggaaattcacagaactatcctattttgcgaagcccactacttaaatgccagatattcttatattgatagcctatttccaggaagatacattttttaacatgagagaaaactgctattactggaagcaaagagagaaaagatcaagactaagcccagaggccctggattacatttatggctctggaagttattcacgcctcatatatatggagtacttaaaaacactaaaggaaaagatgcatcaaaagtcatatagctacaatgagcttacagcatgacataactgtggaagtgatataacacataaaaagttaacacccccaaaactaccataaagatacttgaatataattactttcacataagctctctaaaagggaaaagaactccactctttaataaaagactttccaaagggataaatactgacaaagtaagaacatggtataataatatttaagccaaaatcattgttttgcagtgacaaggagaaatgggtccaaacactatttacccataaacctataaaatataagccatattgaatacaagaataaccaccatgagggacagcataaaacagcagctgaaagatgatgacttagcaatcacttactttacaagctaaattgaggtttcccaaattttccagagttcctcaactgggggcggttctgcctccattcagggacatctggcaacatttttgataatcaagactggaggaagtgctactggcacttgtaggaagaggccagagctgctgttaaacatcctataatgtacagggtagcccaccacaacaaagaattatcaaattcaaaatgtcagtagtgaccctattgagaaatcctgctttacaataaaactgaaaagccccgctagtcacacaaaattctgagataatctgtaatacatataatgcaatacaatgtaaataactatagctagaaatgtcaagtgcatacatacatcccattgctactctcccacactgtttccccgtccatcctgtcattctactcttctatttaataattgttgctctgtttacacttcctttaagtcgccttcccattccaaaatctccaattctcctgagaaataaaaagaaatgggaagcattgccttatctatgctgcgtgaggtctagaactacacaagaagaatcagaggagtctgatacatgatcatgaagctcagtattgttttgatttaaagaaagaatgctataacaagacaactgtgtcataaattcccagaaccatctcaaaggattagagacgggacccaaaatacaaccttgttatgtttgtaatccattatgaaaaatctactcattcttgggatctcatcagcacaaggtgagttccaaaatttctctccttgctaataaatagtcctttgattcacatcagctgcatttattaaacacctaagtagcttcctttcatctgtcctaaagctctttcaaaaactcttcattttaatattccccgattcagagagcaagtccatttttaaccaatttgtatttttcatgtttcatttaaatctgtcttagcctgtatttttttcattcaactgtatccaaatgatagcatttcaacattaacatccagcataccttcaactattttttttttacattcttctctctgtaatttccagtttcattaaatatttttggaagcacaatgaacaaaactcccaataacagaggaagcaccaaaaaacatcattagtacatggataagcacaggtttaggatttgatttcaataccctttttttttttttttttttttgagacagagtttcactcttattgcccaggctggagtggaatgttgtgatagctcaccgcaacctccacctcccaggttcaagcatttctcctgcctcagcctcccaaatagcccggattacaggcatgtgccaccacgcccaactaattttgtatttttagtagagatggggtttctccatgttggtcaggctggtctcgaactcctggccccaggtgatccgccagcctcggcctcccaaagtgctgggattcgtgtagtatctgttcttatcagttcaatacccttcttaaaaatgcaaaacatcaaatttatttttcacgtaaaaaggaaatcaatatattttaaatactctaaaccaagcctagttaagatgtgtttctggcacagtggtcaactaaatatggcaatcagtttgaacaatgccacttaaggtaatcatgtatataaagatgttataaatattttggtgtcagaaataaaattgaataatgtcaagagatgacttttcataagggagttttaaatatatctgaaaatagcccataaccaaatatattcttattgtaccatataaaaatctattgctaaaaatatatgaatctgtccagtcatccatgcatccaaacagaaggcagaaatattttcaataacgtattctagtaatagtctaaacttcacatattgtatgagctagactaatgacttctatcctcgcaggactttttttacaattgtttcagggcactatacctttttaaagctagtatatacttaatgcttaataatgcagaaaaattcactcaccatttcagtggtgtgccttcatattcaaaccatatctcactaatgtcttcttgtctcataaccttctgaaagtgctttttcactttgtcagttaccaacgtcaaataacttactcttggcaaaagcaactgaaatgaaaatttgtaaaaccgtatttatttactagttattatttttaaaaaatactaagtaggtttttgaattttaaggaaaaacagccgtgttctttgcattattttgaatatcccacacaaagtctactgctttttatagaagatcaaaggttaaaggttaagatgttttaatatttcttatggggccattactttaagcacagcttaccacataaatgcccagaatgatcaacacaaatctatctacaatcttcctataacactaaataaaaatgtaattagatgtcatactatttaggatacttattggttctataaaatttaacttaaaaattaaaatgattcatctgagtcaattaaactgttctaagaagataatcaactcaagttctaaagtatactttgacttatcaatcaaatcttctcaaccagtccatcatgttttgaaggctgagagagaatgctgagctaggtaaagcctcaaaaaaaaacagtatgaagaacctggtcagtgttttttccccagaaaaggtacccaaaaataaaacaggagtgttttggaaaatcaattatgatttatataaagaaccgacaagtagataaaagaaggagcttggcaaaaatttatggttttcctcctttgcagtagacactctagccatttcttgctttcctaagtgtctgatttcttttgctgataaaactgctttgttattcttttggctgcttttataaccgcatcatctttcatgctttttattcaaggtgatatcttttgactaataaatcaagtagaactactaagctgacaaatatatacagaaagagatattctggttgaaggaatttatatttaatcatgggagtccaagataataggtaccaaccaactaggtaggagaacgtgacattgatcctaggggctacagaatacaggggtatgggagggagatagttggcatgctccagtatggaatacaaggaactaaatactatgaacaagctgctgaatagtattatgcattcaacagaatataagttattcttttataaagaaataactgtgattagtgaagaaagaaaaaggaattcttactatttaatataagaaaaagcagtttttcccccacaggaagtattatcgcccctgttttaaataacttgccaatatcatgctattcttaaataaatggcagagaaaagattcagtgtagtctttcagaaatgacaaatacagatgtgacattaaagtctctttaaaaaagcaaaacagcgtcgcaaactagctgttttcaaaaatatgtaagtataatctattagtctaataaggtctcttttagcaaaccttgaactttaatttaaaaatgattaatgggcattacatagtaatctattctgtagaaaacaatattaacttatggagacagtaggagggaagaaacaccacagctaatgggtatggatatatcagctcctgattttggagagtgttgtattacatgccttggcttcactcaaaattgctaaagaactcacaaatgatttttatgaaataaaatattttttacaataaggaaaaaagaacattagactataacctcaattaagacaggaatttttgtctgttttgttcaatgctacatttccactgcccaaaatagtgcctgctttaaaggaggcacacaataaatatttgctgaatgagtcagagatgccaatggttaagtgaggcagagccaacaactgtaattttaaaagaatactcatttttaaggcagaatccacactgaaatgtagctgcaattttctgttccgtttggcctgtgggagtaatctttaactaatatatccatagaaacactaagaaatcactctaagatttaagaatgactattctatagtacatatagatacaatttacctaggaaatatttaaacaaataaaaatgaaaacaacaatgaaaagacatcatcttcttgtcttttacctgcagactatatatactactcattgtttttcttaggtgtatttcattggtttaagttctttttttttcaatgtggtaaaatatacctagtataaaatttaccatttaaaccatttttaagtgtacagtttagtaatactaaatacattcactatccatctccagaactttttcatcatgctaaatggaaactgtacgtattaaacagtagctccccattccctgcttccccagctcccagtaaccaccattttactttctatctctatgaatttgactactctaggtaccttatttaagtggaaccatataatatttgtcctttagtgcctggtttatttcacttaacatatgtcttcaatgttcttttagttcttttactttgaataagattaaccacatttggaaatactgtcagctacaatggaaactatcattctcttattcctcatttagccctagtataaagtattccatgactctgatacaagtgattcatttttatctatacagcttaaaagaatacatattttatgcaattatatggaatacttatgtttccaaaaaagttgcccataattttaattctttatgccaagtccaattctgtccaacaattttcaattttaaaattagagacctttctaggacaaaaatagaagtaaaacatactagaattctgttccactccaatgtgtaaagcatcatactaggcaatgaggatacaacattgaaagagacagaagagtccttccccttatacagcatacaggttagacagcaaaaaagatacaaaaaaacaaaattacaaatgtgattaatgcagggaggaagtaaagaatgttataagagcaagtagcaaaggaatttaacctgatcttgagtttcacgggaggccttgacacgaagtgtatcttaaggcaaagagtcaaaagacaaataggagtgaaatgaacatgggtgagtgtggaagtctgggtgtgtgtaggtatgggagatacctctgccttttccaaacaggggacactgcaagacaaaaggcatggaatgaatacaaagaaacaaagatgggcacatttgagtgaagtctaagatgctgaatatgataggaaggtacagagttaagacagaatagtgctgaggaagccaggagccagattatcgagaaccttgtaaactaaatgaaagatcctaaaaatgatgaaaagccacaaaggttttaagcaagcaagtgacaagatcagacatgtgatttgaaaagatcactccaactgcagactagaaaatggaaagaagggaaaactaaaagcaggaaactggttactactgtgcaatttgatctccttctttttttttttttttgagatggagtttcactcttctcacccaggctggagtacaaaggcaagatctcggctcactgcaacgtctacctcccaggttcaagtgattctcctgcctcagtctcccaggtagctgggattacaggtgtccaccaccacaccgggctaattttttgtatttttagtagagatgggtttcaccatgttggccaggctggtctcaaactcctgacctcaggtgatccacccaccttggcctcccaaagtgctgggattacaggcgtgagccactgtgcctggcctgatcagtttttaagcagtagtctggtctaggctgtagcagtgggggatgaaagggatcagataagtctgagagacactgaggtctctggagtaagttaccgactatctgggataagagagaaggaaggaagcaccaaacgatgagtcccaggtttcaagtaagagtagttcttcttgccaaaacaggaagggaataaaataatgcagaggaccagatttttttggggggaaagctgatgagtccagtttctaacatacatagtttgagctcctataagacatctaagtgaggatctccagcagacaaatatataggtttggagctctggagaaaaatattgggaattgtcaagatataaatgcttgacaaagacataaaaatggacaagaactccagggggtaaaaagtgaagtgaaaaaaaagaaagcagagccctaagaaataccaatattaaggaataaacaaaggagaaagatctggcaaaaaagactacacacacacacacacacacacacacacacacacacataaaaaccagacaggcaaaagcaaaaccaaggatactgagcactgcagggctaacaggacaatgccacaagatgggagaagcaaccaacaacatcaaacactgctgagataaagcaaatgaaaattaacaaacagactctgagcttggctaaaaaaataccattagtgactttggcaagaacagttttcttggaatagtatgaaaatgtgattacagaaaactaactggtaggaggtggaaggcagagaatgactataagcaacctttttaagaagtctagccatggaggaaaagccaaagttgagagatggggtcaacagaaggttgttgtttcaggataggaaggatttatgacaacactaaaaactgtgaaggagccagcagataagaagttgaaagtaaaataaacagagaaggcagaggtggaggtgggagaagatcagataccaccagcttcctgagaaggcagaagatagagggctgggccttgcctagaaggaagaatacttcttccattataacaggagggaaagagaagtaaatgtgtgggatgcagataggttttgcagatttggtgacagaaagttaagggaggtcctatcacacctatcatatcatttctcttttcttcatgaaagaggaagtgaggtcacctgttcagagtgaaggaagaggtcagggctcagagacatagtcatagtggaatagggcagacacctgactaaggatacataaacggatcgctgcctaatgttaagggtccatgacattgatgaccatgggtccaatcatgatttcctctagaaacaagtcacaaaatagcaatccaaatgagtatatgtgtttttatactggataatctaaatgaaaagcaacagtttaaatgaacataaacgaaaaaatacaaattgaaaagttatctagtttctacaaatttccttaccaatattctctgaaaaataaaacataatgctcagtgataaacatataggatataggcggaaagattatgcacagaggcaacaaatcaaaatgcagaaaagaggaatatatgtactattaatattaaaaatatgttcaagcttaattgacagcaagggacatattatctgaactacagctatattggcactaaaatcctcatctgtaattctaagactagccatcactgatgttttatatattttcttccttgtacgtattaacttacacttaagcatgtacatatttaaatagcaaaatttggattgtgccatatggttttaaattccagttttttgttttatgtttattatatgccagtcacccaacagtcttcaaaaacacaaatcatgactgtataagaggtttctctgggtgaagaattaggaagaattcaagaaaaaaccaattacctataagacaagacaatcctctttctcctacagttactgtaaacactcttgccattttcaatttgattagaaacactagaaaacaacttacgctctagtgctcacaagtcttttccaatttaaacaggtctataaagaaaaaatactgtattctttacatgaaatttctctaactttaggaagtatgtcaaacattagagtttgatttaaaagtaaacaggctgggtggagtagctcatgcctgtaatccgggcattttggaaggccgaggcgggcagatcacttaaggtcaggagtttgagaccagcctggccaacatagcgaaaccctgtctctactaaaaatctaaaaattaaccgagcatgatggcacatgcctataatcctagttacttgggaagctgaggcatgagaatcatttgaacccaggagagggaggttgcagtgagccgagatggcactactgccccctccagcctgggcaacagggtgagactgtctcaaaataaataataaataaataaataaataaaagtaaacagacttaaattatttttcagttgttgtcaatttggccaaatatactcttatactctcacatactcttatatactattacaaagccaatgaaggttaaaagttgtaattaaaacagcaaaaacttgtttggaaaaaaaaaatggtatcctaacctatattacagaacaagaacagaaaaaatacctctaacaaatgaaattcttctaaaaataaaactatgaccatacttggtttttaactgtggatgtttttctagacagaaaacggttgatatttccaaagttaagattactcacgtgtatataagcttgagtaccagtaacaagattgccgaacttctctaaaactatcatttctagtaagaaaacccataaagatgatttcaaacaaaatcccaacatgagcctggggaaacattcatgcaccgagtagtaccacttgaggagcctgtgccagatgctgaggatgcacagaggaaaacaaaaacaaaaaaacagtcctatacccaaaaagtgagcgaatgggctccttaataagtagcttcctccagtaatctgactttccgtagctggagcaggctgaggagcagcactgcctctcagagagatgagggggaaagcaaagggcagacttcattaaagtgaaacagaagaagcatttcctcatcacaaatacacttctacttttccacatcatctccaggtaaacactagaatgcatacctgagacacaaaaagaaaaaacagtaacgacaattgagaatatctttgcctattatgggctattcagtgaacaggcaggatgtcatctctgacagaggcataaactgggattatacatgcacttagaaaagggaaacaaagcacaccaaaatcagaagacatttgaaaagtgtttgtaaaatacataatccattaactcacacctgcaagtctatgtgcaatttataatatatattaaatatatattacatattagctcacatataacatacaatagctcagtgaacgtatcgtgtgtgtgtatgtgtgcatgtttatatgttctttaagctataaaaacacttttaacaaacagttgcttagaatctcctaactacaaaagaatacaatctgaacctattattttcaatatctcttcctattaaaaaagcacatcttattattccattatcatacatttattatatatgaatatatgcataagaaaaagaaagtcaagaaggcaccatagctgatgattccattaacatacccacatacatgtaaggaaaacaaagtccagaacgcatcatgacaacatgctgacagtggttttgtcctctgagtggtagcattagaggtgattatttccttctttatgcttatctgtgttaattttttttccaaaataagcatgaattagctgtatctaaaacgttacataatggcctccaagttcttacagctttttcttacaaaaatggacaaggttaaatatcccatttgccacaatcaatgtacttacatagtatggttctgcttccctttcagttatctcatcctgatatagcgtgaaacaagttggaattcgtccaaaccacacatctcgaagcacatctttgtcatctgtcattcttccaggagttaaagcagtacatacaggctaaattcttatttcaaccaaagccaaactgaaaataaaatgaagagcattagtcagatccttgcaacgatgaatgaacctgctagaaaacaaaagattattttaaaaaatccatgccataaagattatccacttcaaaaaaaaaaaacgatgatcaccaatctttagtataaattcaaagaaaagagtacaacaaattctaaatgtaaaattattacttatgtaaaggaatcagatcaaaattacatatgccagtaatattcattgcatatttaagtactgaaccacagtcaaaatgaaactgtatctgcatcagtctttcaagcccagaagagtctactgcttacctaaagaggagcttcacctataccctgtgaatcctgacagtccaactccaaaggatcattctcgcatttacccctgccccgtccaatatattcaccttttcctactccagatagtttctcctctcttcctgcaaaactactctcccatcttagaaaatatctctttcacattggggaaaaaatctttctataaacccattccccattctaaatttcatcctctctacaatttaatcccaccaatacttccattttaattactgtacttccttttgtaaaccctctaccaaaagtggccccctgaacacctttctctgtatcctactattcccctacctagtatgctcctctctcacttattcaaatccctactctgcaaaccatgctcacagccctctggccccagtgaaacagtaaatgcttccacttggatctctcagaatattctctataccacaaatatagcactagatctgcaaaacaatattctaggtatggcataaggacatggcttttgacctctgtaatatccaagtgccttccaatgctaatattctgcaactgaataacacatcacaatacacgatatgagtaaatgctgaaataaatattgttgataatatacacttagagtaactcaacatgtggcacctggatactaagattcaatatacttatccaaataatatttctcatctttgataggcagctaattcataatctatcacaatgtagcctatgaaaacactctaaataatcttacgagtttagccaaatataaattattaacactgaattattcaaggagcttatttcccttttttttcctcttccactgaccaatgacattaagatggtataaattaattagttaaagaaagaaaaagttggaggtcaactggatgcaatgtcatctacaggtacgtaaactgcaagaggtggaaaaaatatgtccaacataaaagtactaggcaacaagaattctggttattaaactgagtccagtgctctttccagcatactactagtgttttaacttttattaaaatatatccataaaaacaactactttaagcgaatgatatacatgcatgtaaacttcatatcattccacactgataggctacaaattcaaactattgagtttctgcatttggcaaaaaatttccaagtttacaaatgacacaaaattaactcactgaaaataggaaagacctcactacgtcctgattacattaatagcttgctctttttaaagtgaattcactagtggcaaaaaataatgaaatctaggttatgacaaataagtaaatctaaaattgaatctgatataaaggtggtatgcagttgtttctgcagccatgatacatccagttagtcaacagctgcaactgagattcaccttttgatgatgaagagaaaaataatttgagacgaagagttcctctactaaaaatatttaataaaagttaattacaagcttaaagttgaagtcactatattgtcactattgatattatttttcttctcagaagaagcagatagaaaatataatccaagacaattgctcttccctcctcttcaagcactgtcctctcaaggaggaatagtaatctgattggtcagattccaggacaccacttgacatgtttattaataggcagggatgatcataaaccaaaacatcatgcatgtgagtgtggctcccttctctcccctctaggctgccagacgagaaccctgaccatcctgctctttctttccataacattctcttctgtttctcccttccacatgtcacgaacagtaaaatgaatgaccaatgctgcttctgagtcccttcccaaaagagatacaaatatagacttagaaggcagaacacctcaagactccaactacaggcttgagttttaaagtcttacgttccagcaaagtttaccaaagttctacagtaggattttaagtacaaaaactagtgaaagataaattggtactttatttcccatataccattgttgcttacatgtatattttttgcaagacctcaagggaagaactaactcagccaaggcagctaaaggtataatgtagtagagctgatacaaatgttgcaaaacaaacaaactctgcaaaacagatttatgaaaactgcaaacaaggctgcttactgcctcaaaatacacagacccaaatttataggatcttaaaatgttaatctttcaatattaatgcttacctataataaattatataagaaagcatgtctccagtgaatacacttaactttaaaaatatgtaagaaaaattggggatacatgaataaaactaaaggatgttaagttttcaataatacttttttaaagaggcaataaaacaaaatttaactcttgagaagcactatacagtagaagttagaaatgtaaaatgtggagccagactgtctggagccaaaaccagctccaccacttacagtgtaacctcaagtaagtcatttaacttctctatttctgttttctcatctgtaacatgggaaaacagcacttaccacattagatacaagaattaaatgaatacatgtaaagcacttgaacaatgtctatcatataatatgtactataaaggttatctactattataatttacagaacaagaacatgtctcaaaaatgtttaaaagtcaacatttaaagacttcaaaaactaataataatcaaaagcattatataacataagtagtaattataggtataaaaaagctaaaaattttgcagtaaacactgctaataatatgcaatttagagtcaaatatttaatcgtttgatatgcctagctgtgtggcaggtgctagaagaagaataatggacttttaaaaacctcaatcattaacaaagtataatctccaaatctactaaacatactatgcactttctgtcctttctgtgcctttgcccatgctggtggtacccttaccctaaagcagccttctttaccttatctttcaacttaaacatgctttaggacccagctcaaaataacctttcttctacacatgattcaggcagaactcgccttgttttctcttggcacctctacttttcctctacccttgtaagtttttatcaatagtatttatttgtacgtctcctccagcagactgtaatagattccgttagggagaaggatcatatctcattcatcttttcacctctgatacttggaatggtatctggaattcagtaggtgctcaaaaaatgcttactgaatttgaatttgttggaaagacagtgtatgaatataaaactacagaaccaaacagaatcccaaaaaatgaggtaagcaggtgagattagataataaaaattagttaacagtagattatatactactttaaatatcaagtaactccagaaacactatacattttacattacctcacatgtgatacacacaagcctatatgttcccattttacaaatgataaatttgagatgaggatgtcagatgatttttctaaaatcttgtagctaataaatggcggagccaaaattagaagccacatcctaactcaggtttctaatctcacattctttccatcatactatattgattgccatcatccctcccaactccaaaacatccattatgtccatggtataattaaatgttactctgtgagagttttcatggggcaggggaaagaggaggggttggagatattaatacatcctatagtgttcaaataattttaaaagatgtggaacttgaagaatgggtagaatatggacaggcaaaaagatgacaaatattctaacaggccaaaatagcatcaataaaggtattaagtgggcaggtgcaatatatatgccaacttttaaggaaattttgggttgagagtagtattaatagataatgaaagagctgataccataacctgtcttaacatcacacgtgacctttaggcaagtcactttacttcactaagcttcaatttccttacttgtgaagtggaattaatattacccaagtcaaaaggctgttctgaaaaaaaaaaaaatccataaagtgtttgatacaataatggacacatggtaagtgctaggaaatgcaagcaattattatccctctaatgtcaaatctataaatgtaaataaaatgagactagaccatgaaacataccaaacagaagactgagggggaatctcaatctcatccaccagtcctatagtgcctaccggttttagaatggtaaaataaaaacaattatctggtagcagtgcacagaagggagagccttgagtcagagaggctagccaggtagtaatttcagcaactaaggcaaaaagtaatgagtgcctgacctagagaggtagtcatggactggtgagaaacagatgagtctttccaaggaagaaagagaagttgatgaaaaatgagggataaagaacaagggcagggaagatttagatgctgacagcatgcaaaatacaataaaatagttaaggggctttgaaatcagactgacatgggtttaaaccctgatttccacctattagttacgtgtcttgaacaacaaacccatcctctttgactctcatatttgtaaaatgaagataattataattttcacagggctgttaggtgtttagtacatttggtaaccactcaataaacaatgtatgtttttagtacacagtttcctcatatttccatggcccctctgcttgaacactttttccctcctcttttggccaactcttttatcctctctgggtcaactcttttttttttttttgagacggagtctcgctctgtcgctcaggatggagtgcagtggcgccatctcggctcactgcaagctccgtctcccgggttcacgccattctcctgcctcagcctcccgagtagctgggactacaggcgcccgccaccgcgccaagctaattttttgtatttttagtagagacgggatttcaccgtgttagccaggatggtctcgatctcctgacctcatgatccgcctgcctcggcctcccaaagtgctgggattacaggcgtgagccaccgcgcctggccaactcttaatcctcttaagtgtcggcttaatatcagctccttgggaagttttcccctatgcagcctctagtctaattacttctttaatagcatgcactatcatgcaatgtagttatctgtttatcttatctgtctcctgcccctccccacattgaactgggagttctttgacagcaaaatttagtcataagtaccttcttatcaccaatattagtacagttagcacatagtaggctttgaaatttttgttaaataatggggaaaaatatataaatatatgaatctagctacttaagaaattttctccctaaactcctctccaaatcagtatagtcgcactttaaattcggcatattttgttattttagaaagattttccctctcctacatacactacaccatccaatcaccatccaatttcaaggaactgtcttggaaataaagaaactccaacctgtgacgcaatctactagaagtaagtttcttgagggcaggggctattattgacttctattttctgcatctagttcagagcctgggacagagtaggtgcccaccaacaacatctgttaaccaatcagtcattcagaaaatggcacggtgtgacaacaatataatgcataatagtttctttcacactacataccaagaaaaactaacctactacctgaagtaattttcactgacaaaacccccaactacctagaaatatcaaatacttactaaactaagcgtgtaaacagaaaaaaaattataatctatgctggctggtcttcctttaaattcataaacactagtttcctactcttccctagtccatttattctcccactttcctacatcactattctataccttctcctccctcaaatgttcacttcttcctcctcctcctcctctctctcagctaatgaccttgctttctatttccttctatccaggtactgtgaatcagtgattctcaagaggaattttactcaacagtcccaccctgggagggaggaaattttgtaaatctctccaaactgtaaatgttgaaatgccccaggactcagtccttgaaccactcccttgaagatctctcacatggttttaaataacacttatacatttacactcccacagttttatcttctgtccagacttctcttttgaactggctggcttcacatataccaccacatatgacatttccatttagaaatttaacatatgcaaaacggaaaaccatttcagatcttccttcctcctctctcctatcatttattttattttattttgagacggggtctcgctctgtcgcccaggctggagtgcagtggcgcaatctcggctctctgcaagctctgcctcccgggttcatgccattctcctgcttcagcctcccagtggctgggactacaagcgcttgccaccaggctcgggtttgttttttttgtttgtttgtttttttgtatttttagtagagacggggtttcaccgtgttagccaggatggtctcggtctcctgacctcgtgatccgcccgccttggcctcccaacaaaaagttctcctatcattatcactctgtggtcttttccgtttcgctaagtggaaaagtccttttttttttttttttttttttttttaaagagacagggtcttgctgtcacccaggatggactacagtgaaggatcatgggtcactgtaaccttgagctcaagggggtcaagtgatcctcccctcccatctcagcttcccaagtagccaggactacaggctcatgccactatgcccagctaattttttatttttttgtagagacagggtctcgttatgtcgcccaggctggggattctctcaaagatggtattacaagcatgagccatcacgcccggccaagttatattctttagttgctcagtccgtaacccttggagtcgtccttgacccttcttctacctgactgctctcaaaagtctagaatctggtcatttcgcactaccgccactattactaccctgattcaagtcacctcgacctttaacctggataaatgcagtcaatggcctactaacaactcttatttctgcacctgctgcatacagtcaacatagcaatcagatcttttaaaacacaagttagatcaactcactgcttactcaaaacccaactcattcaaagtacaaattaaggttcttataaattcccacatgctcctaaatgacttggccccatttccacctaagtatccactacttctttccctcttgttcattattttccagtcaaactagctagtatgcgcctgcttcagggcttcagtggcagctccttccaagtggcacccttctttatcacccgtaggcctccaagttaatatcatcttttctatggccaccactcccatctcttggcattccctatacccctgcactgctttggtttttttctctagcactttccgccacttgacgtacacagttggcccttcctacccatgggttcttcgtccttgtattcaaccaatcatggatgaaaaaatattcggggaaggaaaaaaaagtcagtactgaacatgtatagactcttttttgtcattattccctaaacaatacaccataacaactatttatacagcatttaagttgtattgcgcattataaataatgcagagttgaactaaagataggaggatgtgcataggttatctgcaaacactacaccattttatatcagggacttgagcatttgaggactttggtatccaagggaggtcctggaaccaatctcccacagatgccgagggacaggaaagactgtaccttaatttttgtatcaatgtcttctcaccccatccccaaagtggaacttcatgatggcagggatttttattcttttgtttactattttgtttactgttttgtccagtgcctaacacataggaggtactcagtttgggggaaattaatgaaataaatacacacttgaggtgtgtgcactattctaaaaatccatatccatacagttccattctgtacactttcccccaattttaagtagcatatctttgaagataaaagcacaggcttaaatctggtgtaaaatacctctcaattactaccctgagcacaacatcgttattttcaaattcaaaattcaaccagaaactccctctatggaaatcacaaatagttcagttcagagccaagtatccagtttcaaggtctcagaaatttaacaagccaattctggaaggctttggaagttcagctactgtctggtaagtctccgggttctgattgctcaagacaggctgtacctcctcacccctcagaaaaatctagaaccaatagtttcctaggttcctcaagttcaggataattttaaaataatccaaagtacaaatgaagtatgtaaaagtgtcttgccaacagaaaatgtctttggtagcactaaatattgttattgagacagggaatatcgtaaatagataaattgcttggaggacatacccaccgagtttggacagactcacactgcactgtgcaataaaggtttaaataactgtgttccacaaacaattcaggtcctgaactgaactctagagcctgcgactagactctcgctttcctaccttagtaagcaacagacatgtaccccaagagggaccccgcaggccacacccgccaaccggccccagggctccgggccggcgtctcgccaactccaccttgcccggaggaaccaccttcacccgccatcgcggccgggcgggcgctcctccaggcaactactcacccctccttcctaccacacctacctggcccctccccagccctcctcctctaggaatttcctcacacaaggtggacacacacacgtaccctactccaagctatggctcctccttccggctccccgcactggtggggacgcccagattccgcgctccggtggggcggcggggcaagctgcccgcctgacacactgtcctgcggggacgcggtagcaggactccaggaagcccgcgcagccgcaaaaagcaccggcgcggaggtcggagctgaaccctgctgcacttccgccctctggtatccagcgaatacaaccggcaacgctgcggagccctggcagcgcaccacaagtccagtcaccctcggcgcccggagatgacgtcac

SEQ ID NO: 2335 - DNA, 285130 bp, Homo sapiens
  source 1..285130: mol_type = genomic DNA
ctttgcgcacgcgcgccgcttcccagtggcaagcgcgggcaggaccgcgttgcgtcatcggggcgcgcgcctcagagagagctgtggttgccggaagttgagcggcggtaagtgagccgcggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggtaggcagtgctcagaatcttcagtgttggaacacgggagatgggacatttggattcccagcctggctgtgtctggatttgctgtctctggcacgttccttccccatctaagctgcttttccatctgcaaaatgggaatgataatccgccatttgtttaagtgaggaggttaaataagtttactttctgagaaagaagattctcgattccttggttacagggttagaaactaatgcacaataagaatcaatccggtaaggtaaatataggtgttagaacatttgtcagaaatagagtcaaacttctaattttataagtacagtactaacgtacatgatgttggagaagtacaagccaaaccgtgtgtgtgtgcacgtgcgtgcagtttcctgatttttaaacactggcgactgatgccattttttaaaaattggcaagtaattctggcgtttaaaaacattggcaactcagtttttacaaaaccctgttcaactgtaaccagtcatatctgtggctgtcagtttgggacctctggatcccagactccctttttcattgactacttagatttttttctctgacacctctgcccactggccagatttcttcagtgacagaaagctttctacttctggttgctcctgtttggtcctcccccagttctgactcttaggttgagctgaaagcagctactcggtaatcttagctcactgttcctccttcaggctcttggaatcacccctgcatttaattgccctatacatcattgaaagctgctagtttgtcttcctcttctcaccttttcttctctaggctaagcatatttaatgtatttgctcatagtaaacttaacagtgacagcaaattttgtcatgttttgttatatccccagcatatagagcaatgcctagcatattatatatgctcaataaatatttgttggatgaatgaataaaacaaatatttgcctgttatgtgcctggcattattgtgggcactggtgatctatcagtaaaataagaagaaaaagaaccctgtttcatggcaccttctaataatagtggtggtggtggcggtggcggcattgtcagtaagggttggtaggtgtttccgattctgaaacgtacagggtcatgggatggacagtaattggggggaagcataaaagctagctagtcagggatggcttccctgaggaagtgacctaacacttgaataaagaaaagtccagtcttggaatggctcatgttgctaaactgctttcccatcccccaacgctgctccagtcttgttaagctgcttgcaggtgtgtgtcacctatagccctttgcttctgctgcttcgaacatctccccttcctcttccatttatcttggccaactccttcctgccctcatgtgacatgattttgaaatcctttaagagctgagtactggactttccattactcaaccacaggttccgtttttcgttcccagccagcatctcattatagagaataaacatttattgagcttcagctgtgtgtctggcactgcgctgcaagctgggaatacaaaaatgagtaagatacacatccctgtcctcaaagagtttactttttttttaagccaaggagatagcaacggtatggcatgaagctattgcggaggtttggtagaggaggacttagggtacgcataagtcaggctgactcatcagagaaggtttcagtgaggaggtgctgctttagccaagacctgaaggacgaacgagatctgacaggtgaagagtggttcgaagtgagatgagcaaagggctagaggtgagaatgcatggcctgcttgtggttcactggagtgccagtgtggaggtgtaggatgagaggtgactggaaaggtaagcactagccacatcgtgaagggccctgtggacaatagcatgttacccgcacatagactttgggatccaagatagctgcgtaccaatattcccattgccactgaactagttttgtgaccctgggcaagtcacttctttctaagcttcagtttcctcatctctaagaaggggaaataaaaactgtacgaggtgatatgttactcacttgacactggtagatgataaatactcaataaacagtagtcattaatattgccaggcccagaagtttggactctaaaatgtgggggcgggggtggagagcaggacactgaagattttaaaacagatgcgacatcctctcatctgttttaaattacccaggcagcaatgtggtgattacactggacagaaaaagacaagcaggggaccagttgggtatagttgcagtgatccaggtgacaggatgaagatctggatgaaggcagtgacagtggagatggagaggagtgggaggagttgagagattaaggaggtggaatttgctggacttggtaactgataggatgaaacagaagaaggggacaagaatcaggatcctgatgacgggagggcagaaatgaatttgctgtgtggaattgagcagtaacaaaattctttgactagtgtctctaatagattaaccctgacctctgattttatttggaattcagtttgcctctgtcgtccacttctacccatggaaatgacgttcgctaatgtcttcctctcctctttttttttttttctttttttttgagatggagtctcactctgtcgcccaggctggagtgcagtggcacgatctcggctcactgcaagctctgcctcctgggttcactccatactcctgcctcagcctccccaggaactgggactacaggtgcccaccaccatgcccggctaattttttttttttttttttttttttagtagagatggggtttcactgtgctagccaggatggtctccatctcctgacctcgtgatccgcctgcctcagcctctcaaagtgctgagattacaggcgtgagccaccgcttcctctcccctttctatctcctgatctccccacccttctccagtgcgattaaggcctgattgtataatcaagggacaataaatactggaggtgctgctctgttaattggtagtcagtaggtattaccatgatcttggcagactgaggaatagcctattcactccatctcagaccggcttcagaatgatcacttttgggatttcctcacaccttcatcccagttaccatccttgaacttgctctggtttgtcagcctctctttgagtgtgtggtacagaaaggaaatcctctttccttgaggactctaaccatgcagagcaagactgcacttttcttgtggtaacctaaagccctgccagctccattatagacacattgtgcttttgacactattacactagtgtgccaccaaataggccctcagcgtggctcagccctccccatatcctcaggcagctctcttgtccatttccctttatgtcttcctcatattcattcctctcctcaacctcctaccttgacttttgctccactaagttgcagccattaattaaggcatcgcagcttcctcttctatcctttaccaactgatctttagctgaccctatccttttgccttttattctaattctgtgaaagaaatggtgttttaagactaagtcctctatttgtgcttgagatcccatcgcctcctttgcctcaaggactgggttccatcatttgttcattttcttttctgtttcatcaacccttctcatttaaatattctctgtttactctcattttggaaaaaacaaaaaccctccaattaacctatgctgcaccctgtcacacctcttttacccagccacctttcttggaagagttatctagagttgcttcctgtacttccctaagtcattgctaaaatcctgctctcgtcccaccactccccaaagtcatcagacctcgacattgccagaatacctgaccacttttccttcttatctttcttggcacatctgacattgctgaccttgcccctcacttaggaaaacccagtcctactttgtattatctctctggccatttgtccctcaatttccattgtgggctcctttcttcccctttgtccctcacatgccaatttttgccaagactctgccctctactatattcttttcaaccgcagcttcaaacttgtttatatgctcatgacccctgttctgtatcatagcccgaatctctcctgagtgctaccctcaaactcaaacaagtctaaaactaagctcctcatcttccctttgaacctgccgttctttctccattcttgaatcttgccaattcctctcctttcatttagtcatccaaaacagaaccctgagagtcatctcagactcttcctctggtactagccctcctttccatcttccaagtccaggtagtcatcagagttctatagattcgactttgttgctatctcctgactcacatctcctccatttcctcccttgctccctcatttcaggctcccctccctttttgcctgtctttctgcacagcctcccagctggttgccctgcctcagcagtctggtcctcactgctgtggattgcctttactaaaatagagatctatgcagaaatacagttgcatagcttttcacataaggctcttcatgatatggcctttgcctgcttttatggcatggtccatctactctgccccatgtgcctctccttgctgccatacagaactctatcaggggaacctgcccccaatatttcaaggtatgttctttctattttccataagtgtcagctggctgagaaataaagagaaagagtacaaagagaggaattttacagctgggcctctgggggtgacatcacatattggtaggactgtgatgccgacccgagctgcaaaaccagcaggtttttattaaggacttcaaaaggggagggggtgtgcgaacagggagtgggtcacaaagatcacatgcttctgaggaaacaggacaaggacaaaatcagaaactcctgataagggtctatgttcagcagtgtatgtattgtcttgataaacatcttaaacaacagaaaacagggttcgagagcagagaactggtctgacctcaaatttaccagggtggggtttcccaatcctagtaagcttgagggtactgcaggagaacagggcatatttcagtccttatctcaactgcgtaagacagacactcccagagcggccctttatagacccccccccccccaccaggaatgcattcctttcccagggtcttaattattaatatttcttgctaggaaaagaatttagtgatatcttccctacttgcacgtctgtttataggctctctgcaagaacaaaaatatggctgtattctgcctgaccctgtaggcagtcagaccttatggttgtcttcccttgttccctgaaaatcactgttattctgttctttttcaaggtgcactgatttcatattgtttaaacacacatgttttacaatcaatttgtacagttaacacaatagtggtcctgaggtgacttacattctcagcttacaaagataacaggattaagagattaaagacaggcataagaaattataaaagtattaatttttggaactgataaatgtccatattaaaatgaaatcttcacaatttatgttcagagattgaagtaaagacaggcataagaaattataaaagtattatttgggaactgatatatgtccatattaaaatgaaatcttcgcaatttatgtttctctgctgcagctccagccggtccctccgttcagggtccgtgacttcccgcaacagaactcatttgtattttctcaaacataccatcctggtttgttctttcattgtttcagtcatcaacaagtatttattgggcacctgtgaggtgcgaagactggtgttagaaaaacaatgacgaataggggaaaatgagaagctggcacggttcctttctcatagaatttttatttattcattctttgtttcagtcatcaacaagtatttattgggcacctatgaggtgctaagtcaggtgctagaaaaacaatgatgaatgggggaaaatgagaagctgacatggttcctttctcatagaatttttattctactgaggaggataactgcatacgtgctatgaaggtaaggtagttggtgctctttgaggactagaatacaggaggatcgacctaatccagagctgagggagtcagggaaggcttccctcagaagtgatgattgagctgtgatttgaagtgagcaaagaaattcactagatgatgggtatgtggaggtggccaagaaaattctaagcttatgcagaggccatggggtgtttctgcagctgatgatgtggagctgagtcagcttcctccctttgcctggagagtccccactccctacctctagcctcctcatccaggggtccttgcatggggctagtgctgtcatctaaccctccctttctcaaccatcaggggtgggtttagaagtttgtggagctgttttattttgctttgttttgtgacattgaccagagggcattactgcatttattgagagagagccagagatgctcaacattctgcagtgtgcagggatagctctaaacaaaaaagaattgttccatccagcatgccagtagggcccctgttgagaatctacttggatgttcttaaaaccttgggttaagggtttctataggatattcttaaaaccttggcttggctgggtgtggtggctcacgcctgtaatcccagcactttgggaggccgaggcgggtggatcacaaggtcaggagttcgagaccaacctgaccaacatagtgaaaccttgtctctactaaaaatacaaaaattagccaggcatggtggcgggtgcctgtaatcccagctactcaggaggctaaggcaggagaatcgcttgaacccgggaggcagaggttgcagtgaagccgaaattgagccacctccctccagcctgggtgacagagcaagactctgtctcaagactccgtctcaaaaaacaaaaaataaaaagcaaacaaacaaaaaaaccccaccttggcttaagggtttctataggaaacactgttgcctcatcagtctaatttagatatccctcctcctataacattctgtacaaacgccaggctatactgtatttgttttacctccaaattgctatactccgattcctcttctgttttgttgtctgttttggcttcaaaattgttagctctttaaaggtggggaccatagttttttttttttttgccattgaaccctgaaatgtagcacagggacaagtatgtaacataactgtttattgaagaaataactaatggaagccccaatttcatttcttttcttttcttttttttttttgagacagagtcttgctgtgtcacccaggctggagtgcagtagtgctatctcagctgactgcaacctgcgcctcccgggttcaagcaattctcaagcttcagccttccgagtagctgggattacaggcgcctgccaccatgcccggccctttttttgtatttttagtagagacgggatttcgccatgttggccgggcatgttattggtaaacaatatgatattagtcctgctttttgagtgtctcctatgggccagatgtatgcattttctagttgaatcttcacactaattctgcacagtaggtggtatccccatctaacagaagaggaaacagactcggagaagttgaatgacttgtccaaggtggtgtggctagaaagtagcagagacaggatttgaactcaggtctctctggctcatgaacctatgccctttccagtctagcagaccatctgccttgtccagttgttttcttgaacttagatttagggccctagatttacctctatgaaatttcaaatcttgttaaaataggcctgccattccagatggttggaatctttttttatcctgaattttagtcacttgtattgcctgtttcttcttttgtcatgaaattgataagcaaatctatatcattatccaagttattggtaaaatatggtaataagaatactttattgaatatgtttatttgcctattccccctgctcttagccccagcacagggttcagtgcacatgaaatacttagtaaatgttgataaatattcattcatgtggataaataaaataaattggacaggcccagagactaagccaaagacgtactgctattagctcctttctaattaacattaattaattcagtaaccaagatcctttgaataagattattttaccagttcttaatccctctaattatgtcaggatccaattcctgtatcttcaccttgtctaccgggatttctagagcagccttgtgagagacatttctgagacctgtatgtcctgcgtctatgattcttccctgatcaaggtaggaatgcagttactctgtcatgactttttcttagagaaaccatattggcctcttgtgattacttagggctgcctcatacagttatgcaggctgtgcactgcacaagaggccacatcaaagggggttccatttatatcataggtatcatgggtgcatttttgtaatgacagtggcagagaaggctaccatgtcttgagctaatctaatcagtatattacaacatttctctaactaaaggaagtaaaatcttgaagcagaggtgtaattttctgattgtacaaaggtgctaagtggactagagtggcccatatgggcctttcctgggagcaaaacttctgtccagtggtctttagaacccatctttattcttatctttgaaaaatcaggccgggtgtggtggctcacgcctataatcccagtactttgggaggctgaggcaggtggatcacctgaggtcaggagttcgaaaccagcctggccaatatagtgaaaccctatctctactaaaaatacaaaaaattacctgggcgtagtggcgggcgcccataatcccagctacttgggaggctgaggcaggagaattgcttgaacgtgggaggcagaggttgcagtgagccgagatcgtgccattgcactctaacctgggcaacaagagcgaaactccatctcaaaaaaaaaaaaaaaaagagaaaagaaacaaagaaaaatcaaacattttgaaaatcggaaatcaggcctttgcttggcccagttttaaagtacttctcccgtttctcaggattctttaaacataccagaaatgaaaaccacagagatgtaattatttagaagcaagccttcataactcagccagcttttaggaaaccatcatagattttagttgttggttggcatagggctccacagtgatttagacaaatccaggtgggtgtctctcagatgaacagagaaatgggcaacactgttgatcagtggaggtaacaaaaggactcagaaggaggcacactgccctccatcttcctggcattattgcttcctctctcctctttcccacattttctcagctgtcactgtccctcccatgtaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggtgaggaggacaactcacccatcatagcaattttcctaactgccagtgtgatcagctgttaccacagaaatcacctgaaagcacagtcacaaaccaatttggctgacttgatgatttgatgtcttgtggagatgttagttttgctcagggacatcttgactctaatgcaacttttaaaaggaagtgaggtttctgtacccagctggtttccctgtaggagtcctgagttctcatcttccggtagagcctactctttcttctaagtttagaactttttcccttcttttggaagagaaggctttaaacctccctctttaacagccttgcagattgtttctgaaactcatgaggttgcagaagcatcatttgtctataaaatgtgcattggctccatatgccaaagcagccccctcccgactcctggtgatctctacctcctttttacacatcagcagctaagaacatatgctgtttgtcagcgggacttggtcatgtggtttggtgcttattttaatgactgccagagcttgcagccctgcagctgggaaaatgagaatagaagcctgctctgtgtgctccattttggcccagagaaggcacttcagggccaaattgcagttattctggcacttctgctaagtgaatggccccacatgggctcagagaaatcggacactgagtgctcgctgccctttagaacttgttcttttggacttctcgatgacctgtagtgggagactgaccatttccttttaattaagcctctgttgtgcttgcagagctcttttgagggaggtaggctttaaatgaggcatgttttaggcagaggaaattttcatagtgagcatggggaaggggaaccacattagtcaggcattgttggctaatatggggcagtgacaagaaaaactaccagcagctaccatttattgactgcttgctgtatgccaggcactgtagcaagcacctcacaaacatttagccctcccagcaagttctagagtagttatacctgtccttatcttacacctgagtaaatccaggtgcaggggggtgaaggaacctgccctaacctgccctaggcttctcagccaataggaggtggaggtggaatccacactcgggttcatctgtataaagacctgattcctgactgcattacattacctctccttttagcatcctttccctgaaccattaaaaactctcctgcttgtggtggacatggtggctcacgcctagtaatcctagcactttgggaggccaaggcaggtggatcacctggggtcaggagtttgagaccagcctggccaacaaagcaaaaccctactaaaaatacaaatattagctgggcatggtggcgcatgcctgtaatcccagctatgtgggaggccaaggcaggagaatcgcttgaacccggtagacggaggttgcagtgagccgagatcacgccattgcactccagcctggacgacagaacgagactctgtctcaaagaaaaacaaaccaaaaaaactcccctgctctcctaaagcaaacagacaaaaaactaaaacacacagaaaaatcagagtgtgataatttttagcattgtcaggctggtttatggaaactagaggcctgtgtgtctagcttcccctaaagacaggttctttttgtttttgtttttttctctccctctgttttttattttctacaattacttcttcactttaaagtgaattacttcttcatttaaaaaatcctgtatttcttcattaaaaaatatcctacacttcttcattttaaaaaatcctatactggcttgattatttgctgtgtccaatcctagagggagaatggttgggcggtctcactccaggaagcactcctgcttcaattaattctataagcagccaagccaaaataattccatccttagcttctttagtcacaaaatgccagaaaactttatggaaatgatttctcatttaggctacttatttagagtaatgaattgctttttaccaaagctaaatttaagtaggtcatctgttaactgttggatgaataaatgaaggttctcttcgtaggactggtatggtttaaagataggggttttgttctacttttttattttattttattttttgagacggggtcttgctctgttgcccaggctggaatacagtggtgcagtcatggctcactgcagcttggattgcctgggctcaggcgatcctcctgtctcagcctcctgagtagtcgggaccacaggcgtgcaccaccactccataataattttttaaaattatttgtggagatgatatcttactatgttgcctagagtggtcttgtctgggctcaagtgatcatcctgctttggcctcccaaagtgctaggattacaagtgtgagccactgtgcctggcctttttttttttttttgagacggagtcttgctctgtcgcccaggctggagtgcaggtgcgcaatcttggctcactgcaagctccgcctcccgggttcacgccattctcctgcctcagcctcccaagtagttgggactataggcgcccgccaccatgcccagctaattttttttttgtattttcagtagagacggggtttcaccgtgttagccaggatggtcttgatctcctgacctcatgatttgcccacctcggcctcccagagtgctaggattacaggtgtgagccaccttttttttttttttttttttaaaagcccggccttttttttttttttaaattccttcctgtgacagattctcaccctgtcacgcaggctggagttcagtggcacaatcacggctcactgcagactcgacctcctgggttcaagtgatcctcccacctcccacctcagcctcccaagtagctgggactacaggtgcctggcaatttttttttattttttgtagagatgggggcccaccgtgttgcccaggctggtcttgaactcctgggctcaagcagtcctccttcagcctcccaaagtgtggggattacaggtgtgagccactgcacccagccctattttacttctttattcatggataacatacataaagtgcactgatagcaaatgtttagcttgtggctttttacataggtatatgccttgtaaccaccacccagctcaagatacagaatatttccatctccccaggagccttcctcgtggccttctcaagtcagtagctccacctcaccctgtaatcaccattctaacttctgtcaggttgattggttttgcctgttgaacaacgtataaagctgtgtgtgacacacagcttttatcttaatagtaagataaaattattcttactattttattttggaacagtttcaaacttacagaaattctacaagaataagacagataccttctatttatccatctcccagagactcccattcagtttttgtcccaataatgtccttttatagtggagcatcatcccaggatcacacgtggtccccagctgtcacgtctttgtggtctctttcagtctgggacagctccttgtctccctttgacttttaagaccatggcacttctgaagactataatcctggtcattttgtagaatgtttttcaacttgggtttatctgatgtttcctcccatgagatccaggttgtgtattttcatccaaacaccacagatgctgtgttctttccatggcattctatcagatagcacacagtgtctgtttgtcacgttgctgctggtgttaactttaatctcttcattaaaatgctatattaatgaccagatattgtcactagtagctaccagaatgctttcagaaagaaacatttattcttgactactttcatatgcagttgcataaggttttatttgcactgatttgtgcatgcatgtttcctgcccgctaaggtcttagtcctgaaaaaacaataataggtttagggacctaagttatatggcatatcgtcgtatgttcttcatgattccttactccatattctgtggtaattggcttctggggtttgttctcatagtcatagaagtttgggttatttcttgcttttgtttcttttcgggaggatatctatagaaagttccttgtttttgttttgtgtttttttttttgtcttttcttttctttctttctttctttttttttttttttttttttttttgagacagggtctggctcgatcacctgggctggagtgcagtggtgccatcttgccaccttggcttactgcagccttaatctcccaggcttaagcgatcctccacctgagtctcccaagtagctgggaacacaggcgcatgccaccgccatgcccagctaactttttaaatatttttggtagagacggaatgttgcccatgttgcccaggctggtctcaaactcctgagctcaagctatcctcccgcctcagacccccaaagtgctgggattgcaggtgtgagccaccgcacccaacctttttttattattattattattttatttttaaattaattttttctagaaatggtgttctgctatgttgcccaggctggtcatgaactcctgcccccaagcagtcctcctgcctcagccttccgaagtgctgggatgcaggtgtgagccactgtgcctggctgataaaaggtttctaaaattcatcctagtaatgtttgagagccactcacaagggattagggacattgaaaggaatatgagccaggatctgtatttgtagagtttacaatcaagtttggtggaggcaaacaggtaagcaaagagttgaaaaacaataccaaatgtctaggtggcttagagccaggagtgattaaatatagctgccaggggaggagtatgaggggagtgaagacaggcgaggcacctctgagaaggctttcctgagcaggtcacctctgagctgctctgtgaatgccaggcagtcacagaagcaaggtgagggagaacagggaacacttttcagacagaggggctgtgagttctaggccatgggggcctgagagcggctgctaaggagcatcaagtcagaggtgaggagtgacagggccgtggggtagaactagaaaagtcggaaggcagcagcggcggtctgggagaaagcataaggaaaccatcagaggtgtagtcatatgcctgcttaagatgtagaatgctgctgatgcagtctttccggaacgttatgagccttaataaatatcaaatgagcttcgtcttggcttaatgatgctgagagatgtgtgaatgttttgagtagactgtatttaccagttcataaagaagtatttgcagcattacaaggtgcctattgcaggccagcagatgtggccttagaatctggccttcgccctcagcgccctcactgatctttactgccctttaaaaagattatgccaaaaatatcagtcttcctcaaaacaaaatatactattggcaccttcaaagaatcaaaagataacaggtttggaagatcatttagtccaggagtcagcaaactatagcctgtggatcaagtcctgcccgaggcctttttttgtgcagtccaggagctaagaatggtttttgcatttttttaagggttgtaaaaaaaataaaatacacagcagactgtttgaggcctgcagtgccttaaaatatttactatctggccttcttcaggaaaagcttgccagaccctggtcttgtctgactgcctgatacagcaatcctttgtgcagtattacgtggcaaataatcatccaatatatgcttgaacacttctgctaatggagaactcattatctctctgatctatttcctgtttggacaattcaagctattagtaatttttaaactgctgaaatttatcttactatatagcatccatccattggccctttgtgcgaaaagagagctattatttcatttcaacctttactgagctcttaatatgatccaggcactgtgctcagtcctgaagaaagatgagtaagacatggtgcttgtttcaaggatctcccagctatgatttcttggaaccaaagcagttgagctgctagtcttttatctctctctttgtcttcttgccattgggttaggacttttttctttaattattttagttatttctgtattgttttatatacataatacaaactttaagaggcaaaaaaggtcatgcagtgaaaataagtctccccacactcctctctcctcacctcctagcagctttcttgggaggcaaccgccactgcacatttcctgtggggatttgatcttaaaaaacaaaagatttagatccatgtggacagaaacttttggtaagtactcattcagtgacattttctgagctcctacttgtgctgagtgtgactgagttttattttcattaaagtctgaaatttgcaccaagtttgggtggtagacacagccccgggggattgtattggttaaccacacacgctgctatttcagtttaatcttgactgaacttcttggctactgcaggctttcttacaccactagagttcttgctcattacagtgttgaatccctatcaaaacctttcctgtttaattggcagtgacacaatcccatcttgtgtaactcaggatgtttcacatcctgaaatagtttgaaataaaattgaaacacacttacattgatgcctatgttaatttctttccttgactgtgtctgaatataatgttgaagtgtgatagaaacaatcctttatctttctaagctaagcagaggccgaagtttcacttgcactgtccagggttatacaggcaagccttactttttcaggaagtaggtaatgtttggatttagattagtgacacatgaataactctgtctatgactcacttccccccaaattcccctccgaccattacttcttaaatcttcccttccagcttaagcgctgtagtgatgttacatagacgtgtatgttcctaagtgatacctttaccatagattgtcctgtttaggtatttccagaagattcctcatcatgctgatgttgcttaagacttttctgttttcagcctgtcatggaacggtttcagcagctcaacatcaactatatcctcttatgaaataggcccttggattctgttcagaatttccctaaggccaaataagtcagaaaatatttgaaggatgtgcctcttatgcaaattacttttgtgcaatcatggatcactgcagcctcaacctcctggtgggctcgagctatcttcctacctcagcttcccgagttgttgggactaccgatgcgccctgcaatgcccggcaaattttaaaactttttttgtagaaatggggtctcaccatgttgcccaggctcgtctcaaactcctgggctcaagcgatcctcctgcctcagcctcccaaagagttaggattatgggcatggaccactgcactgggccttttttttctctctctgtaaaagtagtttatttgttctgtttacaaagtacagggaaggaataagggcaatacctggaacccctttggtcgcacatcttcccagtctatgcttctataaataacgtttgtacaacagcaaactcatattgtccccatgtgttttctcacatcctggtagctgcagtctatagtatagaccgggtaggaaatagatgcctgattcacagggtagggctcccctccaattagtgttccagctcacttttgctaatattgaaacagaagtaactagttgttcttaaaaactctctcatgaacaagtaggtcataagcaaattatgtctgcacaactcctagaattgtttcaaataactttatagaaaggcagtgactaaggccctttcctctttcccatctttctaagtcctaggctgccttcattcagcacctggactgccgcctgggtcccccacatcccagcgcggtgatggaggaggggcaggccaggccaagcatgaggaataagctgtctttactgggctcagaccaggagcccatggtcttgaggaactctgtatttatcagttttcttctccacgttctcttccacctgtttctgcagcctcatggcctgtttttacttttggtagtggatcttggccttctccttcctcttctcctccaggtagctgtcactgcctggtacttccagccaacctcatgaaccagccacccccaggtaggcagactttattttaggcttcagacgcacaaccttgaaggcaccaggaaccactatctgcaattaatatacaaaatgtctgttatcttctttttttttgagatagagtttcacccttgtcgcccaggctggagtgcaatggtgcgatctcagctcactgcaacctctgcctcccgggttcaagcagttctcctgcctcagcctcctgagtagctgggattataggcatgcaccaccatgcccggctaatttttgtatttttagtggagacggggtttcgccatgttggtcaggctggtcttgacctccttaccaagtgatccacccacctcagcctccaaagtgctgggattacaggcgtgagtcacttcacccggccatgtctgttatcttttaagtagtcatccttagtcgcttttacccagctaccgaagtgctgtagaatagagttttcttttttgtctttgtgattctctggcactggtaaaattccatcttgatgtccttagcaggtcatcaaaattatgatgaaaacaagttacatttgtccttgaagagaaagttgtggatgactgacatatgtagggacttgatgatctgtcacacagaggattttagatgaaatccttttgtaccactgtctgcaactgtgttgatttccttccacattggatgatagctctggccagggcctttttgttttgactgttggagaggaggttagcttgtgaataattggttattttttagcatgtgtgaggctgatgggcagtagaaagttcctgaaaagaagtttcttccttcaaggcagtgtaatatagtgacgagaacaggggctttgaagctagcagacccgggttatcatctcagctctaccacttcctgtgtgactctgggcaagttacttaagctcccagtgtctcagttttctcttcagtaaagtaggcataatcttaccactggggttgtcaagggaataacatgtaaactgtttagtgtagtgcttggtacagaatgagcatttaataagaacagttactaatatgacattactactgctgttatttaaatagtttttaacagtattatcaaaacagcaagcacagttcatggtggtaaatgccctaatggaagtgttcatctgtcaccattgagaagggaactgttaatatccactgactgttactgacagcttcataaggaccttgtgagatgagaagtacttttcctggtagagaggggaaaggtttcctaggaacatcagccatgcagaagatcaggaaactagcaggctaaggctgcagcaccttattctctgtgtagtaaggccagtaagctttcgtttgtttgtttaaacaagggagccacctgtgcagatcattcctggtggcagtttgtcaccttgtttggaggagatgggccaaaggcagtgacccgtgagtatatcactgcaagagccgaggtgtgagatgatggagcctggcacgtagcagtgggaatggagagaaggcaggcagacctagacaggaagcatgaagttgcatgaggagcatgggcttcagagtggcgtgaatctggaagctgaatcctggttcccctactttcctagctgtatagccttgtgtgaatttatttttttctttctttctttcttttttttttttttttggagacagagtctcgctctgttgcccaggctggagtgcagtggcacgatctccatcttggctcactgcaacctccgcctcctgggttcaaacaattctcctgcgtcagcctcccaaatagctgggattacaggcgtgcaccaccacacctgggtaatttttgtatttttagtagagatggggtttcaccatgtttgtcaggctggtctcgagctcttgacctcaggtgatctgcccgccttggcctcccaaagtgctaggattacaggcgtgagccaccacacccagcctccttgtgtgaatttcttacttcttggaacctcagtttcttcctctataaaattggagctattccttagggcttctgagagaattgaattcaattgaacaacccttgctgctgtgcctagttttggtctgtgttcagtaactgttaaccttcatctcattccagaggactgtttaagattgagcttctaggaattagtgctttattgcgttgagagagagaaaaattgaagatgactttgaaatttcttccttgaattaaggtgatactattaagcaaactaggaaatacagagaaaggggcagaatttagggaaaatatatgttgaattttggatttgttgaatttgagattctgaggaatctaagtcctggctttaaaggacacttaaatatatgtttagaggttagagctagaagtacagtcctgagattcattggcatacagacagaacttgttgtagaaagtgaatgatttggccgggtgtggtggctcacgcctgtaatcccagcactttaggaggccaaggcgagcagattgcttgaggtcaggagtttgagaccagcctgtctaacatggtgaaaccccatctctcccaaaaatataaaaaattagccgggtgcggtggtgcatgcctgtaatcccagctactcaagaggctgaggcaggagaatcacttgaacccgggaggtgaaagttgaagtgagccgagatcgtgccactacactccagcctggatgacagaatgagactctgtctcaaaaaaaaaaaaaaaaagaaagaaagtgaatgactggccgggcggggtggctcacatctgtaatcccagcactttggtacatcaaggcaggcggatcacttgaggtcaggagtttgagactagcctgaccaatgtagcgaaacctgtctctactaaaaaatacaaaacattagggccaggcatggtggctcacgcctgtaatcccagctacttgggagtctgaggcaggagaatcacgtgaacccaggaggcagaggtttcagtgagccgagatcatgccactgcactccagcctgggcaacagagcaagactccgtatcgagagaaaaaaaaaaacattagccgggcatggtgacacacacctgtagtcccagctacttgggaggctgaggcaggagaatcgcttgaacctgggaggccgaggttgctgtgagctgaaattgcaccattgcactccagcctgggcgacagagcaggactccgtctcaaaaaaaaaaaaaaaaagaaaaagaaagaaagaaaatgaatgactgaggagagggctgagcatggaagccttcaaaaaccaacagtagaagaaaacgctagctgcattgtagaggaaaagagggaaagggagagattagaggcccaggaaacaacaggaggctgtgagagtgtttctacacgtgtgcctcaaatcctcaaatcacctgttttctttttattttattttatttttttttgaaatggagttttgctcttgttgcccaggctggagtgcaactgcaacctccgcctcccaggttcaagagattctcgtgcctcagcctcccaagtagctgggattacaggtgcactccactacacccggctaatttttttttatttttagtagagatgggggtttcaccatattggctaggctggtcctgaactcctaacctcaggcgatcccccgctttggcctcccaaagtactaggattacaggcgtgagccactgagcctggccaaatcacctgttttccattgggcaaaattataaaaattctttcaaacaattaaaagccaaaaaatatttaataggagttgagggtgcattcaaatacatttgaggtgattttgaggtggggcctccaaaaataagtgccagtgacctaggcttcaaaatagcaccaaacctacagcagcatcacctgaggcactaggcaaactccagactcctggcctccatcactatcccttctcttatcgaatcttctttcctccacaggaagtgggagtgagacccaggcatcctcattttttaataagtgctcaaaggccgggagcagtggctcacacttgtaatctcagcactttaggaggcctgggtgggcagatcacatggtcaggagttcgagaccagcctggccaacatagtgaaaccacatctctcctaaaaaacaaaaattagccgggcatggtggtgcacacctgtagtcccagctactcaggaggcttaggcaggagaattgcttgaaccaaggaggtggaggttgcagtgagccgagactgtggcactgcactccagcctcggcaacagagcaagactctgtctcagagaaaaaaataaataaatatgtgctcaagatggtgaatgttggaaaacgcttggtcaggcgctatctggggatgtgatgctgcaagccacactgaggcagtggggaattttagggacagtgatgtgttgtcttttgtgatcaatgaagcttatcaattatatagaaaaataattattataattcccacctcattccttctgtttgcttttcagtttttttaagaccttgttgtgagtctttcattcattcaaaattggatttctgttgccaaaacatctttttaaatgtggaaagcatattcagcctgttgaaaaacaacaacaaaccacccattaggaatccagtggcagactaacctgccccactggaacttgctacggacacagtcagttactcccctctggtgattctgccttttatagcctgttctcttttaagcaatctacaatgaaattgcattttagaaagccaccaccgcactccttttaaacattaaatacaatgtttaaatgaccagtcattttctttgattcctagtgtccattcatcattactcttctcaaagtttttttactgcttagagttggtagatatatgtactgtcctggtgttccaactacagctttctttgttttactggttctatttctttctttcttttctttctttctttctttttttttttttttgagatggagtttcgctcttgttgcccaggctggagtgcaatggcacaatctcggttcactgcaacctctgtctcctgcagttctcctgcctcagcctcccaagtagctgggattacaggcatgtgccaccacacccagctaattttgtatttttggtagagacggggtttcaccattttggtcaggctggtctcaaactcctgacctcaggtgatccacccgccttggcctcccaaagtgctgggattacaggcatgagccaccgcgcctggcctactggttctatttctttttactccctaactgcggacattctctaggactttgtggggctttttctttctctgagtaacttctaagaactgatcattgtcacctgtgttagctgttctctcagtatccatgtccagttttcttggcttatctttgccctgctgttgtccacagctgaaaatgtctttcattattactcttctgaaacttgctttgcctctcaagggtcttctctttcactcaagctgccattctcctagccatttgtggcttgacaccccaagagctttattctctcttttcattgcttgagtccaccaagataccaagttaggtcaccttttattttaaatcagccccaacgagggtcccctccttttcacttttactcctctgctctaatccaggtcttcataaatttttgggcttttagctgatttccctgcctgcctctttcaaagccctttacccactgcggaatcatatttaccatgcaggactgccactggcttcctcctccaaaattcgttagcctcacatttgaggcttctccataggtgttcacccatgtcacctgctcagctctgtgtgtgctgctcctgcacagcacaaaccctccacatgaggacagctggtttcacgtgtccctatttctgccatgagtattcctctgctcttcttgttccttctgccctccacccatcttcccccaccccttacccatccttttcaacatcactcagtgcccatctgcttcacggtgtctttcccagggctctgccccacattcatcccattcttcttgatttgaataccttttatgtaggagcactaactttgtatttcattatacagtttctatcaatccaaagctccttatctctaattctaaatccaacaagtttggaaaactgaaagctttttaatagtcttggcacaaaactcaagcaaaacctccctgagtagatatgagctgtttttaaaaaatatatcccatttggccaggtgcagtggctcatgcctgtaatcgcagcactttgggagaccagggtggaaggatcacaaatccaagagctcgagaccagcctgggtgacatgacaagacctggtttctactgaaaatacagaaaaattagccagtcacggtagcccatgcctgtagtctcagccactcgggaggctgaggtgggaggattgtttgagcttgggaggctgaggttgcagtgagctgagattgtgccactgtactgtagcctgggcagcagagcgtgaccctgtaaatgtatcccatttacagtgactgttcatatgttctgctgcagaaatacttgtatgtctggttgtggggtaattggacagaatggaaagtgaagggaccttatcaatttgctttttggagctgccagatttctttagtattgtccttctcaaactggggtatgttaccccggagagtatggagggattatagaaagttacagtatacgtatgcatgattgccaggaaggtcaaatttattagatgattcgaagggggaaatgaaataataaaatatatatcatggcacaaaatacaaaatttccatgcattgaaaagataaaatatgagatttcaaagaaatttaggcactgtgggaggtggggagaagcatatcctcattatctgcttcagctagaggtgttaaagcactgctctcagacagaattctgacagtttgggttgttgcatttctgagtggctggatttaggattttgtacttgcagagttctccaggaccacacaagatggcaaaaatttctgagacagtgtctgtgtcgaagaaggaataacagtagtgcatcagtcagactgactcaaggaaggaagaagcataaacattaaggccgcaaaggttacttagaaaaatcactgtgtcatcggtgaaaccctgtctctaccaaaaatacaaaaaattagctgggcgtggtggcatgcgcctgtagtcccagctacttgggaggctgaggcaggagaattgcttgaacccgggaggcggaggttgtagtgagccgagattgcaccactgcactccagtgcaacagagtgagactccatctcaattaaaaaaaaaaaaaatcactgtgtcatgaggagaatcagcttgacaacacaggccaattaggatggttttcaaagttgtgtcttaagtgaaataagccagtcacaaaaacacaaatactgtatgatgccatttacatgaagtagtcaaacctgtatagacagaaagtagaatggtgggtgcaaggtcctgggggtaaggaaatggggagttattgtttaaagagtatagagttccagttttgcaagatgaaaaagttctggagatctgtttcacaacgttgtgattatacttaatatcacctaactgtttacctcaaaataatcaagatggtaaagtatatgttatgtgtttcttaccacaatccaaaaagaagttgtgtttcaaggtagcctgtaaacatctcattactttttgtttgtttgaattaaactttattacaaatgttctttctcaccaggttttgcatggatatgttattttgctgtgttctgttttgttttttaataggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtaggtgattgtaaatttcattttccatcatcttctgttatcctcacggtcctccagtatagtgtcagctttcctttagaaagagacagccttgtcttttataatcagtgctcttcactagtttctattttacttcctgactttttgatcccagttcattttcatttattttctcttgttgtggggaaaaagaaagagagtagtgaaactcaaattattaatccaaataatacccattacttagcattgctgtgggaagagattggaaatattttttccattgaatcttttttatattcttggcgaatgtctcatattcacaagagctctgtcacattctgccatttatctatccatacatatattatctatgtagcatagataatcagaaattggatggggcgccttgggctcaacaaagagaagaaaactattcataagcatttttgttatgaacgctgctatttctgacttgtcattgaaaatgtgataatgcttctgtccaggtgactctgctgggctgccagctcgcttaacattggagttcagtgcttttgacatgtgagtatttatttgttcaaaatctgaagtaaagaatactacttttggcaaggaataagcatgcttgcctccctcataggtggaccacaggaggactagggaagttcccggtgggcagagtcagcccccctcatgattctcttatacctcccatagagatgagtgctggatacttaggtctgcctggttaatttttcaccacctatttatcagagtcaattaggtgccaggtgccatctagattgattgagacatagataatatccctcttgattttgattgtagttaatattttgtgttcttttcttgatacctctcttgattcactcctttagtccatgggcattgtccatgggcattgatcaatgaatgtttattagtctacttctgtatacaagccactgtgcaaggcattatagtgctatataaaggaatatgatagatatatccttgaagaatttttttaaatctgcttgggagctgtggggagttgctggagagaagagacacacttttttttttttttgagacaggatctcactctgtcacccaggctggagtgtagtagtacaatctcagcccactgcaacctcttcctcctgagttcaagcttttctcgtgccttagcctcccaagtagctgggactacaagctcacgccatcatgcctggctaatttttgtatttttttggtagagacagtgtttcaccatatttgccaggcagatcttgaactcctgacttcaagtgattcgcctgccttggcctcccaaagtgctgctgggattacacgatcgagccaccacacccagccaagagacacatttattgagcacttaattaggcattttcataaacatctgttctttgagactcgccaggtgtgatttttctctcttttttcagatgaggaaagcatgggatgaaaggtaaaaatggcttgcccagggtcacacctggccaaatttagaaagcaggggtgagagaaaaaaatgtatttataaatgtatttctgaaacacagtatgagtagctacagggattttgctatcttctacagaaatagagaaaccaggagggggatacaaatttaggaggagacaagtttggtttagaatatgttgagtttgagatgacagtgtctgctagaaatgtccaggaggaactggagacggggagaaaggatcagactagatttgggagacatccaggtagaggagaaagagaataaagatagtctccaacttatggtggtttaatgactttttgactttacgatggtgagaaagcgatacacattcagtggaaattatactttgtggacccatacagccattcggtttttcactttcagtacagtattcaataaattacctgagatattcaacactttattatggaacaggctttgtgttaagatgattttgcccaactctaggctaatgtaagtgttctgggcacgtttaagggaggctagactaagctatgtctggcaggttagacgtattaaatagagttttgatttatgatatttttttcaatttatgatgagtttatcaggacatggtaagttgaggagcatctgtatagtataagaacaaaaggcgcaaacagtgaatggctctaattagggaggtgaaagatgatacagaactagcgaaggacacaggggttgtcagaggaaaaccagaaaagtgttagagaaaccaaagaaggcaatgctttctggagggaaagagaaactaacagtgtcagaagcacagaggtcaatgcgagggccactgtgtttgttgattaagtcattgtggtccttaagaattcagtttgagaaagagggtggagctgaaaccaagatgagggcctttaagattattgagaattgaaaaaggctacagtgttttttctgctttattgtacctcagcagtatcaagatggggaattttaggaaggtgaagaagtcttataggtctttctggcttttgaaagtggcaatggtcaactattaggatatttaaaataaagtgtccctagaattttttttaatctcagaaaatcaatactttttttccctttatctcaatccagttgcaaaatttgaaagcacgatgtacatccacaatgattttagtatttgtatctttaaaaatgtatgtgttggtgtttcttgttccctttggagctttcttgctccatcgtaaactgcttgtggttacctgtcaaaagaaataaaatcctaataatctctctcttgttttggcaaactaacttattttggagccagtaagatatgacgaggaaactactggaaatgtacaagcattaaattgtctgaagatggtacgggggagcatcaacagtctgttttgtgtaatctggagagcctcatatttatctcagactaacctcactcctatccttatccttctactggactgtttgttttataaggttttaataattttattctttagaataattaattagaaaaatgcagttcacagaagttaggtttgaacttactacaaaatgtgagcatcttaaacttaattaatctaaaaattttggttgaaggagataagaaaatctgtgatcctgcagctatgactttcacacaaattgctcattttcactcatcatattttttctttaaccgttgaataccctcagtgtgcaaggcactgtggtagacagtgggatgtgaacagaaataagatgtggtccccattgtgtgaaaatagccctggattcgaagtttgaagatttggaatctatggctaattaactgtgctacttcaataagctcttttagttttctcagcttttgtttcctcatctttaaaatgggttcttgctttctaatgttctttccagttttaaaagtctgtcactttctgagtccctattaggatggctgagaagtttaatgaaagtgcttgggacttctcagaaggcctgatttctttattccaaattatttcctttattattaccccatttttgttttgattgctgtatatctgcatgggttggtagagaaagtctttatgaatttatttatcaaagaaggaatatctacaatgtgcagatgtgtgtgtgttaggaatacaaagacttatgaaatatgttctccagagctcctctactgtatgagagagagaagtagaaggcaaatatttgcattatagtgtgctcagtgctgtaataagcatggagaggtaatcattatttcaggaaaacttattgattgcttcctctgtgtcttgataacagaatgtgctaggtgctgggcatacagacaggaatgacatacagttgaatagctaacaatcccagtactcacttatagatgtcaagagtatctcagctttgcatagcactggataagtctcttctactctgtgcccctgatagtcttatggatctctaaggatcctgttctctgaattgtattagatgaattgtcagtcaagtagtattttatcaggcaccaactgtcttaaactggaatatgctgtcttgagttagggtatcctgctggatcagacccaaaaatgtaagggcccaaacactaagaagttcatttcttgctcatcaaatagcccagggctgctggtccagtcttcttccatgttgtggctccattatccctgaggactttgcattgtgtgctgattaagacagttgtcactttcaggtaacaacagattaatgaggaaagacagccaaggtgcaaacaggtggaagagacacacttagtctcttaaaggccctggagggaagggacatttatcactccactcagattctactgaggagaactcgtggcctcacttgtcttgcaaagaagactgggaagcgtggaacccagctaaaacgttatgtgtgctttctgtttctgttgacaaggaggaaaatagattttgattgacaatctctatacctatgtgaagctgagaaaaaaaaagaattttccgccaggcgcggtggctcacgcctgtaatcccagcactttgggaggccgaggcaggcggatcacgaggtcaggagatcaagaccatcctggctaacatggtgaaaccccgtctctactaaaaacacaaaaaattagccgggcgtggtgccggcgcctgtagtcccagctgcttgagaggctgaggcaggagaatggtgtgaacccgggaggcggagcttgcagtgagccgagatcctgccactgcactccggcctgggcgacagagcgagactccgtctctaaaaaaaaaaaaagaattttcctttctctgggcctcaaatgatcaacatttgaatgaagaacatttctgtgggtttctttcccttgaggaatatttgtctttattcataagaaattttcttttcggccgggcgcggtggctcacgcctgtaatcccagcactttgggaggccgaggcgggtgggtcacgaggtcagggatcgagaccatcctggttaacacggtgaaaccccgtctctactaaaaatgcaaaaaaaaaaaaaaaaaaaaaaaattagccgggcgtggtggcgggcgcctgtagtcccagctactcgggaggctgaggcaggagaaaggcgtgaacctgggaggcggagcttgcagtgagccgagatcgcacgactgcactccagcctgggtgacagagtgagactccgtctcaaaaagaaaaaaatgtttttcttttctatgcctcaagttggacctaattagagaaatagaaggcataattcttgccctcaaagaactgaaaaggtagtgaaggaagtaggagtcttaggcacactcgtgtgtggggcagaggctgtgtctttcttattctctgctgtatcaccagcacccaacacagatctggggtgtactatttgctcaataactgcctaattgaattacaagcggtctaagcgcatggctgtcaaaatcacatgtggtgtggttgatggaaagacaccagtggactgtgttagaggatgttacaaacagaaactctgcgattgctagggaagtcaggagatgacaaagaagcatgacccccaacatgacccccaactgactgtgactttctgggttcccagcgttccctgtgggcatgtgaagctgtgtgcgaagtagattcctccaggtatgatgagcacaggtgctcttccagaggatttattccgttctgaccacctgcctgcctgttggccaagtgtaaataactggtgcaacacagccccagcactttcctgagtcatcgctgtgagactgaatgaagtgaaggccaagtgtctagctgtaatgtccccaaagcaggcccagtcttccggcctttgtgagatccatttttactaggttagtatacgcattatcgcaagttcactattggccttagtatgtggagaaaatttctaatttgaattctttttaggagctatgttgagatataattcatataccataaaattcaccccttagtttaaaggggtacgattcagtggtttttagtagattcatagagttgtgctgccattactattaattccagaacatttccatctcccaaaaaagacacccttagcaattactctccatcccccctcctccatactcaccagccctagccaaccataactctactttctgtctctgaggatttgcctattctgcatatttcatgtaagtggaaccataggaaactaaactaggaagtgtcagaaccaagatttgaactaaattctcttgtctccaagtctcaggctccttccctctcattatcactttttaaattcattttcctgccacctcccatggtggaactttagtcatgaaagatgcttctcctttgaagcttccgattgtcctggctaattaacttgcataagtgctgatgctcctaggagcctagccatcttgcagttgcttgagttcttggtatgcagttttctcctttcacaaaatgaggctttggtatggctctcacacacctgggaagtttgggaagaagggtaccttcctcttctgtgcttgtgtccaaattagatcatggcattcttccttctgtttccacatcctgtttcagcagtaatttcataaagccaagtctgaatgtagaaggcctagtttaccaactgctctgctttctttgccttccctctgggcttaatcttttccctttgtgatttctctctcttcaagaccagcttggatgtcctcatctcacctggatgaaaaatattcttttattggaggagcatggtgacaaacaacttgtgatttgctgactcatacctcccaagagaaggttctggccattgaaagctagctctccctgaggacttggcatttgagcctgacagacggcatttgacagagccatgtcattcattgcaccccttcatacctgttctaggtttagatttctactctttcagccccataaacccaattttacatggactttaaatgaaaagacataggttcttctaaactatgcagctgtcatcagtgcagtcagtgaaaaggcattctgtctgcattagctgcgacaacattagtaggctactaatgaaatgaatattttcatttaacatctgtaaactctgaaatgcaagttaatcatttcagagaagagaccagatttgtccacatctgaattcgtattcagaatcaactcctcttctcttctcctgactttgcttactctgaggactgtgaggcctttgggggcaatgtagagtgtgtaaacctggtggcacgacagattgacaggtagcccaggtgtgagacattttgtctgcagacaaccgtcaggggcttgcccagcagcagttttgtgcagagccctgtttggggtgggctaggttgtggggcagtcaggagaacacatactttctatcctcaaggagcttagtgtcctccagctgggtgggtatgactgtagttcttgaaaatgctagaaaatattatgctgagttttatgtgccaactcttagcagagaaagtggagatagctttccggaagaggagagattgattagagcaggaccttgaagcctgggagggtctgagaggtggcgtaggcacagcacagtaccttggactcagctagttctggttttagattcaagctctgcctattattatgtgaccttaggcaagttgcttaaacctttaaatgggggaaaagagctgttatgagaattcaaactgtgcacagctcaacaaacaatatttccctcaggttaaaggtgggaaagaagaacaaataggaaatgaacttctctttgggggacagtagaacagcatcctgataggttagagtatagggaatatataggcttttaggggggaatggtgcctgttttttagttcttgagttatgatattcatctttttccaagaaaacatacagttaatcttctgtttgccctgcagagcaataccctttttatcccactacagtggtggttgacttgtctctccctggctgagtcccagctgtgcctgactaaccgtgtttctcttgtatctaggagtgctcccaccccagcccgttgctgcccagctattggaacactgtataacaccaacacactcgagtctttcaagactgcagataagaagctccttttggaacaagcagcaaatgaggttagctgtgaaaacgtgatgtatgtgtcatatttcctgtggtcctggcaggtgcagtgtttgtgatcaggcacatgggtctgctgcagaaactggcatatgaagggaacttaaagacacttgtgggctttggtatatttctccagagagaatactcccagctgtctccttctgtattggcaggaaggtcagggagaggacatccaggctctcacctgggataggctggaaataacatggcagggcagaggttaagtaatcagtttgctgctcatctccagccagcattttgaagcagccagacctctgagagttgtgttcctgtggctgaatgcctctaggcactctgtttattgtgccttggagaggcttggcaatcctgtgcaccatggcggtagaggagattatcatgtagtctctgcagtgtcttcacttatctactgcatctgattttcaaggcctctgtggcctggccctgttttcctcttttcctttctgacctctttactcttgcccttgcattctctgagtctgtcatagcaaatcacatgtaattccttctacctactttctgttctgtcctctctccttgggaatacaatatcctctctgcctggaatgtctttcctttgcttctttacattggagttagtgagaggaattaaaatgggaggtgggggcagtttatcccaatcctgtctaaccgctgtaatcaaggagtctttataccagtctttatcacgacatgaatcttgttggtgtgggtgcagtggtcaggtcctgaggcaggcttccttcacatccctcgggatggacgcagctgtgactcaggagaggatggtcgtttttcttgacctgtggcttgactgctcctgggcctcctgctttggctgcacatttaaaagggagtctccaaagaattgggtcaggccttaatcatcttggaaaaaagcaggctctgcccccacaggaatatcccacccctcaactggggcccagaattctcctagcagcttctgccccatgccccctcggcttaccggaaactgggggcctctcttcagtggtccagcttctccaaggccagtatgtcagtagcaggaacttacttctgcttacttatttccctcttccacccacacttagggaatgattcttattagtgcaactgttttgtcttgcttagtaacaccaagtttagctacgaatcttatctacaaaaacatcttgtgatccacagctgctgaccagcaccagcatttgctcctagtctcagtacttgctgagtatacataaatttgaagtttgttcttctttcttcatctctcagggcaagataatctcaaataagacttcaagaaacccctatgtgtatttcacagcatttcctttgagagcccctcccaggctctttactctccccgttccccagcagagtctgcagaggattcctcccataaattctacctacttctgtgacagcaaatcctacatggtggtgaagttatacatttacgccagtctctctatctagactgcgagtgtcttgagggtagggactgactgtgtcttttatttctgtaaccctgatgtgcctggtatatagtagacaataagtaaatatttgctgaaggagattgtgaaggcatgaaaatggcctggttgccccctcggtgctgagatctgctgagaggaggcgcctgggttccctcacttggcttagatgttgaagggagtgtggctgggagagaggcagtgtgaagtcggcagagtgaggtaacaacccacttcattgtttggggtaagtggtgctgggcctgtaggaaagaagagcctggtgcttttcagctccacacttcacctgagagtgagaaactcagagatgcctggtaacctgccttgatgcttttcttcttcttgcagatatgggaatccataaaatcaggcactgctcttgaaaaccctgtactcctcaacaagttcctcctcttgacatttgcagtaagtaaatgggctctcggttgcaccgaggttggtgaaatcccctggcttagcccagtgtaccagtagaacagtctgctcttctctccgaagctactaccttctgttacttaaataatagctgttaacgaaacgctcatttgattagtggccagatagtgctggcacctattaccaatgctaacttaattcacccctatggatcatactggcagtaattgcatagtttatataacacagggcatgataaagtcaggttcagggaatgtggtttcattgttgctaacgcctttgttaaataccatcctaaataccatctaaataaaggaaaggtgcttctggattagaggagatcacactgcatagcttgaccacaaaatcgcttgttgattttttttttttgtttttttaaagacagaaacatgttttctgtaagcgaaatctaattaaaatgaacgttaagggcagccttgaaaaggaaatcgtattagggtaacatgtgctgcccagtgaagaaggggtaggatgtagatggaaggacctggccttggtgagggaaaagtagggaaaaggtaagggtcgattatagagataccagctatgcatgcatgcgcgtgtgtgcgtacacacacacacagataccagttatacacaggcacgtgcacacacacagcaacacacagatgtgtgtatatatatctgtgtatataaaactaatttatatcctttattattatattgactatataacattctgtcaaatgtatgtttcatagattcctgttatatatttaggtggtttctaatattcactgttataaaaaatgctagtctgggcacagtggctcatgcttgtaataccagcactttgggaggctgaggcaggtggatcacttgaggccaagagtttgagaccagcctgggcaacaccttgtcacttcaaaaaatataaaaattagctgggtgtggtggcgcctgcctgtggttccagctactggggagctgaggtgggaggatcatctgagcctgggagattgaggctgcagcatgccatgattgcaccactgcactccagcctggacaacagagtgagaccctgtctcaaaaaaaaaaaaatactgtggtatattgaaaaatatataatattagccatattgatcttttctcctgctcattttacttctttagaataagttctttggagcgggcatataaacacagtaatgttgctgtgtattaagtgtgctgtttcaccacagcatcatcagctttggacattaatcctctttcccacttctttttttggcaagttttccttccccgacctcccaccgttcctcctagattcctagatgcaggggaggcctctgatttattgcccaaggcaaaggagggtatgatagcaatcaaacaaggccagtgggtggctatctacaaggaacacattttctaacaagttataatgctttctatgtaatagtggaggagagagaaaaatgtttaaattttttgtctgattacttggctcagtttggcattaataatctgtctatacgtttgggtaattctgtagttttttttttttttttgagacggagtctcgctctgtcacccaggctggagtgcaatggtgcgatgtcggctcactgcaagctctgcctcccaggttcatgccattctcctgcctcagcctcctgagtagccgggactacaggcacccaccaccacacccggctaattttttgtatttttagtagagagggggtttcaccgtgttagccaggatggtcttgatctcctgacctcgtgatccgcccgcctcggcctcccaaagtgctgggattacaggcatgagccaccgcatgcagcctgtaggctctttactgggataaattgtaagcattgctagttaaagatttctagttacttgaacgtcagtacgctttctgtaccaagaattctcatagtagaacatgctgacagtttgcatttaatgagaaaaataacattagctcttacttaaagttttaaggtttgcctagagtcagtatgtgtgttggtcttgctgccttgtttactgagcattcttagcctgacttaaaaaaaattgtaagtatctactttttaaaatcttcagacaccaaggactttatgtttaatttaatggaggtcatttctatcctgaaaagaatcctaagaaatgcaagctttttgacttttgaaaatgacctgataaagtttcttagaattcgtgaggtccggccgggtgcagtggttcatgcctgtaattctagcgatttgggaggccgaggtaggcggattgcctgagctcaggagtttgagaccagcttgggcaacatagttaaaccccgtatctactaaaattaaaaaaaaaaattagctgtgcatggcagcctgtagtcccaactactcgggaggctgaggcagaagaattgcttgaacctgggaggtggaggttgcagtgagctgagatcgtcgtgccgttgcactccagcctgtgtgacagagcaagactgtctccaaaaaaaaaaaaaaaaagattttgtgagtttcttcatcttgaattgtttaaccttttactaaatatcggttatgacaaatcatttaagtacaaagaagagaaaataatctctggaggtgtttttgctttccttctgctgttttttaggactcataggactagacagttcattaatttcagctttgcagttcattttgccattgtgaagagggaattttttcttagttgatcaatgaatagcagaattagagaccgcagagattacaattattagactttctcatctgtacacatgattacatatacatttacattttaaaactcatctagtatgatttcatttatatgaaaagtccagactaggaaaatccacagagacagaaaatagattagtggttgccaggggatgagaagagggggaatggggagtctctgctaatatgtatgagatttctttttggagtgatgaaaatattctggaattaatagtgatgatggtacaaccatatcactatactaaaaagaaaccactaaattgtatactttttaacatggtgaattttatggaacgtaaattatatctcaataaaaagtcatctaacaaccatccaattttaattcttagcaagattcaagaagaaatattaattagctacataaactgcattcatattcagtggtcacaggcttgtaggcaagctgccaaatacccacatatgtctggaatgctaccatgaatttaattaaggccccaaaagctgtaagaattctgaagcaagagccattagcgtgagtgggaacagtgtcaaagacagcctcacaaatcctttcccctggatctcctaccctggtgggggatcggtcagatatacccgtgaagatgtaacctcttctattcacccatccagcttactacttagagcctctccatggctctaatcatgcactcgctttatctctgctctgtccacaaagtgagctgcctggtgtctgggactggggtttattcatcttattgtcagtgtcttatgttttgccttgtacatagcaagggcttgatagttgttgacttaaatccactaagccatttacaaaagcaatattgtattatttcaggcatgcatacatatgtgaatagcacagcttccttaataacatgtaatttatttgattgtgaagagaatggtaactgtttggaagttgtgcttctgtagatagtacattaagtatctatggtcagtggaaaaaagcttaagttttggaagcagagttctgatctcttctctgccccttgccatcttttttgttgttgtttaggttttttacccctttgtaagattcagttttctgtttataaaatgggataatagtaaatacctcccaggggggttttgtaggttaaaggatgatgatgataatatcaattacatattgcacattttctgttagcaagtggtcaataaagtatattatgtttgtcatcatattattagtggtggtatatgagactattttgggaatacaaaagtcctttatttgatcatgagttctgttggggatgaggatatttgataagctggacagactttgtttgcatagctttgctatcttaattggccttgagaagctacattaatagatgcatttcaccttaagttaatggtgctattctaataacttatttatacttttttttctaggatctaaagaagtaccacttctactattggttttgctatcctgccctctgtcttccagagagtttacctctcattcaggggccagtgggtttggatcaaaggttttcactaaaacaggtatcaacaaataaccaaaatgcacataaaattgggttgaatgtgcaagagtagttatgtagttctttccaaagacaaacaggcacttctctggatgaagacgtggtaactgaaatcctccaaaggtggtactaggagcagacttatttagaaaatgtttgtaaagtcatttttttgtatatatatttatatatgttttgagactgggtctcacccccattacgcaggctggagtgcagtggcacgatcactgctcactgtagcttcaacttctcaggctcaggtgatcctctcatctcagcctcctgagcacctgggactacaggcatcccatcacacctggctaatgtttgtcttttaatagatatggggttttgccatgttggccaggctggtcttcaacacctgggctcaagcaatctgtccacctcagcctcccaaagtgctgggattacaggcatgagccaccctgcctggtctgtaaagtcattttgaagatgtagtgcacagtaattttccaggttttcagtggtatttggtgaaatgctaagccagtaagggggaattataggaatattttgaaacactgaaagaatttaccaaaatgtggtcttcattttcaatgtggggaaacataaggcagtatagtctgggaaagagtctttgaaacaaaacagaaggcattctcctacccttgtaccaagttgcagaacttttctacctggagcagtacatgcagagttagtcggtgacatttgggatagataataagttcattagagatggttcccagaagagcagttaaaataatcaggctggtataacagagaccctaaactagagaattcttattgttgttaaggcaaagattatgtgtcaagatgatttgaattcttgaaacacatcaatcactaaagccctgaatactgatgccatcattcagggagctctcttggagctgttcagggagcagccattattgattaaattttttttgttgttgttcgtacaaatccgaggttgtggttttgtggaactaatttcccaagaggaaatataagtaaggaaaaaggattttggctgagtattgactgctggcaggtatggggtttcttttattgaggacaaaaatgttctgtaattattgctgtggtgcttgcataaccctgtgaacatactaaaaaaacaaacagcacattgcattatgtactttaaatgggtgaattgggccaggcacggtggctcacaactatagtgtaattccagcactttggaacgcagaggtgagcataccacttgagctcaggagttcaagaccagcctgggcaatatcgtgaaaccccatcgctataaaaaataccaaaaaagttagctgagccatggtggtgtgtgcctgtggtcccagctactcaggaggctgaggtaggaggattgattgagcccaggaggtcgaggctgcagtgagctgtgattgcctgggtgacagagcaagaccctgtctcaaaaagtagtaaatgggtgagttgtatggtatgttagtcatgtctcagtaaagctgttgaagattatggaaaggttcggggtaaaattcatcaggggtagattcatgttgggttatcataggagagaaagaatgtttcgttaccgctctaaaactctgattgacagcttagggaactaccatgttgtagtccctttgtgcccctaagacacacaccaccatgcccctggaaagtgttatataaaagctaagtggtattatttggaggcacttctatgttcacttgctgtaatagagtaagaggagtgtgatcagtcatttctagtcttctggttttaaggtaccttttttttgagttagtttttagcccagaactagaaatgtaattttctagagaataacaacgtgttttctgttttcagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaaggtcagataaactttgagtatcattttattatatagttttttaaaaaatctgaagttcatgttacaagagaccactgcaaaattcaaacttgtttagatttccttagccttcaaaggatgtttaagaacatttccttatctctatcctctcccacccctacagttatcgaatcagctcctctaggtttttctagctctactacagctcagaataattttgataccttactctttttttttgtttgtttgtttgagatggagtctcgcactgttgcctgggctggagcgcagtggcgcaatcttggcttactgcaacctctgccttcctggttcaagcgattctcctggtcagcctcccgagtagctgggactataggtgcccgccaccatgcctggctaattttttgtatttttagtagagacagagacgaggtttcactatgttggccaggttggtcttgaatgcgtgacctgcttcggcctcccaaactgctgggattataggtgtgagccactgtgcccagccaataccttactctctattagtgctaaagttatttccgttttccctcctgatgtattttaccctctatgttttaatttttattcccagaactaccctgtagttcaggcccctcatatcacactcctggacacttagaatcttgtttccatgttgtgcaacactactgtagaagaatctcccttgaactacccacatttagtgtatcattcattgaccaagagcataatggtgtcttccttctggctccaagctgcctttcctgccttatcttccattattttcctcataaagcattgctccagctaatcttatctatttttctccagaatctccatccccttcccgtcagatacatctaaaactttttttgtatctttgtttttcctcgtgttgtatcatcttcctaaaacatgttctacttgtgaaaaccctaagaaattctctctgtcttattgaaattctatctccactgtgaagcattatcatggtgtggccatatatgatctatccctatctgaagtcactgcatttattccctgatcctcatttgcaggtccagtaccttgtacaagtttctttttgtgccatattagactgtaagctccaagagggcagggcccaagtcttatgaatttgtgtctgcatagtgtctagtacttgtctgaggccctcaataaaattcttttgagtgaatgaaagagtaccgtaaatgtcttttagaagtgatcagatatataggaagttgtcttagccatacaggagactatgaattaaaaatatcaaagattatgagtgttatgaagttctgaaatcaaatggaatcatctccatagccatgtgaatatatcagagctgaaaaaaggaaagcctttaactgacggtctggttattctttagcctgaacttaggatgacttttttttttaaaagcacattttaaaatcaactacatttacattttatttttcagaggaagcccacctccccttttttgttgtatttttattagagatggggtttcaccgtgttagccaggatggtcttgatctcctggccttgtgatccgcccacctcggcctcccaaagtgctgagattacaggcgtgagccaccactcctggcccagaggaagccctttttaaattgaggactgaagattgaatttttattaaaattctttcccccaggtgatttcacagaaccacagctaaattagtatagcaataagaccgttaataatttaaagtccaatctagtgtgaagtcctcttgtcatagcaggcaggattaaatggcctgtgtttggaagcgaccgtaggtcaggttgtatgtggtaaataagtggtcctccccaaagtgcagctctgccaaaataataacagtttgaacagtgctttacaattaatttaaaagggactttcacatacttgatctttttatgataagtctgtgaaacaagcgttagttactacctgtggttagttaattagtatctgcattttctgtttgagactcaaagtcacacgaccacattgtctgattccgaagcctatgccctttctttctttcttttttttttttttttttttgtttttgaggcagagtcttgctctgtcgcccaggctgaagtacagtggcacgatctcggctcactgcaacctccgcctcctggcttcaagtgattctcctgcctcagcctcccaagcagctgggactacaggtgcgcaccatcatgcccagctaatttttgtatttttagtagagatggggtttcaccatattggccaggctagtctcaaactcctgacctcgtgatcctcccgcctcgccctcccaaagtgctgggattacaggcgtgagccactgtgcccggccacaagcctatggcctttctaccattcccttgaccttggggaaactgcataacttttctttgtattagtttatctgttaaatggtggtaatgccacctccttataaggttttgtgaggattaaacatgataatgtgaataaaatgctgagcacatggtagatgctcaatatgtatccacttcctttatgtttcaacagcagtatattttgaaagacaacaaatctctggggtctcctctgaagtgctctgagggattcaccagaaacctgtccctgagactaactgcctgtctgcttgtcggattcaggcacactatccttcacttggttagggtggtatctcaggaaagcctggaattactcagcacacgtgatgaacacctccttatgggccagaaattttgagatacagttgtacttgttctcacaccacctaaggtcttctagaggagatcagacattgacctgtggaaaattaaggagaaattcaagtaatggaagataagttcagagaattgatacgggtgatactttggttggtcttctatgccttatcttattctaggaaagatcaccagaagccttagagcatgatggcctcataggagttttatagccttcatgctgcctttcctacctgtggccctgaatgttcctgtctcccctccacactgctgtccaagtgcattttctaacgtgtaaatttgatcatgtaactcttctacttaaaacccttctaaggttcctgttgacttcgggataacgttaaaactacttagcttggcgtttgaggtctcttcagttccagttcctgtccaccactagcctcatttaatatttcccaagatacatcctgtgctctggctacccctgtgccctccaaatgccgcagcttcccccatctctctgcctgcagacatctctctgtctcccttctgtcacctggctgctgcctcacctacctttctgattcattaccccaggaagcactggctgattgcttgcgccatttcatttctctcttctgtgttctggtagcagcctccttcctagcactgactagtctccaaagtaattgttgatttgcttttctgcctgccccatatccccagcctgtgagcaactttagcacagaatcttgtttgtccccactctgcgtcctcaacatttagtgcaatgctggacacttaagagacacatgatgtgagaatgctgagaggaaagagagagaattgtggactggtatgaaaattaaagaaggcttttgccgggggcagggccgaaccctagagaaataatttctagacatcattttcagtggttcttgcttttattgcattaaccttgttcactctctttagcatgattccagtttcccttcgagccacgacatttccttgaaggttttcaccctcttttttcaaaaataggcattcttttcagtatgaaatcctgcacttgtgttctggcttcatgttttacttgattctgccccctcctcctcctaccagcactttgttccctgaaaagtcactgctgctctttgagccctgtgtcctcatgtgtaggatggagaaatgttggaatccctctgagtttctctcttcaacctgtttctcttctgggttatctcattgtgcctacaactccagaaaccatttcctcccaagtaattcaattttctctcaccggcctgaacctccctctggaccccgggccatattatccagccacctgcttgcctccttctgcaccttacaatctttgccccaaggctggtccttttctggcttcattggctcagaatgatgctgcttctatccagtcacacaagccagaaatctggttatcctaccggacagctgtcttccccctaccacccctgtgtcttgtggatttcatgtcctgaatgtctctcagcctaccaccttgcgtttcttctgccaccacctcaatctctgctatactgcagcagcttcctaacaagcctccttgtatctactgtgggcctctccagttcattcccatatcatccccacagttttccttagaaaagcagatctgatcgtgtccctatcataatgaaacacctgaatgtcttcttccctgtgctctaagagtaggggctaaattctttaatacggcctacaagagtctgtgtggcctggcccctgtgggcatccagccccaagtcattccgtgttccctgccacagggcttttgcatgcaccttttgcctggaactctcttctctctcttttctttacttctacccctccctccccctacctcccctttgctccgttaagtgctcactctttcaaggaaaccttccctgacctctataaaaaggtttattccttctgttgcgagctctcatagcactgtgcatcccttcttcttttttttttttgagatggagtttcactctttgttgcccaggctggagtacaatggcatgatgttggctcactgcaacctccgcctcctgggtccaagtgattcctcctgcctcagcctcctgagtagctgagattacaggcatacgccaccacacctggctaatttttttatctttagtagagatggggtttcgccatgttggccgggccagtctcgtactcctgacctcaggtgatccacccaccacagcctcccaaagtgctgggattacaggcgtgaaccaccacacctggtccataattttacattttcttgagtgatctttgattaatatatttttctcccatttaaatgtaagctctaccaggacaggtaccctatctttgatttcccaccattgtgtctgcatcccatggcatcatgcctggtgtgtaaaatgcaatggaaggatgaattcatgcataaatgagttgtgaagactggagattgctcatgggaagcacctgggtcagtgcctggcacacagtaggccttcagtgagtagagggtagctcttattattagttcattgtaagtgttctctttaatgtgagcattctgttgtctggttaaggccacgtattttacaaagactttcccaaattgtctgtacacctcaatttatgtctaatgagttacacacatggttactggcgtgacaggagacagaatacaggggaggtatatgatctgcatggctgattcagagcaggggttcttaatttggagtagggtgcagatgcgtaatgtctgggaatgttttggaagtaatggatcctcaccctagaaaaatccacatgtgcacacagttctgcgtctaatgtcagagacgcacagagtgctgacatgcttggaggaagatgaaggaaaagacaggagttagcctgcctagtggggagcctatggattgttaaggtcaggaggtgaatgagtcctctttgttccaagtcagagtgggagctttgcatgtggaggtactgttcacttgtgtgtgaagccttggctgactatgagagagtgggtacctgcccctgaagaggacacattgccagccaccaacagctgggactgccatggtctcagttttgaccgtgaccagcatgcagctggtcactcatacatgttatcacttatccttacatgccctgcaaagtgagaagtgttgtctgcattttacagatgagatgaatggaaaagagactagggaatggaagcctcttcaaatgtgaatgatcttacctcctacagtgagaatgcttcctatagtgaaaaaggaagcagccattttttttctgctcagctcacaatgtgttggggtagagtaggaaggccagacttcagttcccaacagcttaatgggtcgaaccctctgagcctcagtttcctcagtgtgtataagcatacagtaacaacacccccttccttgtaggtggctgtgagaactaagaatcattaagtttcactcacatgttctaattgttcccactatattttcttagaatgtttttcagttttcattttcaaaggaaaattttctttgattaaccccagtttccagctattccataaaaatggagttttaaggtcccgagtcacacagccaactctgcctttaccaaaggaaggcataagagaagcccctcctgagattggcagggttgccagttcagcagcccccgggacatccaagaaagttttaccagttcactgatggtattgtctttaaatgaaagctcaaaagcaaatgcgcctgtgattggtttcatctcacttcttgggtgatgtatggttgttactgtgattgcttaatgctggagttctttgtcatttatagttaaaaatacctgttataacccaatacatgtctttgaatctgcacccacacatacacataacaaaacaagacttttgcaaaataatgctttcctttttctgttttatctttttgaaaaattctagttgtgacccagtaaatgatttaagaatcgcaaatagctcaccacctgcagtttgaaaaatgctttgtgaccattttatgaccattttggaaatactggcaaataaatgaactgtactaggtgaggttccattcattagttttacttccagctatatatctctgtttttaaaatgtcgcaaaggttttcagctattcttttacatttttaggtttttttaatatacaaactttttgtatatttccttttaatcctgtgcattttttaaaactaagattgtacagtattttgttttattgtagcattttagcataatagtattatattctacacaacatcctttttaatggatgtatgatagtatttttaccaaggttttgacatttatatttctcataattttttcactattaggactgctttgtgcatcaaatttttcctctttttcctctccttatcccctgtagttttaattatttccatagaaaagatgtctagatgcggaattactgcgttacagagtttgaggctgagcgtggtggctcacgcctgtaatcccagcactctgggagacctaggtgagaggattgtttgaggccaggagttcaagaccagcatgggcaacatagcagggctctgtctctacaaaaaatttaaaaattagctaggtgtggtggcacacacttgtagtccaagatactctgaaggctgaggcaggaagattccttgagcccaggaatttgagtctgcagtgaactgtgatcgtgccactgcactctagcctgggcaacagaatgaaactgtcaaaaaaaaaagttagaacatgttaaggttcataatcagtggtgtgctggtaaatgtttaacagccagctcttgtgaggtaggaatagtcctgtttttgtagtgttttcttacttgtatggtaccagtactaccaccatggccaattgcaggctaccagtgtgaagtcctggaatgccgaattgaaaagagacattaacagttggctcccagaaaagcctgtatgggccaactccagcacaacactgcttatcataaatgtttccccaagaccctgccagcttccctcctaccagctgtgtacccttaccaggatcagatgttgtagtattgtacacatgtgttaggttgaaaatgggccttaagttcttctctcaatgaaatgtggattccacagtcgcactccattgctacaacagatcaccatctttcaggccagttcttgtgattacattaaaaatagctcataacattgtcccattaccaatcttttggggaaggttacttgactcttctacttcattcagagcagttattgaagattgaatgtttgggaaatgttgtgtaatttcaacaacattagcctttaattctagggctttaaaatctgtggacaagagcaatagccaaggagcaacaatttatatgctgttagttgggctctttcttcacttagtgatctctccgcatcttggcagctgtctgtgactttgaagtgcattaggtatttcagttttttcccccatactttaaaaacgtgtaatctcctttgtgcatttcctgttatatcaagtgtttgagttctaaagacagccatttgttagattagcatgttttatgggatcattgtggaaaatgttcttgctgaagacaagcaagttggcaattttgccctcttttctttctcacagtgtactttttcagcaaattgcttggcagactgatcatgactgaatcatttcaatgaattgtatgctctcagccaagtagaaaggaacatttatttcataaagcttctaaacaaagtttttcttcagttacgttgagcttctttctgctgatttgtattacaaaaggaagtgatttgcccaagttcgcacaattaatttgtggcaaagccagttctaaaaccagaactcctagtcagtgattatttatgaaaaatattttttaaaaaattctgtttaaccgtagtataagctggcttacctagcattgtgccaactaatcattcctccaatgattaagatagattctgagttgattcctaaagcacttaaagattttggggtcacttttgaatcatcaaagaaagattaaatgatgttcagcttagtgttaaatggattttgtcattttcctattcgacgcctgccttctgcacttatgcctcatatgggtaggaaagttaccttaaaccattttcaagctgacctgcttttatgggtaagtggtagattttcctccttagcagatcattcctgctctctatagcccatgttaggtcaggttgctctaagaaacttattcctagtcttttctgctcaaaaaaagatttttttttcactattctaccccattgcctttgtccttagggtaagaaatatgcttattctttgaaattaagcatccacttgtagcatctaacataatattctagtttatataatttagatatcatttagttccaactctacatttgcacatgataaagcctagaccccgagaatatttgatagactagaacttatccctttcttttctttgccagttaagaaaaaataaccttgaaactgaagacagctaactatgtacagtcacatgccacatgatgtttcagtcaacaatggaccacatatacggcagtggttccataagattataatactgtatttttactataccttctatgtgtttagatttgttcagatacacaaataccattgtgttacagttacctacagtattaagtatggtcacatgctctccaggtttctagcctaggaacaacaagctataccaggtagcccaggtgtggtgtagtaggctatacaatctaggtttgtgtaagaacactctgtgatgttggtatgacggtgaaattgcctaacgatgcatttttcagagtgcatccccatcgttaagcatgactgtcatggtggtggattggactgaacaaagaggtcaatgaagttactgcaagacagtgtatttatgttgcttttgttgttactatttgttaagcgctggcctcattctcagtttctgtgctaagtgcagttaagaattatcctataggccaggcgtggtggctcacgcctgtaatcacagcactttgggaggccaaggtgggcagatcacctgaggtccggagttcgtgaccagcctgaccaacatggtgaaattctgtctctactaaaaatacaaaattagccgggtgtggtggcgcatgcctgtaatcccagctactcgggaggctgaggcaggagaattgcttgaacccaggaggtggaggttatggtgagctgagatcgtgccattgcattccagcctgggcaacaggggcgaaactacatctcaaaaaaaaaaaaaaattttatcctatagatgagaaaattaaggcatagagaagttaagtaaattgctaaaggttacacaagagcaagtgatccagaatgtttgattaagggcccaggtttatgaagtcatttgcaaattgtaactcagtgtctctgtaggaacggcattttctagattgatactgcctaggttcttcctaagtaacccatttaatagcctttgtgtgttttttgttgttgtttttcctttgctggtttgaataccctttagatactctgtaagattgagctttgatatagtctgtgttgttttgtgacctatagggtattttcttcttaaacattctctaaagttctatgattctggagcctgaagaaatcctttgagatgaaaggttcaaccccttcatcttgcaggagagaaaggaacttcccccaatgtcttaggatcagttagctgcagaattaaaacacatacctgcttactgttaagcaagtgagtttttcactacatcaggccattttctaattgtaagctgtttcaatgttttggaagtagaaatgctagtttctcccttctccccctttttacacttgatagagttgtaaatgctgttttttttttgttgttgttgttttgtttttgagacagagtcttgctttgtcacccaggctggagtgcagtggcccgatcttggctcactgcaacctccacctcccgggttcacaccattctcctgcctcagtctcccgagtagctgggactacaggtgcccgccatcatgcccggctaattttttgtatttttagtagagatggggtttcactgtgttagccaggatggtcttgatctcctgaccttgtgatccacccgcctctgccttccagagtgctgggattacaggcgtgagccactgcacccggcctagagttgtaaatgctttttatgaataaaagcaatgtgaagttgaagcgacgattgctaaataaatgtagttgtgtggcagacgctatctgtcatgattggcagaggggagcaaaataaaaagatgtccctgatggaagagtagcaggtggggtggccacatggaccagaagagctcaaggaagacaacttcttaattcggtggaagccctggactggaaatcttgttctcagagttctctcacttctcatccgaagccctctttttttaaatcttactttcacattctcacctaggagaatcccagggttaaaatgccatgagaccctgtaatgttgagaaaggaaagaaggaaggaaaaggaacttgctgagatgctgcatcacagttttgtatggaagcttcaggtctgcgtcagtcaggcatcacttttcctgctctagctgcctcccaggatccctgctcaagatctttgcagagggggagtccgtgtattgaagcctggagaaatgtactagtctgtcatctattcaatagatacttgctgactctcaggcactgtgcttaggtaactagagatggaaagatgaatacagtgctcttgccttcacagagagttataaaccagcaagacatcaaatataacatgcatcctgtgttttctttattctaaaatgcttgtttctccatattttaatttttctacagtcaggaatttcttacaattgtgtatatttatgcagtgaaccctcttttaagcaaatattttcttcttttgactgtagacagctagtgctaagatgatagtgtacataagaatcacatgcggtattcactggacatgcaggtattggtggtacctagagaggtctgggatcagattgagtgtatgtatgtgtgtggatagggtgttgtgcaagttcatcaagcttctaggcaattctgatgcaggtggtctctgctggaccatactttgagaaattgctgcagacaatcaagaagtttgtaacttgcacattagaatcacctgaggatcttttaaaatgaccagtactcaagccagactccagatcgattaaaccagaacctctggaggtgggacccaggcagcagtatttttgatagctccccaggtgatacccaagcatcttcaagtttgagatccacggccattagaaggttgaggaggagcagtgcttctgaaacttccatgggtgtatgaatcacctgggttcttattaaaatgcaaactctgattcagcaggtctggggaggaggccggggattctgcatttctgaaggctcccagggaaggctgatggatgcatgctgctggggcatggaccacattttgaggagtatgggaagatgtagggccaatccagagttttcaagataatgacagttcagagatgttttctttggtctgtaagagcaccctctctaatacaccccaaattcaagtccatggagtggaccagctgcatcagaattattcaggagcctggtacagataaagatacagattgctgggctcaccactggagattctgagtctatcaccaataatgatattagtagctctatgtatgtgctggacttttcatgtttagtatcagctcatttaatcctcactacagctctatgaaataagtaatatattatttcctccatgattaaactgtggcttggagggttgagtacttttccctaggcctcatttagtaagagactactcagcgtagtaagctctgtttttaaaagtgccctagatgctgaaaccttatctctgtgggaaaggaaatctcaaataaaaatatttcctgaaaggatgaccatatctatgaacctgtttgtattaaattaaatacgaatctgtctatttgcgtttaagaaacgaacatgcatttagaaaaaaaatgcttcaattttaggaataagaaaattttatataacggaaaaggtagcaaatattttaaagagtgtctttgaaataatacagtaaatatctgataagaccatagtaaaattcattttcagagattgagcagatgaagactacttaattgtccttcaaaaggaaatagaaaaaatttggtacatcaatacaatggaatgccattcagccattactcacaatggttatagaacatttactagcatagaagacagttcacaatacaataagagatatgaaacaatatttaggccaggcgcagtggctcatgcctgtaatcccagaactttgggaggatgaggccagtggattgcttgaggtcaggcgttcgagaccaacctggccaacatggcgtaaccccgtctctactgaaaaaatacaaaaaattagcagggcgtggtaacacatgcctgtctgtagtcccaggaactagagaggctgaggcactagaattgcttgaatcctatgaggtggaggttgcagtgagccgagatcgtgccgctgcactccagcctgggtaataacggtaataacgtgagactctgtctcaaaacaacaacaacaaagacagtatttatagcatgatcccatgtttgtttcaaagtcctagtaattaaaatatatttatgcaaagaataagttcatgggcagttatacaccaagatgttaatagttctctcaggatggtggggttatgggtattcttctgaatattggttaagctcctactttgtggctgatactataccaagcattgtgggaaataaaagggagtgtttagggtgattccatccttacagaactaactggatctagatttaacaaaaatttatcagccgtgttttcatttaacccatgctatgcttatgaaggaaacctatgggtcaatttatggttctctgccagcaatttccctccctcacccctactcactctacatccttcctttctttcttccacccatttatccatccatctacttttttatcatacaaaaaacattcaccgagtgtctgctctgtatttatgaaggagagatgaaaaagatactttctgctctccatatgctctttgtcttccttttattaaaataaactttttattttgggataattttagatttacagaagatagtggcaaagacagtacagagaattcccatgtaccttcacccagtttcagttttttctaatgttgtcacattatatcaccacggttcatttgtcaaaactaagaagccagaattcttacattactattaactcagctctagacatttccgatttcaccagttttttcctgcaatactctctgttcaggatccagtccaggatactacattgcaattcgttgtcatgtctcctccttagtttcctctgatctgtaattgcttctcaggctttctttgattttttttgatgaccttgacatttttgaggagtactgattagttatttttatagaatgtcccttaatttgcatttgtctgatgttttcttgtgattagactggggttatgggtttttggaaaaaataccactgagtgaagtacccttatcacctgatatccacatgacatccttggtaatgttaaattgattgcttgcttaaggtaatatttgccaggtttctccactgtaaaaatactattttttctttgaaagtaaatcagtaattccagctacctttaaggaggggaaggtttaaattttgcttctgaagaggccagtatttgcttatatagtttggaaattttctttaaggaagacttgtcccttcacatttattccattctttatttatatcagtgtggactcgtagatacttattttatactttgggttataattcaacatcatattatttatattgttgcacaaattgttccagccttggctattgataactcttacagttggtgcctgtatcaccttggcatgccccaattcatttgttttttgagtacctccttctttcctgatattataagatgctccaagcttctcttgtattttccctgcctgagccctagaattaaccatgtgtccaaggagccccgatttattttcttggagaatggtatttagaagtcagtatctgggtgctgggtgctcattgtctttgaaaggaaggagacagaaaatgaaaaatgttatatacaaggttcaaagagctgtgaaagcagcaaggacaggccaactacttctgccagcagaagtcttcactgaagaaacggtattttaaattgagtagagttttccagatgaagatcgggattggagtgggatgggaaaggggagggaggaaatatatgttagcaaaatcaagagtaactggctgtttaacttgatctgactgtacacttacattggtagtggcccttctttgattttctcattgcataaaaatgagcaattttcacagattatatttctttgtttacaagaggattttctctacaaactctcttgactgtcctccttcattccccatcttccttccagtcttttttccttctacgtgtatttagctcctactttctgccaggcacaatgcaaggcacagggggtgcagacaagaatttgatagcccctgctatcaagaagttctgtagtgcagtgtgagatcctgtggctttcttctcctccccttagccctttaccagatgtttaatttttaaggctttgcagaaagcataaaaaagcaaagaggaagtatgagcaatgtctgtattgtgaagctgacatgatactcgacttactcagaaagtcttttttgttcacagataacaattggtgtatatgatccctgtaacttagcccagtaccctggatggcctttgaggaattttttggtcctagcagcccacagatggtatttacaagagtgtgtgtttgtctgtctgtctgcctttgccagtatatgttttacaatgtgtctgtttctatttgtatctctgttttcctaaatgcattattttttcattttgggcatggaaaccaggtaatcaataaatcagtcataacccaatttccatactagtgaaccttaagcaggtctgttagggacctgcatactctgatcattctgtgctaaagatgttttagtgtatggtagagttggtagccagaggtcctgacacaaattctgtagccctcccttctagctgtctgggtttctttcagataggattttcctactgctgtcattctccatttttcttaaccctaaaataattaaaacagaggatatcttaaaagccaatatacatttgaaaagatgcccaacatcatgtcattaaggaaataaaaattaaaaccataatgagatgctactacatatccaccaaaagtatttaataaaaatgtctgtaccaagtgttgtcgaagatgtggagcaaatactgctggaaaaatgttgggcagtatctaccaaaattaaaaatatctatggctcagcaatgttactctcaagtatattactcactgaaatacctacatagatagaagcaaaacacatatacaagaatgtttacagaagcattattctcaataaccaaaagctgggaatagttcacacgttcttcaataatgaaatgaataataaatttaagtatatcccttatgatgaaatgtcatatacaatgaatctgagtgaactattaatacagagatcagcatggctgaattttaaaaacataatattaagtgaaataagttggacctaaaataatacatactccatgattccatttatgtaaagttaaaataggcaaaaccaatgtatggacttagagtagttgttacttttgaaggcagtggttaatgactgagagaaggcataagacagccttctttatacttgggatttgtgtaatgtgtctgctttacttaaataaaaatgtttatttaaaaatatgaagatagataaattatagattgttctctgagggagacaatctacaattatccaggtggtaagtctacacagtgcaaatgggcttcctaactactgactgaggtactgctgcttaatatggaagttcagatggggagagcagagggaaccaaaagaacccacgtcctagaggattttttctaaatgtcttgtgagcattttttccgcatttaaaagatttacttgtcggaattatttatgtgcaatatgattgtagaaagaaatcacctagaaagaaatcacagccaattcatttttcagcctctaaacacttggacagaggagccatatatgaatatgttcaaaagagttaaggccatctcctgtgggtatcagagaggcataattagaatgcattgaattctctccaactggtttgctgaagctcttatgtgagctttttcttttccttcctttaaaaaaaaataataaataaataaaaatccgggcatgacaacaggagtagcagtttccagtctgttgaagttgtttgcttccgtgaccgtaccatgcagggggcgagagacgttgcccacagcatcatcttcgaagtgaagcttccagaaatggcatttagcccaggtaatttgccggtctttgaaaatgcatataattatcatttatcagaaacggaaccaggtttactttcttttcatatcgtcacaatggcagaagaaaggaagagaaaagtacaacttgtacctctttgccaatgcagacacctacttcgaacagagggcatgctctgctattcagactggaacaaaggcaaagattgtgaccaggaaattttctctaggcagttttttcagtcttcaggatttgttcccctctgctccccccgttttcaattttacttttctttaacacaaaatctttattcctgtccattcttaaaggaaggatgaagtattaatgcacttaaatatttatttgttatatacttaaagttgtatgtgatcctgttcttcatatagtaaaccagtcaggaaaaatgccatttctccttccacatttaatatcttcatttgatccttatgtgacagttatcagcttttacccccattttataaattgagaaacttagactgagagacattttatctatagagagatatatgtgtgtgtgtgtgtatatatatatacacatatatatatttacatatgtcacagagattgaatacatattcaagtttgagtaaaataaggatataatgcccagctccggatatatttctttttttttttttttttgagatggagtctcactctgtcgcccaggctagagtgcagtggcgtgatcttggctcactgcaagctccgcctcccgggttcatgccattctcctgcctcagcctcctgagtagctgggaccacaggcgcccactaccacgcccggataattttttgtatttttagtagagacggggtttcaccgtgtgttatccaggatggtctccatctcctgaccttgtgatccgcccacctcagcctcccaaagtgctgggattacaggcatgagccaccgctcccggccagcttcgggaatatttcttacccggaatccatgtcctatgtcaaagtcagagcacgatgtctggcacatcataggtgcttaataaatgttatgtaaatttcctagctcacataaagcccagcacttttatacttcttgccagaataattcctcatctctatgtgatttatatgcttttcagagcactttcacaacatttattattattattattgaggcagagtctagctttgtcacccaggctggagtgcagtggcatgatctcgactcactgcaacctccgcctcccaggttcaagtgattctccctcctcggcctcccaagaagctgggattacaggagcccgccaccatgcccagctaatatttgtatttttagtagagacaggtttcaccatgttggtcaggccagtcttgaactcctgacctcaagtgatccacccaccttggcctcccaaagtgctgggattacaggcatgagtcactgagcctggcctcatatatattatttagcttgttccttatatcatcctcatggttccaaggcacatttctttccttatgccatagatatgccttaaaatgtgtgtgtgtgtgatgggggaggtggtgtcaaaatctcttccaaggccaggcgccgtgggttatgcctgtaatcccagcactttgggaggccgaggcgggtggatcacctgaggtcaggagttcgagattggcctggccgatatggcgaaaccccgtctctactaaaaatacaaaaatgagctacgtgtggtggcgggcgtctgtaatcccagctctcaggaggctgaggcagaagaatcgcttgaacctgggaggtggaggtgtagtgagccgactgcactgctgcactccagcctgggtgacagagcaagactctgtctcaaaaaaaaaaaaaaaaaaaaaaatctcttctgagatatcttttctagagtgctacagtcagaaggattcaggattggcccacatgacattttttcagcgattctatgctctaacacagatgtctttacacaattcgctgaaagattgacagagtacttctgcttgatcaaaggacgatgctgcttttcagtttagagcctttgcctttctgctgtttttagatatttgcattggatgtagcaccctctcctggcaaattctaaaatagctcctgtgtaatgttaacttacatgctatacctttgttttattaaaccacacttaaagatagtcgcaggggtgtccaatcttttggcttccttgggccacactggaagaagaattgtcttggaccacacataaaatacactaacactaatgatagctgatgagctaaaaaacaaatgcaaaaaaactcaatgttttaagaaagtttatgaatttgtgttgggccacactcaaagctgtcctgggccatgggttggacaagcgtggtcttagggaatgaggtgagagttagctaaaaagtaatgtgggtctggtctgtgtgtctgacaagctgccaggcaccttccatggggtaatcacttaattctgccaaccactctgcagagaggcagttttctttccacttttatgacaaagtcactgagttattcttacatcctactctctatgataaggctcatgcttgatgatgctgacattttttttgctttttttgagacagagtcttgccctgtcgcttgaggctcgagtgcaatggcacgatctcggctcactgcaacctccgcctcctgggttcaagcgattctccagactcagcctcccgagtggctgggattacagtcgcgtgccaccacgccttgctaagtttttgtatctttagtagagtcggggtttcactgtgttggccaggctggtctcgaacccctaatctcatgatccacccgcctcggcctcccaaagtgcagggattacagatccacccgcctcggcctcccaaagtgctgggactacaggcatgagccactgtgcccggtcatttttttttttttttttttttttgagacagtctcgctctgttgcccagactggagtgcagtggcaggatctcagcttactgcaatcctgggttcaaaagcaattcttctgcctcagcctcctgagtagctgggactacaggtacacgccgccacacatggctattttttttgtattttagtagagacggggtttcaccgtgtacccaggctggtcttgaactcctgagctcgggcaatctgcctgcctcagcctcccaaggtgctaggattacaggcgtgagtcacacgtccagccgatgctgacatttaaactcaggaaccacaccgtacatttccatttgaaaaaggttttctgtcgtccactaatgcctttaacacatcttcttaatgcctgatattaaatgtagattatttagcttaggaaaggcaaatgaatttcctgtttttcatgtaaattaatatgttccctcttagctgtaaataaaactttatggtaaatacaacttcataaagaatttttctatatcataatgtaaactgaaaatataagtatggttgtacttttcaatacttctaagacatcccatagttgccatggtaatggtataaggagtattattttaaattattttattttattttattttttgagacagggtcttgacctgtcacccaggctggagtgagtgcagtggcaaaatcatagctcactgcagccttgacctcccaggctcaaaccatccccccagcttagcttcccgagtatctgggactacaggcatgtgccaccacacccaactaatttttgtattttttgcagagacagggtttcactatgttgcccaggctggtcttgaactcctgggctcaagcaatcctctagcctcagccacccaaagtgctgggactacaggtgtgagctaccttgcgcagtcgaggagtattattttaaatatcctatgtcttcttttgcttcctcatggtgtgttgtgttacagctctggcacctggtggaggaagatggcagacactgctgcgggtagagatcccatcttaactctgttttttcttgtgctgctcctgcttgcccactatgggagacagcacctaattttttcctaaaaaatattttcttggccaggtgtggttgctcatgcctgtaatcccagcattttgggaggccaaggcaggcggatcatgaggtcaggagattgagaccatcctggccaacatggtgaaaccccgtctctactaaaaatacaaaaattagctgggcatggtggtgcgcacctgtagtcgcagctactcaggaggctgaggcaggagaatcgcttgaacctgggaggcggaggttgcagtgagccaagataagtgccactgcactccagcctggcgagacagcaagactctgtctgtctctctgtctttctagctctctctctctctctctctatatatatatatataatttaatttggtgtatgtcttataggtatagattatatggatgcaggtatggtaaattacatactattgccatatgtgttatttttttcattattaagtttaaagggcatctaattttcttagaaatggctatagcctttattattattattattttttgagagatgaggtcttcttatgttgcccaggctggccttgaactcctgggctaaatccttcctcctgcaatctttcctcctgccttagcctcccaagtagctgggactacagacatgagcccagcatctgtaaccttttgagtatagagaacttttaatttgaaattatgtcttatttttgtctaataatttcttacctgtatcaagagaaaacctaggctggagttatggattacaatactaggctgtgattctgtagttcttgtcaagttccttgctatgtatcaaagacacattaaaaaaaaaacttttattttcggttcaggggtatatgtggtttgttatataagtaaacttgtttcccaggggtttgttgtacagattatttgatcacccaggtactaatacctagtacctagtattttttctgatcctctccctcctcccacccttcaccctcaagtaggccccagtgtctgctgttcccctttgtgtccatgagttctcatcatttagctcctacttataactgagaacatgtagtatttggttttctgttcctgcactagtttgctaaggataatggcctccagctccatccatgttcctgcaaaagacatgatctcgttctttttttatggctgcatagtatttcatggtgtgtgtgtaccacattttctttatccagtctgtcattgatgggcatttaagcagattccatgtctttgatgttaagagacacatttttaattgaatctaagagtagtaataaaatcaaacaaaatatcaattaatggcaggtgggaactcttttttttccccacagaaaaacaattctgaagtcttaacctctttatgaaactcaaatctgactgggtatggtggctcatgcctgtaatcctagctgctccgaaggctgaagctggaggatcacttgagcccaggagttcaagaccagcttcagcaacatagcaagaccctgtctcaaacaagaaaactctattatttcagttttaatttttcatggcattaaaaaataccacatcagagtgcccgatttaaaagggggaaggacgtttgttttctggcttcttgctgtgaatgataccctcagccaaactggggcccaactagctttcaaggataattggtcctatggtttctcattgaccgtcctatcccagaaacaaaagatcgtgtaaaggaaatcagtaccttctaggtcccgtaattatattgggcaatactatttttttaaatgtcaacagctgaaaagtttcccaaggaaaggaaaattgtgatcttgatagaaattcaaaagtaggagaatggacaaagaaaaccagtgtacaggccgggcgtggtaactcatgcctgtaatcccaccactttgggaggccaaggcgggtggatcacgaggtcaggagatcaagaccatcctggctaacacggtaaagcaccatctctactgaaaatacaaaaaattagccgggcatgctggcgggcgcgtgtactcccagctactcgggaggctgagacaggagaatggcgtgaacccaggaggtggagcttgcagtgagccaaaatcgcgccactgcactccagcctgggcgacagagcgagactctgtttcaaaaaaaaaaaaaaaaaagaaaagaaaagaaaaccagcgtataattagaaacaaaattaaaattcccccagtcccatacatcttaacttcaagtcaaggagtttctcttcctgcagagtctgttgcttaaggcagacagtggaggtgatgctggaagtgtaggctgtggtggggtgaatttcttgcttagtagttcaggttttattgtgagcagtgggaattcaatgagaaagggggagtagcagaggtcctgagatgtagggagcgcaagagagtgggatccactagcaagatttacaaggctgtggttccaccaaggcaagcaaagctttcattaacatgagaaggtagcaggtgtgttctgcaaagcaattgagatgtttaagagaattttgcaacagtagaatacagcagtgtttccctgaatgtgtcccttgagattgtaattggtatacagggaaatgaagggagatatggagagccacgtaagtgtgggaaacacaaagccaaatcaaatcacgtgggttctgtactgcaggtttctcagagcttttatctccctcatgtgcaatgtgaatggccaggtttgagtggtagtgggggctggatatagaagacagatataagtatagaagcatttccaaagtctgtttagctacaggatccttatcctctgagattattgaataggacacactttgggaactgctagaattggagttaattggagttacagaggctcccatagcagggattaaaagagggctgcggggaagggagaagtcagggaagggaaacttctgaatggataaagatgagcttaaaggaaagggcagcttaatcaaatgacagtcaccttggactgtgatctgctcacaggtacagaagggacatacttaatttaaggttcaaatcccaataggaacctcagtgaaggggtgctgcagttacattggcttggcttgcttagatagagaagcctcagtggggttatacctaccccagaaaagattgtctttttttttttttcagcaacttccaataacagtgaaagttgagccaccttgggccagagttgagggctatttcagaagctcctgtacaggaagattgcttgggtttgatggtccctaaacaagattcccagtagttgggaaagatggggaggcaactgtggcaagtctgtggaaattcaggccctcaagtctcttttagaaagaagcaaaccaaaagcttgtcaatgcatgggccattatgaatgtcgatcttttttatgtaaggtcgttgcttgatctgcttgtttttattcttccctccttcattaaactttgtgttttatttgccttaagattgtcctaaagcagttggatgggaaaagaaccagaaaggaggcatgggaccaaggatggtgaacctcagtgaatgtatggaccctaaaaggtatatttgggaagctgttttctccagtcgggctttttgtaaccaagacacacaccaagttctgtcaggccaacacaacattgtgtaattcagcccagggggtgccagtcatgctgccgtgtgttactctgctcttcaattgaagtttggttgtgagaattaatattaacaatgcatatcctgaagggcacactcttcatctgttctagacattctaaattttgttcttgtttaaagctcatgctctcagaccaccagcgtacctgtactgccgttcagtcctttatgcattgtcctctagcttggtcctattggcccactcccccgccccgtcccccaccccgccccagacagagtcttgcactgtgcaggctggaatacaatggcgcaatctctgctcactgcaacctctgcctcctgggttcaagtgattctcctgcctcagcctcctgagtagctgggattacaggcacgcgccaccatgccctgctaattttttgtattttagtagagacagggtttcactgtgttgcccaggctggactcgaactcctgacctcgtgatccacctgcctcggcctcccaaagtgctgggattacaggcatgagccaccacacccagcccttattggcccaccttgaaggatattagaagaattatttcatggaagccagtattgtgtttaagggcgaatctcagtgcactcttttttttttttctttttttttgagacagagtttcactcctgttgcccaagctggagtgcagtggcatgatcttggctcactgcaacctctgcttcccgggttcaagtgaatctcctgcctcagcctcctgagtagctgggattacaggcgcctgccaccacacctagctaatttttgtaattttagtagagagagggttttaccatgttggctaggctggtctcgaactcctgacctcaggtgatccgcccgctttggcctcccaaagcgctaggattacaggcgtgagccgctgtgcctggcctgagcgcaggagatatgggaggccttattaaggagatatgggagaaatttctgttttcagtactaggaaaaactttcctcttaatcagatggtgtgtttttattcatggacaccatgattcctatcactggtcatgctcttcccttttcaccttggctgctggaactcagtatcaaatctgtggccccctcgttgcagaggactccaacagcatgctgctgggtgggaagctttctcctccctgcttaccctccagtttaattttctttttcctttgatcccaatttccttattatttcttattttcttgcatagccacttgaaatctttcagaacaagattattgcataaaggagtgactgaataagtaaatctctccttttctaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatggtaagtcggaggtggggggtgcaaatggcacctttgaagttgtagcttctcttcttgttttactctcatgattgccttccatctcccagctccccatcccctccatctctccctcccttcctttttccttttcttatctttttaagtgtaaaagaaatacaaccttttatcatcagatagaaacagaaagtcctccacacccatcgcaagtcccatttcctattaagcagactttgtagattagtatgcagcctttttcccagatgttattgtagacatatctaaatatagagaaatcagtatctttgctgatatttatttgtatttataaagattagatcatagcatactatctataacaggtttttatttttaactagatagaaaaatgactgtagctacctttctgtgtttccatagtatgtatgtgtagtattttgttgtatgactatgttctttatttaatcaatttcagattactttctatttttttctattagatactgttctctattagagaacattcttatacttgtatgtttatatatccataggatttttttttttaggaaaaaaaccctggacatagaattactgtgttagagagagtatagaatttgaatgtcaatattttatatatttgtttgtcattaattttttttttttttgagacaaagtctcactctgtcacccaggctggagtgcagtggcatgatctcagctcactgcaacctccacctcctgagttcagcgattctcctgcctcaacttcccgagtagctgggactacaggtgtgcaccattacacttggctaatttttgtatttttagtagagacggggtttcatcatgttgtccaggctggtcttgaactcttgccctcaagtgatccgcctgccttggcctcccaaagtgctgggtttacaggtgtgagccaccacgcctggccaaacatgtttttcaaacgaaattgccttccaaaaatgttacacatatgagacacagaacttttttccacgctcttgccaaaactggatatatcaacttttgaaatctcagtcagttaagtaacatttattgtttgaatttgtgtttctttaattagcaagggtgagtttaattttatttcttttgtgagttttatttcttttattcatgttctttgggttgtgtcttttattgatttagagttctttttattggggcaattaaccttttttctgtaatatgatgcaaatatttttctcagtttatctaaggtgtctttagccatataaaagtttttttcagctttatgttattatatgtgtcagtcttttcctttgtgggttatggaactcttgtttttatgttagagctttatgaatgtggaaattttttggttacatgataaggggtaaagatctagctacttttgcacaaaatggattgttagttgttttaatggcatttattcagtaatctaaatcatcatttttctgtctttatcaaatgctaaacccccttatatacctgagtctctttatggattctctattttgactcattgatctatttttttattcctatattcatgctcactgttttagttgaaattacaatgaatttatagataaattagaagggattgatgtatttttatgacattaatccttagttctgggagcatggtgtatctcttaattagatcatctttgtttttcagtagcattttctttatataggccttccatgtatctaattgggtttaaatatggtatttctgcatatttaatgatgttttttcctttagagatattttctcccgttaaactttccagttgactattactgggatgtaggaaaaatagtgaattttgcatatttgtctttggccatctttctaaactctcttagttctaagagttttttgattcttttgtagcttaatagtattcctcaccaacacttatatcttccttttccttgtcttataagattggctagaactccacagtaatgtagaagaatggcagtgagagttgatatctttgttttattgctgactttaatgagagtgcctcttgtttttatctttaattttgatgttggtttctggtaagtgttctttataatttaaagaagctgatttctgtttctgcacgtttatatcagaaatgtcgagctttatcaactacgtttatcaagacaaagtattctaatgttgagcattcctagaataaaccctatttgtacgtggtatcttattcttctcatatactcttgaattcaattagtaatgttttgtttttaaatgttacattttggccgggcacggtggctcacacctgcaatcccagcagtttgggaggccaaggtgggcggatcgtttgagctcaggagttcgagaccagcctgcacaacgtggcgaaactccatctctacaaaaaaaatataaaaattagccaggctgtagtggcgcgtgcctgtagttgcagctgctcgggagctgaggtggaaggattgcctcagaccaggaggttgaggctgtagtgagccaagatcgtgccactgctctccagcctgcgtgataaagcaagacactgtctcaatcaaccgatcaattaaccaataaattttacatctcacttcataagtcaaattggtttatagtcatgttattccttgttctatctttgtatattttatagctacattatgctagctttataaaataaacttaaaacgttctgcctttttctaagttccagaacaatttaaataaatgaattatctgttctttgatggttaggtaaaattcagttataaatccgtctgggcctgatgcatttaagaattttgttgggccgggcacggtggctcacgcctgtaatcccagcactttgggaggccgaggcgggcggatcatgaggtcaggagatcgagaccatcctggagaacacggttgaaaccccgtctctactaaaaatacaaaaaaaaattagccgggcatggtggcaggcgcctgtggtcccagctactcgggaggctgaggcaggagaatggcgtgaacccaggaggtggagcttgcagtgagcggagatagcgccactgcactccagcctgggtgacagagcaggactctgtctcaaaaataaaataaaagaattttgttggttggggtagtaagggtggtgggaatctttgtaaacttttacagatgtttctgtgttgactcacctttttagattttgtactgcttttctagctttaaaaattaattgacataaaatacatatggtattctcttttaaatcttccttttatcttttaaaaaatcttttcatattcctaatgttgtatatttgtgttttctcttttttcctcatattaagccttgctagagaggcttgtctatcagtttttttggagcattactttatttattctataatttttgtttctgtctcattttgctttcagattcgtaaatatctacttttatctttattaattttttcctccttctgtggaatttattttactgtctttttctaggttctagaatttttagatgcttagattttcctaacatttttcaaaatttcaaagtcaacataaagccattatagaaaatataaaagtcataaagcaggaaagaagacactcattttcctaccgctttttcacttgtcacatttcagtgtttaatgtgtattttaacattttattagatatataataatgtcctttgctcttaccaattaacatgtcattaaaaatgatgcctgtctatgaggcctttttattttttgggacaggttctggctttgttgcccaggctggactggaccttgtgatgttcccaccttggcctcccgagtagtcaggactgcatgagttcactgcaatgtctgctaaagctttatgactgtagaatatgccttctgataggatgaaacataacttactgaacccttctcctaatgttcagcattaacattgtttccagttttttacaattgtaaattgtgctgcaaagaacatctttgtgactgcatcttggtcagtatgtcagattatttcttaggataaattgctggaaataggtcataggatatgggtattcttaagattctagaaacatactgccaaattgctttccaggaagattagaccactttaacattctcaatcagtaggatgattttctccctaccacatcctcaccagcattgagtattgtgattttctttaatctttgcagattagccatttaaactgtgtagcattccaggaaaccaaaagttaagtgtgtgcaaatacacctgcatgtgactaacctatggcatgtttgtaatgtatctggctttcttcccactacccagcacgttcccagagtgccttccttgctatccactcatcagttgctttaaggaatgcaaaaatacttcagaaataaacattcccaaagcaagcacaagtgactttattctgcctccatggtaggttgcttagatgatgaaaataatttacaaaactgggtgggtagaccaaaaggttaccagtgggcttcaaaacagtcagtctaacctatgcttatgaaaggcagattctggcctgtcgttctcgacacagaaaacaaatcttgggtccttgttggctggatctctgaaaccttcaatctaattgagtctctcagtttctaatggaaagatattgaaataagagagagcagaatcttagccttgtagccagtcatggcaggacatctcttaggtcagtatgcttacttatgatctactaaaatatacccactgtaccctaccccaagaagtaggcaacttcatttggttgcacctctggagagctcattcattcccaccattaaccagatgtatctcttaggcaaatcacttatctttcctgggcatcagtttccatatctgtaaaacaaagtaattggaccaaggattttagagatcccatctacctttaaaatcgtatggttttataaaactgttataggagacataattgaagtctataaaaccgtgaaaactatttctaagaatatagacttgttccctaaattccagattattaataaggctttgcctcttgaagaaatggtacaaaatgttctaaaatatcatacagtgggaaataatttgtgagtcattttttggaggagttcattcaggctttaaatgagcttcaagagtagttgttatttatacttaattattcgttaagggaaatcaaggacatttaggggctattgctaatctttttaaaacaacaacatagacaattcttatgggattcacctccaaatctttggtgacactgtcaaaaataattattagtctgttccacttgacattttttagtcttattacaggaaaccaggcactgagtatataattatgttgttttctaaggaaagtcaacattctgtttatcgtaacctgaatttgcacaattcagtttctgaagtttcttgtgttttgaggttcccaagcttctccaaaccaatattctttttgagatttcaagagacagcaccctgtgaaatgttcatcagaaacacaccatgatctcctgtttccacacagggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtggtatgttgttgcttttgcagaggttttctgttatatgtataaatgtttaagtcttgggaaatgaggcctgtggcattgaagaaagagagtcagatatctgtcactttctaccagccactcgctatgtggctgaacctctgtttcctcatctcagagagggataaaaaaacacaaccaggtcaggcatggtggctcatacctgcaatcccagtgtgtctggagttggttccttcagtgcgttcttggtcttgctgacttcaagaatgaagccgcggaccttcgcagtgagtgttacagctcttaaagatgatgtgtccagagtttgttccttcagatgtgtctggagtttcttccttccagtgggttcgtggggttccttccggtgggttcttggtcttgctgacttcaagaatgaagctgcagaccttcgcagtgagtgttacagctcttaaagatgatgtgtctggagtttgttccttcagatgtgtctggagtttggtgggttcatagtctcgctgactttaagaatgaagccacggacgttcgcatgttacagctcttaaaggtggtgtggacccaaagagtgagcagcagcaagatttattgtgaagaacaaaagaacaaagcttccacagcgtggaaggggacccaagtgggttgctgctgctggctggggtggccagtttttattccctgatttgtccccacccacgtcctactgattggtccatcttacagggtgctgattggtcagttttacagagtgttgattggtgcgtttacaaacctttagctagacacagagcgctgactgatgcctttttacagagttctgactggtgcatttacaatcctttagctagacatagagcgctgattggtatgtttttacagagtgctgattggtgcgtttacaatcctccagctagacacagtgctgactggtgagtttttacagagtgctgattggtgtgtttacaatcctctagctagacacagagcgctgattggtgtgtttttacagagtgctgattggtgcgtttacagtcctctagctagacacagagtgctgattggtgtgtttttacagagtgctgattggtgcatttacaatcctttagctagacacacagcgctgattggtgcgtttctacagagtgctgactggtgcatttacaatcctctagctagacagaaaagttctcccaagtccccactcaacccaggaagtccagctggtttcacctctcactagcactttgggaggctaaggcaggaggcttacttgagcccaggagtttgggaccagcctgggagacatagtgagaccctatctctttaaaataaaattagccaggtgtggtggtggtgtgcatctgtagtcccagctacactagtggctgaaacaaaaggattgcttgagcctaggtggtcaaggctgcagattttgagctgtgatcatgccatttcactcaagcctcggtgacaaggcaaaacactgtctatataataataataataataaataatccatctcacatattcttgtgaaaacgaaaggaatgtatgaataaatgttttgtaagttgcacagcattatgagtttaagttgaggaatttaggagtgtatatatttttatatcctgcctggttccaaagaggtttacagtggctcagatctaatgtgttatttttcctccatcaccaggatacttggtggttacttagtacaggtttatgaaattaaattgaatgcaagtcttcatgaagaagaaagattgggctgaaagtttagctttttgctctagctgcttctggtttttgagttatatcattagaaataccagataacaagagaaaagtcattcagctcctttcatttaaaatcttgacagttttctttttttaaggtcaaccagcaaatgatatcctgcctcttgaaaacttaatcattttatctgacaggagttagattaggtgtctccagagcatttgcttatacttaaagtgccagaagaggttctcagtcctaacaaaacaaacaaaaaaacccactttctcaaagtttctctctttagtcactttgtattagattcatccattttaaaaatctttgctttagaagcattgttaatgtttttgtccatttcactagagtccctgaggaacatcatcttgggtttaacagtattaattgaccacccactgtgtagccagctatgtgctaaatgctgaaaaaaataagaatacgttgcaaccctgtcattgaggaggcatattagttagatttctgctgtgacaatattgcatatcacacaatcccaaaatctcagtggcttacaattgcaaacatttatttcatgttcatgggtgtgcaggttggctgtggttcagctgtgtcactaggctgaacttactcaataagccacataacttcgagtcaggttccagtccattgtatgtgttattttcaaaatctaggctaaaggaggaacagtcatgtgggtcctactcttcctatggtggaaggtttaagcttaaaagggttggtgattattatgccttaaagtcttagctcaacagtggtacagtgcaatgtcttccatttctgttaccaaagcgagtcacaggaccaagcccaaagtcaatgacattagtcaatgtactcttcctggtaggaggtcttgcaaaggtcatgttgcaaagagtgaggatatataatattactagagggaggaggtgcctaattgggaagaataatccagtctaggctgcgcacagtggctgaagcttggaaacccagtgctttgggaggctgaagtgggaggagatcgcttaaggccagaagttcgagaccagcctgggcaacctagttgagaccctagcccaaaaaaaaaaaaaaaaaaaaaaaaagcagtgatccaatctatcgttggagagtattatgaactccctttaggacccagacagacctggctttgaacctgagctctgtcacttattagatgcctgaaatttttgtttactcaaatcctagtcattgtcagtgacccaatacaattcccccttcccactgtttatttgtttagttgctctattacttacttgcgtgtcaggtagtgtatttaagacctcccgtgttccagggacaggggaactagacagacatgtggagcttaaagtctagtgggggatggtcattaacaaataatttcacaaatacttatcattgtaatacatgcaggaagcaggagctcagttgccatgagaatatataacaggtaggcctgacctagatgaggggtggactgggaagacttgagaaaacaaacccctgaaggatgagtgggagttagctagattgagggtagcagagctgtctgtgcaaatgcctgaggtaggatgagtgtggtacttttgtggaactgaaagaaaaccagggtggctgcaacatagaggtcaaagaagatgaggaggaagagaaggctgaggtgggagcaagggacgccatgctgggcctgagagagcaagtccaactgttcttggaaacagccccctggcatcgagcctcttccttcacacttacattgtgttactctgttttccctgttggactattaagtcccccaggccacggtccaagtcttttatacttttatccttcatgccttataaataataggagataatatacacaacccatcaaagtactggtgtaattcatcacgttcatgaaaaatacttgcgaaactatttaacttattggttagccagccttaaggggctttccttatatgcttgatttagtatagtttctttttttttttttattatactttaagttctagggtacatgtgcacaacatgcaggtttgttacatatgtatacatgtgccatgttggtgtgctgcacccatcaactcatcatttacattaggtatatatcctaatgctatccctcccccctccctccacgccacgacaggcacttgtgtgtgatgttccccatcctgtgtccaagtgtgctcattgttcaattcccacatatgagtgagaacacgcggtgtttggttttctgtctttgtgataatttgctcagaatgatgatttccagcttcatccatgtccctacaaaggacatgaactcatccttctttatggttgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataattctttgggtatatacccagtaatgggatggttgggtcaaatagtatttctagttctagatccttgagtaatcgccacactgtcttgcacaatggttaaactagtttacagtcccaccaacagtgtaaaagtgttcctatttttccacatcctctccagcacctgttgtttcctgactttttaatgatcaccattctaacttgtgttagatggtatctcactggatttagtatagtttcttcattcaacagatacttattcatcaccttccttctaccaggccacggagaaaaggcttgacctaagtaaacaagacatggttctgccctcatagagcttatattttattgaattataattgaaatactaaatgctaaaagggataagtagacattgctcaggaaatatagaagagcaggacctggacaagtgtggggcatgtgccagggaaagccttcttaaggaagtaacatttggtccaagctctgaaggaattgatcagaagaggtcttgaggagggaggcaaggaccagagagtggtgggaaaggccagtggccaggaggagcattccagggaagaaaattggccttttgaaggtaagaactgtgttaaatgcagacttcctagatatttggttacctggaaaagttagaaagattggttttattaatgcaagattatctaatttggggtattccttacttgttaagttattgcaagattctaatctcagtgcttgaagtcgagtgacatttgacttggaaaagaaaaaaataatgggtgatagcccctttaaaaatgtttaaattttgggccgggcacagtggctgatgcctataatcccagcactttgggaggctgaggcgggtggatcacgaggtcaagagatcgagaccatcctggccaacatggtgaaaccctgtctctactactaaaaatacaaaaattagctgagtgtggtggcgtgcacctgtagtcccagctactcaggaggctgaggcaggagaatcatttgaactgagaggcggaggttgcagtaagctgagattgcaccactgcactccagcctggcgacagagtgagactctgtctcaaaaaagaaaaaagaaaaagtttaaattttgaaatagtaaattcataggaaatgatttgatttggatgtttgtcctctccaaatctcatgttgaattgtgatcctcactgttggaggtggggcctggtgggaggtgtttgggtcatggaggtggatccctcatgaatggcttggtgccctctccacattaatgagtgagttctcgacctcttagttcacgtgagcgagagctagttgtttgaaagagcctggcatctctctttttccctcccttgccatgtgatgcatctgatcccccttcacctttcaccatgagtggaagcttccctcatcagaagcagatgccagcactgtacttctcatacaacctggagaaccataagccaaataaacctcttttcatttaattgcttcaaatattcctttatagcagtgtgaaatggactaacacaggaaatacaaagaagtgtaccaggaggtcatgagcaccctttaccctgcttcttctgggtgacagacttcaaggacagggtggtttcactgggtagctggcctgaaaagccttaaacactccctcagaactagagagtttgacatttgttttttgctctaaaatatatgtatcccagactaaccgtattctggccccagaccttccagtatgtcaaatgtcagctcataagaaacccttgcattttatctgcatggtattctttcactaattccttctcttctactccaggacataggtgtcatattgaccctttccaggtgcctttaaaaaagctatgataaaattacatgaaaagaagcgctctgctacagataccacacctgatcctggggaagagtaaattgaataagaaaacaactgatcttttataaatcatatagctatttgaggcaataagatgtcagattatgaggccgggcgcaattgctcacgcctgtaatcccagtgctttgggaggctgaggcgggtggatcacgaagtcaagagattgagatccatcctggccaacatggtgaaaccccgtctctactaaaaatacaaaaattagctgggcgtggtggcgcacacctgtactctcagctacttgggaggctgaggcaggagaatcgcttgaacccggaagtcagaggttgcagtgagccgagatcacgccactgcactccagtctggtcacagagtgagactccatctcaccaaaaaaaaaaaaaaaaaaaaaaaaagatgttggattatggagccacacttgaggttttaaaacccaaatctggacatctgcttcaaccctaatgagtagtggatactggactagctctgccaccataaacaattacacgctgggacaaaatacgtaaaattactcttttcagacagtgaacagtaggtagtgaaagactatggtcataggtagtgaaagactgtggtcccagacagagggaaggaaagatttgtcccagcttataacatgaaggcactttctggcccatgccatagcccgtgagagcccagggagattctcttggtctcagtgagctgaggaaacaaccagaattcagagcagctgaggtggctggaatttgcaggacgtagtaccagaaatgagggagctgtgcacaggagtgcctcggtagcaccttgagtctttgactgaatagcgagctgtgtgtactcacagcacgactctcgtcagaccaggcaaaaacacactaccagagagctatgagcagaatggagattccagagttcacacgagctgggagacactggagttctgtatacggagtggagagacctcattgaatactctgagcccttatgtgatacccagaatggcccctataaagtttcgaggggaaagcatcttagtggtcttgtgataaagatttcttaggacctagtaaatactatgaacaaaaaatggtaacttagttgactttataaaaatttaaaacttctgcttctcaaaagatgcctttcaaagaagggaaaaactagccaaactgagaagacatgtgcagtcctcttatccagaacacgcaagatgaacaactcctaccactcaagacacacaaagcaacttgtttttaagggggaaaaaagcttgaacaggtacttaatttatggtgaagatctatgaatggccattgaacacgtgaaaatgctcaacgtcaatagtcatcagggaaatacaagttaaaaccagagagatatatcactatacacctactaaaatggctaagattaagaagcctgacaatgctaaatgttgtcagggtgtggagcaaccaaaacacttatacattgctggtaaaataactactttggaaatctggctgtttctcatgaaatttaacatatgcctaccttgtgacccagaaattgtacctttagatctttacctaagagaaatgaaaacatatatacatgaaaatacttatacaaaagtgtccatagcacctttattcaaaacagcccaaatcaccatcaacaagagaatcgataaattgtagtataattataccacgaatggaatgtattattgatacttaacaatataatgaacctcaaaagcagtatgctaagcaaaagaagccaaacacaaacaagtatataccctagcatatcatttatgtgatatgttctagaatagtctaatctatggcttatgaagtcagatcagttgtcatctgggggcaagtggggaccgactgagggggagcacaagaccatgttctggcgtcatgaaaatgttctatatcttgatagctgtatgcagtggttaatctatcatttgtcagaatacattgaactgtgcatatgagatctgtgtatttcactttatgtaaattatacctcaacttggctacacctttgaatcatcaggggagttttagaaaatattggtgcctgggctcattcttagagatttccatttaaatggtctggggaaaagcctggccattaaactctctaggtggttctgatatacagccaagtagaaaaccactgtgttgaaagttgctgaattccagcctcttgggtgtggacataactgatgggctctaacgttagcttactggctgaaattttagcaagtagagatttatttaggttagcaaagttattttattattcaaaagttcagaattggtattgcatgattatacttccatcttggtgtcatgaaaatatatacttaatagttatttggatcaagctaccaccatttaacatgctttgtcaattgtagtatgtcagtaaggtattgcaggtattattattactgtagttgttgcttttattattgcttattacggcatttggtacatagtaggtgcacaatacttaatggattaattaatgagatcctgatagctgtgctagtctcattattaaaatagatgtgtgctgtgctagtctcattattaaaatagatgtgtttttgcacctttcttcttcctgaaatcctttctgcctcaggtcctttcctgctttgcttgccactcttttttacattccttttgaaattgttgttcttcctttcttgaattccagagattaggtttaaagttgaagataataaaaaaaatccacaatctacaaatttgatatttctttgtaaaaagatctgcttgctgtgtcccttgagctatttttccagtaggtgaggggttttggcaaatgagtgaaaaagctgatgttttcaaacacttccctatggccagtgatatacaggggttaaaggtacagtttatgattctagaacacattttttgtggaaagtcagtgtccctggcttcattagcacccatatgtgactcactgttaatgtgccaaaatattatgtggtcatcaaggggcagatggtaaattataaagctgttctaaagcccatataaaaaatcccaattcaggggaactcaggttgatggacagcttctacttttggacagagagtgaagccttactctgtcccacactctgacatcacccaccataactcctgccccgataaaaatatctacatactcctaagtagattttttggctctaagttagcaagtagagttttttgtatttgaggttttttaaaatgcatatacccctgaaaggattaagacaagatcatcagtcattgtaaccttatgtgaatgtattaaatcaaattatatttgctagaacactccatatggagatgtttaacactgaggaaacagaagggagggcaatttggaagcaaataggaagagatagcccagttggaaagaggtactttggcagggtacggtggctcatgcctgtaattccagcactttggaggccgaatcaggaggattccttgagccaaggagttcgagagcagcctgggcaacatagtgagacctatctctactaaaaattaaaaaatcagccaggtgtggtgacgtgtgcctgtagtcccagctacttgggaagctgaggtgggaggatcccttgagcccaagaggtcatggtttccgtgagctatgattgtgctagtgccctctagcctgggtgacaaagtaagaccttgtctcaaaaaaaaaaaaaaagaaaagaaaagaaaaaaaaagaggtacttgggtaggcagaaggtgctgtgataaagtttcttggccttggatggctggaaagagccaaagatacacagttttctccagtgtccttacctcaggtaggatgtgccccctccactttggaactgagatccgtatgtctctgtttgctgccctgccctgcctcagggccctggggtgataggtcaaggtgttctaggatgcagaggtgaagaagagagagggcgtgggaagggtgcagcataatagtgcacagggagctctcatgtatgtgaacacaagtaagtgcaggcagctgtgggaagtgtgggctctgagatattacctataccattgctccagacataactacgtcctggtgtttccctagaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaaggtaggccctgtctctaattatgatttatgatttaatgcaccaccactccagagggaggagtgtccctaaccttcccttccccagggcagagatgtggtttgtgtgacctggtagcatagtgccaaagggcttctgcttcagactctgtctttgcctcgcacaccatcacccaatgtaataagtaccatttactgcttaattttcataataatcttttgagatactctacactgaaagatatactgtacttacattaaaacgtaagctccaagaggacagagacttggtcttattcaccactacttggtcaatgacaacttcaaggggcaacaatgttgaatagtgaactaaatcatggtgcatacctatgatggaatagtatgcagccattcacagttatgttttcaaaggactttaataagatagaaaatgccacattatattaaataaggaagatacaatattgtatatattttataccaattatgtttatatataaacattgatatgtattttcttaagtatctacttatctgtctattgagagaggagaaagaggacaagaagaagggagaaagagagggagagtatgggagagaaagggagaaaatagtaggtaaaaaatacaccaaactattaatagtaattttttgagctgcgggttgtgagtgatttttgttttcttttgtagtgtgtttattcttatttttcaaactttctatataatcagatatttgggataataagttaaattagaactatgaaaagttgttatagtataatgaaaaaacggtttcttaaaaatttatgtgttgggctggacatggtggctcacatctgtatcctagcactttgggaggattgcttgacccaggagtttgagactagcctgggcaacatggtgagactctctctctagaagaaaaacaaaaaattagctaggtgtggtgatgcacacccgtgctcccagctactcaggagggtgaggcaggaagatcacttgagcctgggaggttgaggctgcagtgaaccgagatcacgccattgcattccagcctgggcaacggagtgagatcctgtctcaaaaaaaccccaaagaaacaaaaaaacaaaaaaaaaccaactatgcggagccaggcatggtggcatgtgcctgtaattccagctactgggataccaaaaaaattctatgtgaagggtgaattatatggtatgtgagttatatctcaataaagctgttataaaaacaaatctatgtgaacatgacagtatagcataatggtggaaagaatgtgtttgagaactatgtagacttggttttatatacctacctcttgccagataagtgaccttgggcaagttatagaactaacttctctgactttcagtatcctcatctataaataagaaatgtttgttatgagtttttttgtttgcttttttctttttcagagatagaatcttgctctgtcacccaggctggagtgcagtggcggaatctcggctcactgcaaactccatctcccaggttcaagcatttctcatgcctctgcctcctgagtagctgcgactactggcgcaagccatcatgctcggctaattttttgtatttttaatagagacagggtttcgtcatgttgccaggctggtctcgaactcctgacctcagacagtctgcccgccttggcctcccaaagtgctgggattacaggttatgagccactatacctggtctgttatgagtttcaaatgaaattaaatgagataatttatgttcatcacttatcaagtcttttgtaattaataagccctcagtagtgggtagattttatcatcattagcttttataatctaattacacttacatgcaaaaaataaattttaaaaagttgagcaaatatggaattagccacagcttgaaatatatgtgtcttttaactctgctctttcattccttgaaacctgcagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagatgtaagtggatttctctatagttccaaatatttcctatcaccaacttgtacactgaggcagaccgacttggccctttcatttatgactatttaaatattatcttttaacaaagagaagaattctccaatttggggaggatggcattatctcattatgaaccttgactggcgtcatcaactgtacacctgttccttgttcaccaatataaacgcggctacaaaccatatttttggaaagcttattgaggaaaccacagcagactagtccctgatagcactccgtattgtctccggtgcttctcttagtcaagataacattacaaatcaggagtctaaagaccagattccatcaatggcttgacactgcctcccaggtagttctaaaaagtctcttaggttccctctacctttgcaaaataggagtgatgtgtaggcttgtcagatttagtaagtaaaaatataggattcccagctaactttgaatttcagttaataatgaattcttttttttttttttttgagacagagtttcgccctgtcacccaggctcgagtgcagtggcacaatctcggctccctgcaacctctgcctcctgggttcaagtgattctcctgcctcagcctcctgagtagctgagattacaggtgtgtgccaccatgcccagctaatttttgtatttttagtagagacggggtttcaccatgttggtctggctggtctcgaactcctgacctcgtgatccacctgcctcagtctcccaaagtgctgggattacaggtgtgagccaccacgcttagccaataatgaataattttttggtatatgtcccatgcaatattcaagacccacttatactaaaaatttatttatctgaaattcaaatttaactgagtgtcttgtattctccctagcaatgctaatagaggagggaagaatacctgccctgtcaactcacagtgcaaagtgggtcaagtgcgacagtgctttgaacagcaagactacactgtacaaattaagattctatgactttcagaactccacacaagtcagtctgtatgtaggtctgttcctttatcagaacagataacgatttccagtgaaacaatgcagagatgttttctgtaacctcccctctatttttcctttgttttaaaacttttcccttaataactcatatctcttttggatgactggcttttatgccctcccaatataaagaaaagaagatgaccattctcttttatggagaaagatggcttgatgatctctgttatggtgttataatatatagctggtcttgttatttagtgattgtcaacaaatacgattagtggtcccttgcagtaaagtcccatctgctcataaggtaaaatttttatagagtcaaaaatatctctaacaacctcttaatttgcccagagttggatggttagactctctttggttgaaccagcaaaggcttgtgcttagagccatgttgtagaaaaaaaaaatacttgtagtaaaccctagaatcacacagagaggtgatgcccatgttgtgagaggcacataggaactgagggccgcaggaatagtaaattgttgctcccatctcacggtcactttgaggtgttagctcagttaaaatggcagggcagaatcatttgcacttttcaaatcattgttcctttctgtgtctctgtcacttaactaccaagcacagtagaactgaattgagtcacttaaaggaacacatgatgcagttccattatatgaggcagctaagccctcatttttggttaatatcccccaatctgtttaggctactgatcctttttagcatatcacctcatttagttacctaaattgtatattttgtttatcttgataatctcaagaaatgatgtacttgaggctggatgttctttgccaacaatgagcatctggttataatttaaagctttgtcacagaggatttcatacttgagacagctagagttgaatggagtagaacgttctgcacacaccaatgattgtttctttgcagtcaaccagagaccggaccttggaccagcagtgcactgtgagtcgtccaggactggccgtgattgcaggagccctggccgtggaattgatggtatctgttttgcagcatccagaagggtgagtttgctagtaggagatgagtatttaaacaaagcttttgtaggcagttgttcatcagtgtctcccatggccttttctcagtctgactttacagagaatttcactatttcaccctcaaaaaaacaagactagaaaaagcaggtctggttctttgggctgagataacttggcatgtttcctttgtggccacatttctgcatctttccggacaaagtcactatggtttattttatttttccaacgcttatatagggcttactttgtgctaggcactgttctaagcaccttagaaattttgcctccttcaatctttttttttttttttaacgagacggaatttcgctcttgttgcccaggctggagtgtaatggcacgattttggctcactgcaacctctgccttctaggttcaagtgattctcctgcctcagcctcccaagtagctggaattacaggcatacgccaccatgcccggctgatttttgtatttttagtagagatggggttttgccatgttggtcaggctagtcttgaacctctgacctcagtgatcagaagtgattcacccaccttatcctcccaaagtgttgggattacaggcgtgagccattgcacccggcctcctttaatcttcatagcaaacatattaggaaagaactattattattagtcgcagttttgatggggaaatcaaggcatagtgaggataagtaagtggccaaatttacatagtaaatggaaaagccagggtttagctcaaccagtgtggctccagactatgtttaatgactttgttatgctgtttgcaatacaggcagcagaaaatcgaatttttgaaagatttatttttccagttctcagaaagtcaatatgcaaattaacatgaatattctatttcttgtgtgactcaaagctttcctcagcagttgaaaattgtggttgtatatgtaactagtatgggtactctgagataaatgaaaagcggggcttttttgtcttcctctttgtcatccaccttagctatctgtcatttaagtttattgccactctctgacaggaagtatttgggataaaatctttgagagctgactttatgcttccttgacactgagcctctgtctgccacatttgccctggtcatagtttaaacaccaggtcctgtgtcacatctttttggtgccacaagtatcactccattgttcagagagtagtgtattagttctgcccaattcattcttcacttttatttcttccatttcattagcatttatatcagctcaagaagttaaggttagaaaattttccacttcaaattttcagtacagaaatgtgctgtgatgtttgacaagactatttcatagtaagtgagttaatgtttattggcctctgatatgccgaacattgcactcggcagttgatgtagtagattcctcatttattaatcagagctccctcattcctactttatagatgatggatctgaagcacagaaaagttaagcaacttgcctatggtcacaagctcaggtctttctgactccaaaccatgcatgtttaaattactcttcttgccctttgtcccagggaaattagttttttgctaacttacactgcccagcaaggggcattttagttatccttatgaatcttatgtagatttctgctagatcatcctcccatgtgttaaacttggattaaatgagcagctctgattgtttcctgtcctcaggggctatgccattgccagcagcagtgacgatcggatgaatgagcctccaacctctcttgggcttgtgcctcaccaggttagtgatgtggaagtgaaatcacaattcttttggtacagggggaaagcatgtggggtctctttgccattccatctgcccagcccacttcatatccaccctacttaccctgcagctgggatttcaatgggagagctttctgaccacctggaaggtattccattctgcgggatagtgatgggaggaaatcacgaacgagaagcattgcccagagtctttgatgcgttttgtaaactgactagaggcctcataatgcaataggaacagaaaaaacaggctttggaatcagtcatacaatggtttaaatcccagccctgccgttataaagatggccttctttggccaagtcactaaacttctctgaggcttagttttcttatctgtaacatagagaaggtaatgctgacatcacctggtagttgtatggattatggatggttgctagaaagggctcagcaacagtgtatatcataggccctcaacaaacaatgcctgctgtttctttactgttgcttgttattattattgactctgaacccaaatagaaaacctttataggcaggcatgagaaaaacattagaagcatgcagggtcaccaaaaagtggggtgtcttttcagaaaaagaatccaaagcatcatgaggaagttccatcccttagggagtaaaaagaaaaaggcagtgggatgatcttttagaattcatgttgcctcttcagtcattttcattactatatttttgggagattgaagaggttttccagtcttatttggaaatcatttttttttagattccatgtatgtatcctctcctgtaatgtgactgctgttcccatcagtgaaatcgtgatggtgcccaccagtcctatctggtgatttgcaaggacagactcagacgagtgcagagagcagagtgactcagctcatgcttgtctctctcttcctcctcgccacccaccttctgccagctagggcggcactgtcatattcagtttaggatgagaatcagaagaggggaaacgacttcttcatggtcacagagacttagtggatgagccacaatccatacctaaacttggcagtctgacaaatgttctttcaaaggtcttgtgagttgaaagatccgtggcctgcatgttgggagattttgcttcctgttggtaccccagcccccttgcacaaaaccacccataatagaacttgtgggccgggcgcggtgactcatgcctgtaattccagcactttgggaggccgaggcgggtggatcacgaggagaggagtttgagaccagcctgaccaacatggtgaaaccccgtctctactaaaaatacaaaaattagctgagcgtgatagtgtgcacctgtaatcccagctactcaggaggctgaggcaggagaatcgcttgaacccgggaggtggagggttgcagtgagctaagatcgcgccattgcactgtggcctgggcgacagagtgagactccatctcaaaaaaaaaaaaaaaaaaaatagaacttgtagagttcacttagcctcccagagtctcagtttccaaatcaagaaaagcaggtgctttactttgtgtccaggattacatctgacacggccttgaaaaccacaaaacactatgaaaatgtgcccccctctgtcccccacacacaaggtggcatttttttttgacatgcatgtgttaatcttttctacagagacatttcacgtaggacccaaaagacgcggtaataaccatctatcataaggaagctgatctccagagcctacctctgctatttatgctgtcgtatctcatttgaatctttcccaagtctcccgccttcttctgaccttgagatgtgccctcatctcctttacagactttatattgagaagggccttaattaaattttcagtcatgcccctgcactggtttccttctttaagtcctttatgttaaattactgcagttgtagttttctcagtgctgaggccagagggcaaaacagtctctttatagaaggggcccagtgtcaaaatgcatgtgcccatgtttttaaagtactatggcaactaatccctctcggtgttatttatccccattgagcctcagaattatttgtcattcaccaactcttctagttctttctcctcgttttcaaatgtctgaaggattattttggttgttggccatctcttcatttgcccttttcaaagactgaagaataacgcagccatatatgggaaaagctgtgtgtgtgtgtgtgtgtgtgtgtgtgtgtgtgtgtgtgtgtttacttgcttacattgtttcaagtttcaagcctttatttttagctactttctaagaaagaaagtggagaaagaactttaaaaattaatcagggttgtgtggtccccatgtataggctttaaacaacttttttccccctaagtggagtgagtccatttatgcaaccatgttttgattaggggaccatcgtttccacgtttccacaaaaacactgggctgtgttgcaatgccctgttgcaaactcagcacttccctcctcctcttcctggctcctagagacaaatgatttcctgttggagaggaacttggtaaactcctttgtgtactttgtatgcaaagaagaccagtgaagtttactgggctcatttttctcagttcccaagaggagaagttttattaattggcccctgtggaagagatgtagtagaaaagtgatagtccttggactgagaatcacaaggccccccaccagcaactcattgtgtaatttggagaaagttccttaacttttcctgtgctctctgggtctctgctctcctctgtgtcagacctaggaggcctgaggattacttagttgttctgtctctgggtccacaggcagaatttggcccatccaaagactggccaagtgccaaaaaaaggcctgattaggccctgaaattcagtgaaattctgcctgaagaaacctcttattgaatttgaaaaccataaaccatttcaggtgagcttatgggtttgttttgggtttttttttttttttttaagtctctggcccaatgtacgtggattagattctgcaagcaggcagcagtaagtataagctaatttctgtctataaaaagaatgattaaaaaaaatcattttgttgatgtgtggaatagagattatcacacacatcattaagtggtaatgtgatgaatgatcacaaaacgaacagtcttatacccagcacacagatcagaacaaagtaactatcaagcaccttcaatgcccccctcatgcctcttcggattattattgcatccttcctatagagaggtaagcacctcttgattatcagcaccatgggagatgtttgtctgattttgaacttctgtaaatgaaatcatatagtatatactctttggaatctgttgtcttttgtagagggaactttttcattataaatcttatagtagtgttgttccttcttcccatcaacagtgttcttttacttaaaaaaaaaaaaaaaaaaaaaaagaagaagaagaagaaggaaagaaacactgctttttccctcccggctggtggctgagctctgcaaggccagatcctttttctggttctttggtaggaggcacagttcaggatttataaaatgtacaggccactcttgatatctccaggaagttggtttgccggctggcaagagatcctggatgtgacagaaattaacagcctgttggcctgctaattctttggctgtacctcctcaaaggatgataatgaggtgacaaggctaggcacagtggctcacccctgtaatcccagcactttgggaggctgaggtgggagaattgcttgagcccaggggttcaagaccagcctgagtaacatagggagaccccgtctctacaaaaaattagccaggtgtggtggcacgcacctgtgggagtttgaggctgcagtgagccagtatcacactactgcattccagcctgggtaagagagggagtccctgtctcaaaaaaaaaaaaaaaggaatcaaggtgacgctacaacagttgtccaaacaccaaggtaattgatggggcattcctgctttatcccacttgtggaccaagcagttcacatcttttgtctttaggtgaatgaactcttggttctaaagtactgataaaaaaagaccctgaatgtgtatatgccattcttctgagcttggaattgccaaccccagggttttctcagcttcatgaattcttttagcttcagaaaagtaatacaaagccaaaactagggcaggaccctgggagggacctggcctgggaaaactctaattgagtcacatgctgaggtggagctgggatctctagccatatctcgggatatttggcctttctgcacaggctgtgtcccccaaatcctcaagcctttagattttgaaaaaatctctttactgtgttcagaaatacttatctcagtgtgctcctagggacatggacagatggactgctgaggagggaaatcttagcagataagcaataagagcatatttcctgagatgcagcccaggaaaggagcctcctttacccctctggttctaaacctctctggttgatgatgatggatatagcagaaaaaatgggcaggcctcatgtttcactatatcaagtgctatcgtttgtgacctgttcatcttatttccctccctccagccatcccctcaacaggtaatctgactctgccaagtgccaagcactatgaagttcagggaagttaagtaactggcacaagatcacccagtgttgagttccatttgcgtttggggtaatctaaggtgatggatgtatcccaagccatttggatgtagtagagtctggttccagtggggaggcctctgaatacaaggaaggatccgggtataggtctaacaatgtctgggcttcctctgtgaggtcccagaagaagagtcaagattgctgtttccctggaggataaattataatgtcagcgttcagaagcatctcagattgcatctcttgtcccaggaggagttgggcctaaccttacaggttgaaggatgtcactttgccccatgagttttacccactggatgaggctgtcctgtttaggaggtgcgtgtttaggaaggcagcctgaaggttttgtgatcatacagatctgattagaaccccagctttgtctgttaatttcacattcagtatctcattttacaaaaccagttggggcagctcttagcacttgtccctgtttgaccttgggcacgttacgtatcttctctgaacctcatgttttatatctgtaaaatggggataatataataagctcttggaattcatggatggattaagtcacacgtactaagcattagcacagttctgggcacataagagacccttgtaaatatcggtttcatctttcacttttaattaaaatggaaacttatccactctcctaaaaaggaatttataaagactctcataaagctctgaaagcaatgagtagagagggagtggttgggaagatttgctccattctgcagtgtttttctaaggataacactggctcatgtccagcttagtttttctgcccccttggtgactctagcttaatagcgagagttgggtcagtggtgggagctgaagctcttagctgaaacaaagaccattctggtgtgcttagggttttgcaattgctacactctccattttggcattgaacttgattaagactcttttcagcatccaagatcgatctggagtttggagttagtttttatttatgcgaactccaagctttagaaatattgccaggcctgctggaagctagtgtgaagttaaagcagcaagttccagttgtggctgcaactgtgctttctcagaatggctgtttgttgctgggcattggatcttagcctcccatcgaggcctgggtctgaagctaattttactcagcttaggtgaaaacaccaccaggggtgggtggcccagaaagaaagaggaacctttctattcttgatctatttattttgtggccaactgggcataattgactaaagataattgaatccacctgataggtgttaagccctctaggtgttgagtttttgttcgggagttttgttttttttttaattcctctagcctctttcttcctttctacctctttgcttttcagctttattcctcaggctttagagccagaaagaacaaaattcagattcctggctttgccacttggtagctgtggacccttgggcaagccatgtcactttcctgagcctcctatgttcctatttggagatctgtgccacaagatggtagtgaggccaaaatgagatgcaatgtatgaaaacacccaggagccctgaacacaggcatggaattcagtaaattttagtgctctcctccctccattctctggggtatcattttccacattattcaaggacatgccttcctgcctggcttctaggattaggagggaacatttgtttatttgaaagggaaaaggaagagaagtaagtgctttagcagggggacgtagaacaggcagaaacaatggctgggaaaggtgctcagcgagtttgaggaagggaaaggccagtttacctgcgagacagcgagtaaaggggcacagcggagaaggcaggaatgcaggggccattggaaatgcctggaccttcaacccggggccctgggaggccgttgaacgctgaggtgtgatatgagtagatttggttgctgcatggagaatagactggaggtgatacgagtggctctgggaataggatttgagtcgtttggtcttaaatcagaagacagcctaatccagggattcccatacctggccttccatcagaatcacctaaggagccatttcaaaatacccatttcccagcccatcccagagccactgagcgaaaacctccagggacattaggcatttgagaaccactgcttctgtccatgaaaacatggcttcttgatagcatcacctgggacaaagtacttaagtccttaaggtagcacaccaaatcctgctttttgaattttgtgcttccaccaacactagttgtgtttctaaaagacccttggcaccttgttcccagtgcacatctgcagccccaacaggtgttcctgcctgagagcctttggaagctaattagacacgcacaggtgtgcctaatgaattcctgccggaccacacgctgtccagctgggaacagcccgggagcgaggccaaacaaccatataaagcgaggccaaacgacctattctgatgctttttgcatgctgtctgccgtgttttcattccccacggtgaggacggtgtgtcctgtctcctaaggccctgtgagccaagctcagctacaacctggtgccccacatctgacaacagggatttccactcaaagtgcttggcccttttgggcctgggggtgatgagtgggactggagccaagaaaccacaggtaattgggattcttctaggctctgtgattcccaggtgggttttttaatattcagggagtagcaaagatacaaatattgtagagctagtttaggcgtacaattttttttttctagacgtttctatggaacactaatgttggtgattattttgcagggagagggaatggaggtaacagggacttagggttttcatttcgtacttttctgcagtgttttgaaaaattaagattataagccttttttaaaatcacctttttcaagacataactgatatatagtaaaatgaacccattttagtatgatttgacaagtgtatacactcacataactatcacttccacaaatgagatacagaatttttctgtcaccccaaaaagctcctttgtgccttctcccagttcatctccccaccctcagccccaggcaaccaccaacccaatttctatatggaccatttttattttttctgtatattttactgtactaagggaaaaaaaatgtaatggaaatcttaaaatgttcagagggaggcaaggtttggtcactctgaggaatccctcttactagctacaaagttggtaggtaagggctgggtgtgtgtgtgtgtgcgcgcgtgtgcgtgtgtgtgcgtgcgtgcgtgtgcgtgtgtgtgtgtgaaatcggccatgttttccccttgtggggagaggggagaatgagaaaacaatattcaggtgaggctgtttaaaagaaagttaaatgtttagataattttttaaaaaataggaaaatggaagtaaatatgtcatgggagtatgggttattgttttgtttgttttgtcatgtgtttatcgtttttattacagaaagagttaactttttttttgaaaagctgtttaatgcttaccctactataaggagaaactgacaacaaataggagaacaagagttgagagtaagctgtgtgagacttacgttatgactaactccaaaaggtagaaaatttactttcagcaagaggctttagtttcctgtgtggatggcaaaacacctttgatatcactttataaagccttttaatttaaatgttaatttaacatgaactaaattaggtggtgtggtggtactatttttagaaaatgcgcaaagaattagaggcttgctaagtgcttccatccgttttctgacagctaacaggtgatgctgagtggtacagagcaaaccacgggagggtgtaactaaggttagtaacaaagcatcctgtttcccttgcttgcctgatgggaaccacctggagctcttgttaaacctgcagattctcaggcctttccccagaccttttgaatcaagttccaggggcttcttctgatgaggcaagtttagaaaaacactgagcaacactttgctttatagactttgcacacttctaagtaggaaggtcacggtgaatttttctccacccaagcaaaggacaaatctttttaacttctttgggagttgcggcctggcctctctcaataggtatgtgtatatttattaggacctttgcataaggtacttggattttagattgctctggggtttctatgcatatgtaagtaaggtgcaacttctgctctttaaattttatgcagttcttataagattgaggaagtgcaatgcagagcatatgaatggtggcaagtcagagtttttcttgtggtttgtgtgggacctattttctctgtatagtccagatttgaataattttgtaagctttgggtttttgtttacttgtttattcatttcataatttattgtcttacgagcaaatcactgtgctatgagtaaatacaagtaaatacaagtagctcagcctgtgtcttgtcctctaaaagcaagaaagataaaaacatttcttaattatagtattcagactgatcctcaaattcatatggaagtgcaagggacccagaatacccaaaacgatcctggacgtgaagaacaaagttggaggactcatactttccagtttcaaacttagtacaaatctactgtaatcaagatagttaagtactcacatagagatagaaatatagatcaatggaaagaattgagaatccaaaaataaacccttaatggccaaccaatacagttcaattgggaaagaatgccgttttcaacaaatagtatggagacagcagcattccacatgcaaaagaatgaatttagacctttatttcataccatgttaaaaaattaactcaaaatagatcatagtcctaaatgtgagagctaaaactgtaaaattcctagaagaaaatatcataaatctttatgaacttggattagacaatggtttcttatgtaagataccaaaagaccaagcaatgtaagaaaaaatggtaagtaggactgcactaaaataaactgttgtgcttcaagaaagcacaaaaagtccatgtgtggtggctcacgcctgtaatcccagcactttgggagtccgaggcgggcagatcgtgaggtcaggagattgagaccatcctggttaacatggtgaaaccctgtctcgactaaaattcaaaaaattagccaggcgtggtggcgggtgcctgtagtcccagctactcgggaggctgaggcaggagaagggtgtgaacccaggaggcggagcttgcagtgagctgaaatcgctccactacactccagcctgggcaacagagctcaaaaaaaaaaaaaaaaaaaaaaaaaaaaagtctgggcatggtggctcatgcctgaaatcctaatgcttgggaggccaaggtgggaggatcgcttgagccctgagtccaagaccagcatgggcaacacagcgagacctcatctctcttaaaaaaaaaaaaaaaaatcaaaagaattagctgagtgtggtggtgtgttcctgtagtcccagctactggagaggctgaggatcgcttgagcccgggagttcaaggctagagtaagccgagatcacactgctgcactccagtttggagaacagagcaagacactctatcaaaacaaacaaatgaacaaaaaaaccagaatgggagaatatatttgcagatgatatatttgataagaaacctttatccagaatatgtaacaaacttacaatacagcaatttaaaaaatgtttaaaacttggcaaatgatttaaatagacatttctccaaaaaagatagacaagtggtcaagaagcacatggaaagatgcttgacattaccagtcattagagaaatgcaagtcacaaccatagttagataccatttcatactcactaggatggctataatctacaagagacaacaacaggtgttgacaaggacgtgaagaaattggagccctcacactttgctagtgagatttttttttccccttgcccccaagatggagccttgctctgtcatccaagctggagtgcagtggcacgatcgcagctcactgcaacctctgccttccggtttcaagcaattcttctgcctcagcctcccgaggagctgggattacaggcatgtaccacaacacctggctaatttttatatttttactagagatggggtttcaccatgtttgccaggctggtcttgaattcccgaccttgtgatccggccgcctcagcttcccaaagtgctgggattcaggcgtgagccactgcgcctggccaagattttaatatgatgtggtcactttggaaaacaagttggcagttcctcaaaatgttaaacagtcgtcatatgacccagtaattctactcctaggtatatttccaagagaaatgctcatctactgatgaattgctaaataaatgtattatagcaacacaattgaatattatttggcagtaaagaggaatgaaatgctgacatgtgatacaatgtggatgaaaatatgctaagtgaagccagtcatgtgtgatttcatttatagtaaataagcagaataggtaaaacaatagaagcagaaagtagattagtggttgccagtgtctgagagaggggagaatgaggactaattgctgggtttcttttgggggtgatgaaaatgttctgaaattagatagtgatgatggttgcaaaactgttcatatactaaaaaccactgagctgtacagtttaaaagatgaattttatggtatgtgaattatatctcaaacccgttatgaattttaaactccaaaactattcctcaaggtattttgggcataaagatcaaaaggatttcagagggtagagatactatttctagattgggtagtagattgagaatttgtgaatgaggtgtgtttgagctgagtggtttttaaggaaggtgaacacttagatatgtagctgtcaccaaaaggaagagttttgagtcacagaattcagcatgaggcaagctcaggaaatcaagaatatctttgggagggaagttgtagttcagcttagcagttgtacagagtctgtaaaaaaaaattcaatccaaaatttaattggaaaggtgggttgggcccagagcagagggaccttggagtgcaaggaattctctgccttatttattatttatattttatttttattttttgagacggagtcttgctctgtcacccaggctggagtgcagtggcaccatctcggctcactgcaagctccacctcccgggttcacgccattctcctgcctcagcctcccgagtagctgggactacaggtgccgactaccacgcccagctaatttttttgtatttttagtagagacggggtttcaccgtgttagccaggatggtcttgatctcctgacctcatcatccgccctcctcggcctcccaaagtgctgggattacaggcgtgagccaccgcgcccggccttgtctgccgccttttgtcagctatagggagtgggtaaaaaatgacaggcctcagagctgtgtattaggaaaactgacagctgagcctttgcattagctagaagggagggagcccacctgtggaagtacccccttaggagtctcttgcagtcggttgagaagaagggtttcctgtcttgaattatctaaaactggaattattttggttaaattgtgggccttctgatacaaacttggtgaatttgaaagtcctcacacacatattattctacttcattttctgggaaaataaatctgtttcctagtaaagaactgtctgggcctgctgaacggtggtgtgtggaccctcattcaaccaataccgtgcacggcatcttctttttcttctattcctcgccacctgtggtggtgttgttgtttttcttctctatttcctctctccctttctaccccaactggatctactttctccctgtccctcagctttacctgcccacctccaatgataagacagtatcagagaaaattaccagtatttgtgcaacataaagtaagtttgatgaaaaccatattagagaaaacagcatgcagaaacctttccatgaaacatagatggacacatgacttgtaggctgtgttaaaaaactttaatggaaaaatatgctaaatgtgatgaagttcttttctaagtaaacttaatataaaagtaattggggtatagaggagactcactgtgagtattctcaagcctgtaacttccagagctcgtgaagatttcagcattcccatttgtgacttgctattaaactcttttctgctattttgatgtctcctattttgacgtcctgaatagcaaacttatgaccctgattatgcctcaggtcatggattatgaaatggttaccacattcctgagatgttaggaactaaaaggttgtcatattttcatatgtttatgatgaggctatctaacttataccagttaccaattttttttttttttttttgagatggagtcttactctgtcactcaggctggatctcagctcactgcaacctctgcctcccaggatcaagtgattctcctgcctcagcctcccgaggagctgggattacatgggtgcaccaccacacccggctaattattttgtatttttagcagaggtgggggttttgccatgttgtccaggctggtctcaaactcctgacctcaggtgatctgcccgcctcagcctcccaaagtgctaggagtacagacgtgagccactgtgccctgccaaatttttaaaatgtctttatcaatatgctatgtgttttttaatgcaatccgagatcaagtgtttgatagaaatgataaattcgggctgggcgcggtggctcacgcccgtaaccccagcactttgggaggctgaggcaggcaggtcacctgaggccaggagttcaagatcagcctggacaacatggcaaaaccccatctctactaaaaatagaaaaaacttagctgggtgtggtggtgggcgcctgtaattccagctactcgggaggctgaggcaggagaatcacttgaacccaggaggcagaggttgcggtgagctgagatcacaccactgtactccagcctgggcgacagagtgagactccatctccaaaaaaaaaaaaaaaaaaaaaaaattgctgtaggcatgtttttccaggtttgatttttttccagagagaagtatgcacaaacagttaacactgttacagtgtgagcatcaggatggagttatccaaaactcaaaagaagcctttttctttaaatagtttgtcaaattgtttgtttttcggggggtgggggatttgagggagagggcatggtgttaataggatggctaaacggtggtggatcgggtcttctgttctgttcaagtgagagtgttaaagttgtgagaagacctagtgttgaagacaaacgctgtggtattctgagagggagggaagcagagaagctcaggccgggggcaggttcacatcaggaggtccatttttgagtcttggctccattacttactgtttacctgagccaagttgccattcttcctgagcctgaggtttttcaacataaaatggggaatttgaaaggtcaaataaattaattcataatatttgtgttgtctggtttattataaacgttgagtcctatggagagtttagagatgttaccattcatatttttatgatatatagaacagcttaaagctccccctttggtgtaagtatagtatatacaggtataatgttctgaataaattacttcagttatagtttgtgaaacctgattatagctgatactctggaaatgtaactcagttgtagtccagaattttatgctcaaggtggtgctgtttccccataaatctgatgatgttttacattttatctctatctgttccaaatcaagcaaataactggatatatgtctagggccatttcggccttccacagtcccccaagccatctttccttgtgagaccccacccaaaatcatgtcatagaaatgtgtatttaccccatattcactagaacacatgtgggagcttaagagttgagtataccagtggacctgttcaacattttggaagacatttgttaaaaaatactttagatactacagcttgctttttgtattttagagtcagtttgtttttaggtcagaaatatttgaaaagcttgtaagccctggctcctaatggaataaaggacctaatatagttcttctgcaaactgattacgttacaagggaaaatactcatttcgaacttatttttgctcataatctctttccgggccgccatattaatcatttcctacttgttgtcagaaaccagacgtgcatttcatagatgtggtcgttgtgtgtttgatgtgaattgttttgttttgtttgtttttagatccggggatttctttcacggtttgataatgtccttcccgtcagcctggcatttgacaaatgtacagcttgttcttccaaagtaagtcattttgtattggagggacttgtttttaaaagtgagcgggtcagcatttgaccgcagcctcaccagctggagcccttgaaaccaactaagggctttttgtgggggaagggtggggtctaaaccctcagaaaggactttgttttcatggatctgtattcattctcacagtggtttaaaaccagcctgagaaaatgtgtagggagactgagttaaaatatttcaactctgtatcaatacttgcatcatgctaattttgtcttgaatttgaactttactgctctttgttcctccccagagggttccctcctagccaggaccctcatagagcaattttttaaagcgttactctgagggtgaggcggccctggctatgcatcttctgcagatccacataattacaaagaaaaagtaaacagagattaggggcctggatggggagccactaaaagggccccttcagctttgatctttccagaagctctaaaaatagagctggtatgttagccatcgtaatgtgaaacggctgatatatctcaaaactacagtgatggcatctcgtgttttaataggctttcggataccatctgagtgatttttacatgcacactgtatgtgatagctgatttcctttcaagtgttcctttcagccttctgctgcccagcgacttgacctgggcttttaaggctcatgattgctgataagtaaagattttcatgttgaagtgctatacaaaataatgttggtgaccactaatccccaactgtggcttctcagttacaatttggaactatttttcgtgtagccttcgtctgtctgccactgtggaagaaagagaattctagggatgtatttctctattctgagttgacaagcttcctttgaaaactgtacttgggctatattttatgggaagcacaatcctgaccagtttctctaaaaattgaatgtagaattgacaagcaatgttgataaatttggttacgtttagatgctcaaaaattgagactaattattttctttttgcttccgaagtaaactaagcctgttttattatgcatcccaagtgcctatgttgagatttcaagcttagactttgtcagtagttacccatgagcccattctttctgtagtttcctttaagatatatctgctcaagccaggacctcaaggatgtctgcatgcacccccatcttcagaaatgcaagttttaggattgtatactacatctttagtggagcagattttttttttctttgaatggttgagctaactggtctcaaaataacttggcagtattaattttcatactgaaatcatttggcacaggtgccaggttttctatggctttatgttggtctggctagtcaatgaaataaagataattgggttctctaagtgaaatgcaaacactcattcattcttgttctatttctaattaaattagcctttcagatactgtttataaaagaatcacaagcataccatctaactgggcgttccttatactttaaaagagaatagcttagcatttttctttcacacttattgtaagcttttaattaaatataggtatcacttttttgttagcaaaattatttcctcttggtgatcattttgagagtcctgctttacataaacatgttggacgatttaatacaaactgacttggattttaacagctgtgctattcccatagcggtcacttttcatgtggtctgagtattaaatttcttttgtcctggaaaggttgcttcattggtgcacgtatttccttacagtagaaacgcagcatttacttacttggctaccttctttatttgcttaggagattgtcattctctattatctgcaaacccaacattaatactttaaaatgacaaatccaattacattttcatttctgtgtatttgaatttttcttaatgtatatttagtataatacatgttatacagagtcatgtcatagttgttgtttcaaaagattggggctaaaaattacttttaaaaatttatcctttgacattcatgaagtaattttttcctttggtagttttcagtatgtttcctcctccccaccaggatcaaggccatgcttgtgtcttgatttaaccacaaatagagacagactggggaagtagaataagtttctgctgaatagtgaagcacttgttcattatcttatttattaaaaacaaacaaagcaatacattatatacacatatatatagagagagagagtgcgagcacgcacgcacgcgagcgagagctttttatgtagcctgaggtggggaagaatacagtgctttgcttctaaagcaggaaagttggaacatttatccataaatcatttcttatcctatgtgatcttaggttggcacataacgaggtgaattgttccatcttaggggaaaaatattgaaggatggtggggagaggtgggtggtgaggagtcactttcattccagtttctacttattgtcttgcagaactttctaaacagatggtatttgtcaatgaaatttcaaaagaccttatttgacgtttatatgagttgctctttacttctacaaagaaattccaagctaactagagtattgtggtgttactaccagagggaaaagtataatttttaaaatcaatattcctgaaagaatttcctgtagtgcattaaattactttgttattgttagactttcacctaaatattttttggcagagtatttttgggtaactttctattgatataattttaagcttaacagaaacattggaagaatagtacaaggaactccggtatacactttacccacattcatccattgttaacattttgccccacgtatatttgctgtcgtcctccaatccctccttcttcccttcccctaccccatttttttcttgaaattttgagagtaagttggagacattctgatcctttaaaactgaatgcttcaatgtgaattccaaagaacaaagacattctcttacctaaacacaatatccttatcaaattcaggcaatttaatgtttgcacaatactattttctaatccacagtctgtgtattcaatgttgttgtttataccagttaatgttcattataggttttttccttccagaccaggatccagttgaggatcaaacattgcatttagttgtcgtgtctctggctcccttcaatctggaaaagttacttcatctttctttatctttcttaacttcagtgttttgatattttgccagttatttttgtagaatttccctccatgtggatttgtctgatgtttccctatgattcgattcaggttatgaatttttggtggaaataccaaagaagtgatgctgtctcctcatgtcaggagttatataatatattatatacctttcggtgatgctagttttcccttttccatatttctgactaccttctccaacagtgagaaacctgcaatctcggctcactgcaacctccgcctgcctcccaggttcaagcgattctcctgcctcagccccacaaatagctgggactacaggcacttgccaccatgcctggctaattttttgtatttttagtagagacagggtttcactccattggccaggctggtctctaactgctgacctcgtgatccgcccgcctcagcctcccaaagtgctgagattacaggcgtgagccaccgcatccagccgtatcctggatatatttactcacttgctgaagtctagaataatacaggaagtagtttcaaaattgctagcccatactactacagaaaataaacctagaaccttcagttcctatttgtgcatagttctttttttcctaggtaaaatttatatatggtgaaatgtatgaatcttaaaacaactccgtaagttttaacaaatgtatacacccatgtaacccacactcttcctatcaagatattagtgtttttccatcactccagaaagttcccaggtaccctttcccagtcaattctgggggaaggggaagtatgttgtatattatgactagtccttctctaaaaggagtaaagctaggcagcttcaggtgttctttgcaataataaccttgtttctggtacccagaagttgaccaaaaccttttttcagacctgcagagtcaggagcaggactgtgcaggaggagactgcgtgcagagtattcttgctcttgttgcacaattctattactcacaaccttcttgatagtgcaagaacagcctgttgtgaagaatcaggctccaaacttggtttgcataccatctgggacctgcgcagatgcagcaagatgtgcccagaaacctgatcttgagatttcagtgattagcaaccttaataatacactcattctggtgttgactatgcaataggttcttctgttgatgggttatgattaaactcctcaaagtgacttgctattagctttctgtgtgtatctgggcatatatcttgaagagtgatagggtaagggttaggtaggaataataaatgtcagctggtaaatcgtactttgttttggccttggttatagccagcctgtccatttatttttttgatattatataatcctacctaccttctatcatgttttcttgttacttatgaagcatgaaaggctaggcatggtggctcacacctgtaatcccagcactttgtgggggctgaggtgggcagatcacctgagcctaagagtttgagaccagcctgggtaacatggtgaaatcctgcctctacaaagaatacaaaaattggccaggtgtggtggcctatgcctgtagtcccagctacttggggggctgaggtgggaagatccttgagcccagaggttgagatcatgccatggcactatagcctgggcgacagagcaagactctgtcatgcccatgccccaaaacccccgccagaaagaagcatgaaataacaaaaagtcaacttagctgcttaaatagtgtttttgtttgtttgtttgtttgtttgtttgttttgggacggagtcttgctcacttgcgaggctggagtgcagtggcgtgatctcagctcattgcagcctccgcctcctgggttcaagtgattctcctgcctcagcctcctggggagctgggactacaggcgtgcgccaccacacccagctaatttttgtattttcagtagagacggggtttcaccatgttggccaggttggtctcaatctcttgaccttgtaatctgcccacctcgacctcccaaagtgctgggattacaggcgtgagccactgcgctcagccagctacttaaatgtttaagagaaacctctgtcccaaagcaacttgtcacctaaggactttgcaaatgcaccacttagaaaggcaaatcatagatttgaaaggaatggttaaactgttatctgttagcagacattcatttaattcaactgacatttgagtccctgctgtgtgccagagatacaaagatgattacaatagccactgtcttcaaggaacactgcctagagggtgagacagactcataagccaataatgatctgttcagttgtgaaatgccctacagcaaggtctgtcctcttgttacggcatcccaataccaattaattttgtaaatgtggaggactagggaaggccttgcagaggatgacttctgagttgatgttaaagggtcaagtaggagtttctagaaacacctaggggagagaacacaaggaattccaggcagtggagaattgcatgtataatagccagagacaacaaaacatggcagttatgaagttgtttagtagagcagttgtggctgagcctgggacacccaattttctacaaatcgtcctcttgtctttgtgagtgccgttttaattttggccatccttggagttggaatctggtatacgttgtctaatgcttaaagctgctgttttgaattttacaataacatgtaaaactcttgctcacctagcaccgagctttttagggagtttcctagcctaaggaatccagcagctgcagcagggtggtgtggagggcaggaagtcaggggatttccagggtcctggctctgcatcccttgctggactgccaagtgaccacaagcaaggtgctcccccactctgcccgccttcatttattttcttcagtgagtcagttgaatgagataagttctggctctctattgacactttattagcttttatattttatatttcctttatttcacaagcaatggatttttaattgcagaaaaatcagaaaatatatttaagaaagaaaataaccacgatccagccatttagatcactgttaattggtgatgtcaacacttcttgacttaaaatatatatgtatgtatataggtatacatagacatcatttttccctgaacattcctactataagggatttatggtactatattgaggatactccctgcttctcagatttgatagggttttaaatctcaatcatttacaaggactggccagagcccagtcggaagagctctctgcagcctgtgccaggaatctttgcatacagcttctcagtggcaaatattactcaaaactgggctgcagccagattttccttctcctttccaaaagggatataaatctctgatttggaaaatgatgagtaacccccaggttctcttttcctatctcatttacccagcaaggcctcaaatcttctattttaatgtatgatggattccatatgtatgattgtgtggtataaaatatatcccacatcttgtccttagcaactagtgttttctccaatctccagaactgcttggttcccaaaaggagatggaatatacagccagagctggtgaggagtatttagctacaagccttaacctcagaactcttggctcttcactgccttgaaaaaccttggacatttctccctttgcttctatttcctcatccatacagtggggaaaatattttctgtttcccagggaaattgcaatggctgacgtgtatccagttccctgtggccaagtaccaaggcctttgcccactcctgggactggtgttgacatcagaaataagaaaacaaagacccctgtgattgcattaggtctcctgagatacatgcagccttttctgggctcactgtccacacacaggtataatgggagggattgaatcagggatttgaaggccaaggctgccctggctttgaaaggctgcagaaaccttccgttcatgtctcttgacaatgacagccaaaaccttttccatgattccagagaacacggccttgcttgttacttttgacctgtggtttttaagactacctaattagtagttagaacttgtgatgattactcctttccctgtcacctgtggtcacaaacacatctagttttcccagacaaattttttcttacaggatcccttttgccactcagaccagaaagttgagggctgtgttctccttagatggttccattggcagcctggcccaagcatagtcttcagggtattgaaaaattgggttccttttagtttggaattaatctcattcacctctagtcttatccccaagcctattcttaaatttttttgagtcatggattgtgttcagactgatgaaagcagtcaccactgttccccttaaaaatgcaaagccagctgggcgtggtggcgcacacctgtaatcccagcactttgggaggctgaggcaggcggatcacgaggtcaggagattgagaccatcctggctaacacggtgaaacactgtctctactaaaaaggcaaaaaattagccaggcgtggtggcaggtacctgtagtcccagctactcaggaggctgaggcaggagaatggtgtgaacctgggaggcagagtttgcagtgaaccaagatcacgccactgcactccagcctgagtgacagagcaaaagaaaaaatgcaaagccacacagttttacagacaatttcagaggcttcatgaagtccctgaaacatctctgtggatcctagtaaagcaccattgctctatgagtgtttctttggtaccattcccaagctctcctagatgagacactaggatatgagagttgcaaccagtcccaccatggctgcccctatggctttgggaactgaccatctacctctggggactccttttcctcaactgtagtaaagggagatgcaggggctgatttaccactagtttttgtgtctctgagattgtgtagtctcttgatcaactatttcatttctttaggcccagctgtatccaactgggtgatggaggacggtactaactctcctcagagttcagacggttagttctccctctgctagcagggtgcattgacttgactcctgatgggcaaaggtccccaactagccactgctcatgttccttctttttttttttttttttaaggagtcttgctctgttgctcaggctggagtgcagtggcgctatctcagctcactgcaagctccgcctcccaggttcatgccattctcctgcctcagcgtcccaagtagctgggactacaggtgcctgccaccacgcctggctaattctttgtacttttagtagagacagggtttcaccgtgttagctaggatggtctggatctcctgacctcatgatccacccacctcggcctcccaaagtgctgggattacaggtgtgagccactgcgccaggccccttctttcttttttttattcatatagtacattcatcttcatcctcttgcctataccctcaataactttgtaagatagggagggaggaacatggacttgtaactgctacccagctgctgaaacaagggagccatcagctggaactgggaaagcttttatggacatatatggtcttacacacacaggctttatacaatgtatatatcactacttagagtattttaagtacctaaatataggcctggcatggtggttcacacctgtaatatcagcactgtgggaggctgaggggggcagatcacctgaggtcaggagttcaagaccagcctggccaacatggcgaaaccctgtctctactaaaaatacaaaaattagccacacttgtaatcccagctacttgggaggctgaggcagaagaatctttgaacccaggaggtggaggttgcagtgagtcgagatggtgccactgtgctccagcctggggaacagagagagaccctgtctcaaaaaaaaaaaaaaaaaaaaaaaaagatgtgaaagaactgtttgagaatgtcttattcctgaagttacccttatgacttgttcatataacatgttatactgtatttatgatagtgatatggatatgaacttaatcatagttttctagagtgtctgaccttctctagttttatataattctttcattatgaaagttttgttagtgctttttttttttttttttttaacacagaataagctacatggttctcttctctagaatatctaatgactggttaaatcacatagcaaagttagacatcttgaatttacagccatcatactaaaacgggaaaataccgcctgtgtgggccttaagctactgcaagtgtgccaaatgtgaacagtcagtgggagaatacacatgagcaagttttgcaaattagaggagtcttcttgacagtacacaagggtgtattcagcagagtcttgagtaaaggcagcatcattggaatatatgtgcagcctcccacgaggactactgtggagcatgtgttgaatcgtaatctgaactcacctgtcgtcataagtcttggcagctaaggtgtctttgtaattgactctggattcactgaagcatttggatattttaaagaactctattgaccttccaacttgggatagaaatccatgcaaaagcatatttttgtgttatgtgcgaaggcctgggaaaaatttggatttctcttagttctcagttgtactttgcattttcctttctttatatgtcagctcttccacaaaggaccttgaagggagagggtaacgaaagtggggattgaggcaagtggtaattactcattgttgtgttgaaacctcctacgtatcccaaatgtggaatgtgagctcaacatcgctctttcttaaagaagactatttattttgttgcctgagtaaaaccttccataaaattgctaataggcctatgtacaatattttcgttatttcagtttgacttgactgataaggaagattgattttaatcataaggcacacagattttttaaaaagtgagtgcaaaatgacttgctaatagactaatgtctgagtaagaaaacaaaaacatgtgtctcccagctctattggaggagcaagagtttcatttaacaatatctgctgtctttgcctaatcactcactagttgctatttttgataatattccaataggcgctgaaagtatacctggaaaatgagacctatgtcatcctatcccactcagcagaaggactgcagtcccaacaaatggaccctttcacagtgctccctggaggagactgtatgtttctgttgggctgtgctagtttgatctgttcttcttgggaaattgcttttactctcacagtattttcctcataatagcctcagcagtggtaactttttgacctttgtgggtgggtttgatttttttttttttccagaaagtaatttgaagctgtgtgttgtgaataaagagaatgagcaatttgcaggaaatttttaaaaaactgcaagttaaagtactgcaaggcttaaaatggcacatgggtgtgaacaaatgagaacgttagaagggaattcaaaagtatcctatcttttgagctaagagctggcaggacattttgatatgactagtgcagcagcagtgagcactggctttatctgctacccactaaccatgtgaccttgagcaagtatctcaaactttgagcttcagtttcctcaggtatgatgtagttgcagtaccatagccatgaagttggaataagagctcgtgtgatgggtgtcatgtagttggcactgtcagtgttttccgttgatcttttgtctgaacagagatcaggtgccgttcccatttcctttcctgaatatactcatttttgtcatttacagccataaaaaactttccatctttagaagttgacaaaaaaggaggggaacaaaaaagggcctggcctcaagatgtgagcaaatactaatgtgcaagtttttagattctttttctttttctttccttttcccttttcttttcatgacagctgtaaatctaggagcttaattattaacctaaatgaagctgaggtttaatgttccccggagcatgcactgatggggaaggatgaattctcatttcctggaggctgaagatctgtgcaggtgtctgtggccaatgttaagcctacgactttagatgagctggcataaatcttgggagagttttcttgtctgtgttccctctgaatttctctgtgctgttagaggcagggacagaagagaaccagcatggcagtgctgggctcagggtgatgcctgcctgccagcacagcggttcttgtccctgtcccacattgcttcttggaagcctttttacagcctcaatcatcttgctttttctaccgcagctataaatgggttggaagccagtgcaacatgggcagggaggacttggtttaatcttttcaagtgctacagcatttctctgttcctttggcatcgttttatggatgttttcccagtatccctttccagtgtcttatgaattggctagcaagagcgcttcccagtctatcagatggagagagcattaggctcagagaaattacatgaaagtccaggatttccaacttcttgttcacttttctaccatattaatcatctctcagacagtgatgtggtaggattcatatgcatagaattccattgtacttattggggggggggtaatttcactttaaatttttagcagcttcgaggacttaattggttaggctccttcaggctgtctttggaaatcttgtcctttgaaaagggaatgctgatacccagaggaatgtatttcttatggtcatgtttcagactgtagcatcttgaaagtcatgtgggctagagcaacttctaggtgtcctttagcacagatgcaggctgggggttgagagtttaaaagctttttctcaaactgtttatgacaaacatagttcatctcccattttggttaattctcagcttaagtattttaagaaacatttggagggcagggacatgcagctgctaagaatccaagacagtgctgttttgaaaatgcaaatatttctggtttgcatttacttgaagtagggtagctttctcccatatattcccttgaatacagatattctttaaatgacatcattttgagtagaatacagagtccaggtggttttggggaaatcattaaaaaaacaaacaaaaaaaacaaaacaaaacaaaaaaacaaaagcttaggtatcattgcattctaggggccaagaaacagaacgatggtatttttggcaggcacccaggcccagcaaaacccacaccccaaggctgtctctgtagcttcctgtggttttcccactgaagagaaacagcctttctcttggagggcctgggatggcaaatatgtatatcagcttgatcagaatcataatattccggctttgaggttatgtcccaacaggcttcatttaggaaatttgatgcaccacaattgttgcaaactgagctgaactgattttgtggctcctaatggtgcaagttttttgtttgtttggtagaaactggtaacgtcctatattagaagttatgctaccaggtgatctgtaacaataaagtcaagtctcagactaaattttgccacagataagaacattagcaagcaggcacaaaagttagtcattcagcatgttcctgtggactgggaaaagccccaacctgtcctttgggtatgtatctcacgtcaaagtttaggtagaaacagatgcagaaaaattctcaatacaggacacatctaaacttttcattggcgcaggtgatggaatcctctgttaagtgtccagacccaggaccagagtgccactgcagaaagtgttaggctgcctggtttgccagattcttataacccacgtatatatgcaaggttagagatccctgtacagtatttccagccaacacatatatatattgaattctattgttttcatcggaaaaattatttctaccatcctttatacttgtgaggaaatcctctagtatagatttcaaagctgtagctgatgcttttgtaatagccacacctggggtatgcactcctgattagggtacctcagatactaactagctacccataagaggaagggagggagggagggagaaagggtttgtgtgtcttcccacatacttgcatgcattcatactgtgtattcagaaatatttaaaaataaattacagataataggtatctctttatttgaccctggaaatattatgtcttgtataatgttgccagccattcatgagtgacttgaaatgtcaactgacctttggcctgccatggtgttttagtcagagccattgatgaatggctcaccatggggcagagaagagagaagagaatgataatttttgatagttttgtaggttttttttttcttttatctcagtctcattcggttgcccaggctggagtgcagaggtgcgatcttggctcactgcaacctccacctccaaggttcaagggattctcgtgcctcaccctcgcaagtagctgggaatactggtgcatgccaccacaccaggctaattgttgtatattttgtagagatagggattcgccatgttgcctaggctggtctcagactcctgagctcaagcagtcctcctcccttggcctcccaaagtgctgggattacaggcataagccaccatgcccggccagctttgtaggctttttcaagcttttttgcattctttcatttgatattctggtattgtggagatgttgtatcccccactcaattttatacacaaatcgttgtccagggtcatagaatgagtaaattacaggaactataacttgaacgaactctcatcctttatagttcctctgtactataagggcaagttactaccaagaagagctattactattcttcaaagaataccatagaactttttcaccttggggcagttattgccaaggtaagaccatgtactaaggatatattatataacagaatgctgggagatttctgtcttaactagtgataggacaggtgatttaaaccagctctcttactgaagtcaccttaagaaactggatcagttgcttctaaaaatcttcttaaacatcaaatcactattataaggagattctgagttgagctttgagagagaatgtaagcacagaggagcaaagccgtagtattagggcaattttttgttttatggccatttgctgatcaggaaaaggaagttgagagcgtgagccacacctttagtgtcctttcaaggtgaaggagataaaacttgtagtctgggtgctttcaagcctgagaacccttataaatcattcttgactttgggttggaactctatcaagagatacacctaggagtaagggtgaagtgggtgtaaaccatccctcacattggctgtaacaatttcacattatttaagtggcccggaaaccgtaaggcttccttgcattaagataattctatttagctaatgcccatagttgccaggtaaaagcaatgaaatcttagagggaaatatgatcctagtcctaaaattatttatatagataattttgctgttacaatatccagccacagaggtaaccaggcacacaagaagagaaggtaccataagtgagagttggcagaagcaaagacaaaagaaatacagacatacagagattctagatattgtacttattagacatacactatgaaatactattcttacagcattaaaggaagtaaaagcccaaattttagttgtattggggactggaaactctaaaatacggctttccagatttaaaaaactgaaatctagaactgaaaattcaaaaacaaaatgaataggtgtataggcaattatatacatctaaagagcaaattagtgaaatggaaaataggttagaagaaacttcagagtgaagcactgtatacacaaagatggaaaatataaaaaaggtagaagatagagtgagaaagtctaacagtcataattggaaatctagaaaaaaagaaataatggttctatagcaacattgaatgggattatagataaactttttttgaaacaaatgaaaaacctgaagcctcaaatccaagaagcccaacaaatttataacagtacaaataaaactaaatccacaccaagacccatcataatcaaacttcagaaaatggaatataaagacatcttaaaagcagtgggggatggggaaaagacattaacttctgaagaatgatggtcaggcttacagttgacttgcagagtgtgagccacatgacaatggaaataacttctttagtgtgctgaaggaaagaaacgcatcccacaattttaaacccagcagataataccgttcaagaatgaaagggctgggtgcagtggctcacgcctgtaatcccagcactttgggaggccgaagcgggcagatcacgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgtgaaccgaggaggcggagctcgcagtgagcggaggtcacaccactatactccagcctgggcgacagagcgagactctgtctcaaaaaaaaaaaaaaaaaaaaaaaaaaggtagggggggaagagtaaaagtgaaggtattaaaggtattttgtatagacaagaacagagtccaccactagcatgtttacacaaaaggacttttattgggtcttctccaaataggaggaaggtgatccaaaacgttaaatcagaagtataggaaaaaaaaaaaagtatagaaagtggttaaagatggggataactctaggccaggcacagtggctcatgcctgtaatcccagcacttttggaggctgaggcaagcgcatcacttgaggtcaagaatttgagaccaggcttgccaacacagtgaaaccccatctttactaaaaatacaaaaattagccagacgcatgcctgtagttccagctacttcagggggttgaggtgagaggattgcttgagcccagaagtttgaggctgtagtgagctatgattgtgccctgtaccccagcctgagcaacagagcgagactgtcccaaaagaaaaaaaaatgtgggtaactctaaatgaacatttgaacatttactgtataagaaaatacaatattgagtgggatattttttaaaaatagaaatttaaggccgaggtgggcggatcactcgaagtcaggagtttgagaccagcctggccaacatagtgaaaccccacctctacaaaaaatacaaactaaagtttagccgggcatggtggcagacacctgtaattccagctactcaggaggctgaagcaggagaatcacttgaacctgagaggtgaaagttgcagtgagccgagatggcgccaccgcactccagcctgggctacagagcaagactctgtctccaaaaaaaaaaaaaaagaaaagaaaagaaaagtattaaaacttggaggaggtaggtgattggaattagtctgttctaaggttcttgcattgtcttggaagaggttaaagataggaattaatgcttgactgagataagtcaaggatatatgttataactgatagactaaacagtaaacaaatagaaaaattgtataacttctgattaaaaatgaaaaaattgaaaaagatgatttaaaggaagaaaaaaacaagtacaagatacaaagcacaagaagtcatggtaaactgaaacccacatgtatcagtaattacattaaacataattggttaaatgctggcggtagaaagattatcaaaccagatttttaaatttatatgcattatacaagcaatatatcttaaacttacagaatgactgaaaataagatataagaacataatattttagtattgaattttcaaaaatcagttgaaaataaacttaaataccacaagaaagctgctgtagctatattagtatcagacaaaacagattttaaggcaaaaagcattaatttgtaatacaattactttataataattggttttaattcaccaggtagaatttctaaatttgtatgtatttaataacatgtctataaaatatataaaaaatttacaagaactaccagaaataaatgatttttcccccctaagatggagtcttgctctgtcacccaggctggagtgcagtggtacgatcttgggtcactgtagcctccatctcccaggttcaaatgattctcctgcctcagcctccgagtaactgggactacaggcacatgccatcttgcctggctaatttttgtatttttagtagagatggggtttcaccatgttgcccaggctgatctcgaactcctgacctcaagtgatccgcccacctcggcctcccagagtgctgggattacaggcgtgcacccacgcccagcccggaaataaatgatttataatcacaagtagaaaattttaatgaatcggctgggcgcggtggctcacacctgtaatcccggcactctgggagcctgaggtgggcggatcacctgaggtcaggagtttgagatcagcctggccagcatggtgaaaccacatctctactaaaaaatacaaaaattagctgagcatggtggcacatgcctgtagtcccagctacttgggaggctaaggcaggagaattgctggaacctgggaggtggtggttgaagtgagtcgagatcacaccactgcactccagcctgggggacagagcaagactctgtctccaaaaaaaaaaaaggaaaattttaatgaattattctcagtaattgatgaaaaaaggataccaaaagaaatcgggaagggttattgaacttggttaacatgattaataagcatattctagtgaatacatatagaatactgcacctaactgaaatatagaatactgcacctaatttgaaaagaaatacatattcttttcaagcacacacataatattttacaagaatttgctggcatagacgggataattaaacaagtttcaacgaatttcagagtgaaattgtatagatgtatactgattccactgtaattatgcaagaaatcagtaataaacagataactagaaaatcatccccatgtgtttggaaattcagatacatacttataaaactcattaattaaggatgacataatggaaattaagaactattttaactgaatgattaaaaaaattataccaaaatttgtaggatatggagaaagcagtacttaataaaaatgtggctcatgcctgtaatctcagcactttggggggtcaaggcaggaggatggcttgaagccaagagtttgagaccagcctgtgcaacatagcaagaccccgtctctacagaaaattaaaaaattgccaggtgttatggcacatgcctgtagtcctagctacttggaggctgagataggaggattgcttaagcccgggagtttgagcttatagtgagctctgatcatgccactgcactccagtgtaggtgacagagtgagtttgagcccttgctaagaaaagccttaaaacaggcccgaaattaatgagcaaatatttgtatcaagaagtcagtaaaagcaacacaataaatgcaaacaagtagaaggtagaaattattacagagaagaacagaaagacctgtaaaattgctaaacctatggtgaggctgagcaaaaggaagattaacatgtatcttagcattgaatttttaaaaatcagatgcaggctgggcgcagtggctcacgcctgtaatcccagcacttggggaggctgagataggcggatcacttaaggccaggcattcaagaccagcctggccaacatggtgaaactccatttctactaaaaattaaaaaattagctaggtatggtggcctgtacatatagtcccagctactcaggaggctgaggcaggagaatcgcttgagccccagaggcagaggttgcagtgagctgagatggtgccactctactccagcctgggcaaaagagtgagacactgtctcaaaaaatagaaaaatataaatcggatggaaaagaataaatttatagttcaatgttaaaaaacaaaatgaagtgatattattaaggaggcaggcagatttaggtgaaaaattatgaggaaaagtagagaaattattatataagtcgctggttttaagaggtaagtaaggagttgtaatgtagaagtggcctacctttccttccttcctttcctccctcccttccttccttccttctttccttccttttttgacagtctcactctatcgcccaggctagagtgcagtgacacaatctcggctcactgcaacctccacttcccgggctcagacgattctcctgcctcagcctcccgagtagccgggattataggcataagccaccatgcccagctaattttttatttttagtagagacagagcttcaccatgttggtcaggctggtcttgaactcctgacctcaggtaatctgcccacctcggcctcccaaagtgctgggattacacgtgagccacagtgcctggcgtggaagcgactttgtagggacttcggatgtaatgtgttgatgttcttgactgggttgtagttacacagatggtcactctacactatgtatagagtataatgtagcctatagactatattttacatttctgttacttcacaatgaaaaatgttaagaaaataaataggtgttctgcatgtatgcttctgctggcatgcccatcatttacactgttctttatgccagacaggaaggttcacaacctgacactgtgtctttcagagaatgctcatcccagcttgaaggctcttaacacaagaatttccaattagtagaggtaacctgctggtagatcatataactcatcaaccttaggctgtaagagactgagtccaatgtaagttttcaataatttacccacccacaccatacttaatttaagccagggtatatgaacttcctgaaactgaaactgttccctcttatgctgagtacccagataataggggtaggccaataaatcaatgagcagagaaggactagcttgaagacaacagaaaataaatagggactgtggccaactagagctcaagttctctccgtggagcagctgcaacccaactctggatgattgttacttgcagactactgggaataacgttgccatattttctgattttttttccttcgaagagtagatagaaatgtgaattttaatgtgcaagtacctgatttttaagtgttggttcacaccgcaccccccaccccaaaatactgcttgagtcaaaccaaacctgtacctgggatatgtccagttagtttatgagaataacctcaacagccatgcagattggagagagagaataatgtataaaataatgtactataaccttcttgatggaacttgcctgcgaagcatgttcttatataattctcaacttcaaaattaaaagaaactcaaccaaaattcatacattacaaacgtcactcagggtaataattttcttagtgaaacctggctctctctgcaggggaatgaatttttttaccgtaagtaatttattaaagggattgagtaaaactgctaaatagtgatatcacgcaaagcaatttcttttaggagaaatagctaaagatggactttaaaaatgtgctgcttaatgggttgaatcccaagatgttgtgctcctgtttagatgtagcaggcattttcaaagtggtccgagcaccagcagcatcagtgccatttgggaacttgctagaaataaaaactctcagaccccgccccagacctaattaatcagaaactgtggggttgggcccagctacttctgttttaacaagccttcctggggattctgaagcatgctcaagttttgataaaccactgctatagcttttgtgctttgtgactttttttgtagaatgactttagaaagttaaactttgttattttaaggtttcaagtgaatattttcttcaatgttgacatcttccaagtatccttcaaataatatctttggtttggcttatgtcagtcaagtatgtgttggtttaaaaagatgaccgagaatagaaagttgtatcttctaaaaattcattttaaagtgagattcgtatataacagcagacacaattttatcctctttctgcctttcttatccactacactcatggtatccactcacagcctcactaaggaagtcagtccacttcatgctcagcttttaacttaggggttttttaaatgtatgcatagcatgtatcatgcacagaatgccatagaatccttctctgacccctccttctgttttataagccattctgtgcataaggccacagtgacttcacactggactctggttctgcctcctactaaatggcagagtccaggagggtcccacaacctgtgtactccaggcctacagactataagctctaagtaatggatgctcagcaaatattttttctttgctctagggtctcaactctcagcaggattaatagctgtttaacctacggtgatccttttattagtttgttacagtaagaaatgcatgttttaattggattggaagccttgaaccttttcttaaataataaacatttttatgttgaggtaaaacttaaaaacagtaagtacacagatgttaagtgtacaacttggtgggttttttttcacatgtaaatacccatgcaactgagacaggaataataacagggtggtcgcaggagaatagaaaattccaggcagcagtttcacatgactagcaaaaggaaactgttgaaatagctgcatagactgggcgtggttgctcacacctgtaatctcagcatttgggaggccaaggcaggcagatcacttgaggtcagaagttcgaaaccagcctagccaacatggtgaaacccggtttctactagaaatacaaaaattagctggggtgtagtggcaggcgcctgtaatcccagctactcagaaggctgaggtgggaggattgcttgaatccaggaggcagaggttgcagtgagccaagattgtgccattgcactccagcctgggcaatagagtgagactccgtctcaaaaaataaattaaaaaaagaaatactggataagctaggggctgataagaccctgaaaaaccagggtgtgaaccaagctggctaagaatgactgcacccaacatggctgtggatttgacctaggtttcacctagaacctccttatacattcattaacatatcacacatgcaccagccccgtgaaagtcaaggccagcctgggcaacatagtgaaaccccagctccaaaaatataaaatcacagaatagaaggaaaatcaactgtcagatgctgctgagagactgaatgaggattataaatggcaagatacaggtcttcagtggtctttttatattaatataacacattttttaacaatttttttaatggagtcagggtctcatagccaccacacccagtttatttaacaatcgacgtcaacaattacctggttacatagacttaccagattaatttatcaatttagcagttaatcaaattagatttctcctgttttaaaaatattgaatataaatttcaatgcttttaaagtcttaattaaaaccaggaatctattctcttaaatgcttaaagtacattaagacatatcaaacaaacactttgctgtagtgattacaacgttgaatagtacactaacataccatttataaatatgttgatgctatggatctaaatttgtgtttcttaaagatattcaagagctttattgagatacaatttacataccagaaaatccacccattgtaagactagagtctgataattcgtagtaaatgtaaactgacgtgcacctatcaatctgaggaagtcttgacaagagtcttttggagtgcggagaggaagtcctcattggagtaagttaaagagagaatggagaataatatagatgtttcaagggttttcttttttttttttaatctcttaagggtattgggggaaggtagtaaggagaaggagattaagagggattatgtctaaaatggtaattgtttcatcttgtttgtgttcagagaaaatctggagggatagcttgtctgattccttctgtttagataataaaggatgaaaagacatcatttaagaaatggaaactagcaaatgtaaacttttatgtagtttttaaggttttttcttctggtgagttacttgcatttcattgggagaaaaatcttcctttaaatgttattgataatcaattattaagtaggtgaagcagtctggttcctttttcctcacattgctttagaaattaatacgaatgctaatgaaaaggcaaggaatataaaaaccaacaacatattaatgaccctgaggtcgaagtatgaatatcacaagggcaaaaatagttctacacattgggcatttcagtggatattggttactccttgacaaaagatggcactccttatgcagaaacacgctggatttcccaaagaagcgtataaactagagcaggttctcttaaatctttgaatgaatgcactgagttagttttggctgttactgctcttggaatgtctttttgtttgcatttttccaatttacctccttgttgacatatcaatatttaaaagaaatctcccccccagatttttgacctacaatagtataatctcaaatattggattaattggtcagagcatccatttaaacattttgatttttataatgtcctgcttattaaccagctcaatttttttttttttttttttttttttgcggtagagtcttgctctgtcgcccagaccggagtgcagtggtgcgatcttctcggctcactgcaacctccatctcccgggttcaagtgattgtcctgcctcagcctcccgagtagctgggattacaggtgctcgccaccatgcccgactaatttttttatttttagtagagatggcgtttcaccatattggccaggctggtcatgaactcctgacttcaagtgatctgccctggttggcctcccaaagtgctgggatacgggcatgagccaccatggccggctccagctcaaatttttttaaccagccttcaatgctcagccaagccattaatacctctgccttgccttttatctcctgcttgcattcttaaggtcagctagactgagtttagggccttctcagatcttccctgagcaggtgtgtggttttgggcatgtacctagccttgtgcctgtgccatgttgtattagtctttctcatgctgctcataaagacatacctgagactgggtaatttataagggaaagaggtttaatggacttacagttccacatggctgaggaggcctcacaatcatggtggaaagcaaaagggaagcaaaggcacatcttatgtggcagcagacaagggcttgtggaggggaactccctttataaaaccatcagatctcgtgagacttattcactatcatgagaacggcatgagaaagacccgcccccatgattcagttacctcctattgggtccctcccacaacacatgggaattatgggagctacaattcaagatgagatttgggtggggacacagccaaatcatatcacatattttctagattcttaagaatatgcttcagcttttcaaagcctcctttagtattttccagattttttaaagctttttgttggcttattgttacttcagctgttacataccaagtcaggagatcatgatgttaaacagttgcctctgatagttttcaacagttggccctggaaaaaaggctgggtgaattctgaatcaggtcaaatgaggacattttgtcagtggatcttcctgacaccatacaggtgacattttctaaaaatgaagatttatagaagctctgactctaaactccacccccacccccttgcccccactgactattgggctgccggttttcactgtgattatgtgttactgatgttcaaggctactatggagcttgagggggtgaggcgatgagaataggagaagttgaaatgccaaaaagcttattgttttaccaagattcagtttttcttgaatacacagccccagattttgtcagccttctctttccccttatagaaaggattttcagaggttcttactccactatttttgctgacattgctatgtgtcatcttgtcatgtattttctgtgtttatcaagccctatttggcaataattatattttacaagtagtaagtatgtagcatttctttttttttattatttttatttttgagacaggatctctcactctgtcgtccaggctggagtgcagtgttgtgatcatggctcagtgcagcctcaacttcccaggctcaggtgattctcccacttcagcctcccaagtagctgggactacaaatgcatgtcaccacgcctggataattttttgtagagatggggtttcgctgtgtttcccaggctggtcctaaacttctgggcttaagacatccaccgccttggcctcccaaagtgctaggattataggcatgatgcctgtaatcccactgcacctggccatgtgtagcatttctctttccttcctttccttttcttccttccttccttgcttttttttgtttttgtttttgttttttgtagatggaatctcactctgttacccaggctggagtgtagtggcatgatcccggctcactgcaacctctgcctcccaggctcaagcgatcctctcacctcagtctcccaagtggctgggactataggcgcacatccccacgcctggctaatttttgtatttttggtagaaatggggtttcatcatattgccaaggctggtctctaactcctggactcaagtgatctgcccaccccagcctctcaaagtgctgggatcacaggcatgagccaccatacccagcccatatgtagcatttctattgccatgtttttttgagacagtttcttgccccatcacccaggctggagggcagtggtgcagtcatggctcactgaagcctccaattcctggattaagtgattctcctgcctcagtcccccaccaagttactgagattacaagcacctgctactgtgcccagttaacttaaaaaaaaaatttgtagagatgacatcttgctatattgcccaggctggccttgaactcatggcttcaagcagtcctcttgcctcggcctctgtattagtccattttcatgctgctgataaagatatacccaagactgggcagtttacaaaagaaggaggtttatcagacttacagttccacatggctggggaggcctcacaatcctggtggaaggtaaggaggagcaagtcacatcttacgtggatggcagcaggaaaacagagcttgtgcagagaaactcccattcttaaaaccatcagatctcataagacccattaaccatcaccagagcagcatgggaaagacccacccccatgattcaatcatctcccactgggtccctcccataacatatgggaattatgggagccacaagatgagatttggttggggacacagagccaaaccatatcattctggccccgtccctctcaaatttcgtatcttcacatttcaaaaccaatcatgtcttcccaacagtcccccaaagtctcaactaatttcagcattaacgcagtagtccaaagtctcttctgagacaaggcaagtcccttctgcctatgagcctatataaatcaaaagcaagttagttacttcctagatataatgggggtacaggcattgggtacatacagccattccaaattggagaaattgaccaaaacaaaggagctcaggctccatacaagtctgaaatccagtgaggcagtcaaatcttaaagctccaaaatgatctcctttgactccgtgtctcacatccaggtcatgctgatgcaagaggtgggaaggcatgattggttcccatggtcttgggcagctctgcccctgtggctttgcagggtgcagcctccctcctggctgctttcacagactggcgttgagtgtctggctcttccaggcacacagcacagttgtcagtggatctatcattctgaggtctagaggacagtggccctcttctcacagcttcactaggcagtgccccagtaggaactctgtgtgggggctctcaccccacattttccttccacactgccctagcagaggttctccatgaggaccccacccctacagcaaacttcagcctgggcatccaggtgtttccatacatcttctgaaatctaggcataggttcccaaacctcaattcttgacttctgtgtacttgcaggctcaaaaccacgtggaagctgtcaagtcttggggcttgcattctctgaagccatggcatgaactctgtgttggcccctttcagccacagctggagtgtctgggatgcagggcaccaagtccttaggctgtacacagcacagggaccctgggctcagcccttgaaaccattttttcctcctaggcttcagggcctgtagtgggaggggctgccacaaagttctctgacatgccctggaggcattttccccattgtcttggtgattaacattttggctcctagttacttaagcaaacttctgcagctggcttgaatttctcctcagaaaatgggattttcttttctattgcattgtcaggctgcaaactttctaaacttttatgctctgtttcccttttgaaactgaatgcctttgacagaacccaagttacctcttgaatgctttgctgcttagaaatttcttctgccagatactctaaatcatctctcaagttcaaagttccacaaatctctagggcaggacaaaatgacaccagtctctttgctaaaacatagcaaaagccacctttgttccagttcccaacaagttcctcatctccatttgagaccaccttagcctggaccttgtttatatcactatcagcatttttgtcaaagccattcagcaagtctctaggaagttccaaactttcccacattttgctgtcttcttctgagccctccaaactgttccaacctctgcctgttacccagttccatatttgcttccacattttgggtatcttttcagcaacaccccattcctggtaccagattactggattagtacatttttatgctgttgataaagacatacccgagactgggcaatttacaaaattaagaggtttattggacttacagttccacatggttggggaggccttacaatcctggtggaaggtaaggaggagcaagtcacatcttacatggatggcagcgggcaaagagagagcttgtacaggggaacgcctcgttaaaactgccatatcttgtgtgacccattaactatcatgagaacagcatgggaaagacccacccccatgattcagtagtctcccactgggtccttcccataacacattggaattatgggagctgcaagatgagatttgggtggggacacagcaaatccatattagtctcccaaaatgctgggattacaggtgtgagccatcttgctggccagagcatcttttcatatgcttacttgtatatcttctttggtgaggtatctgttaagatctttggctcattttttaattgggttgtttgtatttttattgttgtgttctaagagttcttcatgtattttggataatagtcctttattaaatgtgtcttttgtaaatagtttctcgtggcctgcagctggtcttttcatccttctgatagtttctttttcagagcagaaatgtttaattttaataaagtctagcctaccagttacagatggtccttgacttataatagtttgacttacaatttttcaatttaccatggtgtgagagtaataggcattcattagaaacatatttcaaattgtgaattttgatattttcccaggctagtgatgtagtatgatattctcttgagatgccatgcagtggcagcaagctgcagctccactcaaccacacgatcgtgagggtaaacaactattgactagtactctatgttgcactgtgttgccagacgatcttgcccaactgcaggctgacataaatgttctgaacacgtttaagggaggctagggtaggctcagctatgatgttcagtagttaggtgtaataaatgcattttatatttagggtgttttcaacttatagttggtgtatacccccatcataagttgatgagcatctgtttttctttcatagatcatgcctttggtgttgtatctaaaaagacattgccaaacccagagtcatctagattttctcccatgttatcccataggaggtttatagttttgtgttttatatgtaggtaggtctgtgatacattttgagttattttttgtgatggggtgtaaggtgtgtgtctagattcttttttttttttttccatgtggttgtccagttgctacagcacgatttgttgaacagattatcttttctgcattgtgttgcctttgccccattgtcaaagatcagttgactaaggtgggtctaattctgggctttctattctgttctgtgatatatttttttattctttcaccaaccacactgtcttgctgactgtagctgtacagttggtctagaagttaggtagtgtcaatcctccaactttgtcctttaatattatgttggcttatctgggtcttttgcctccctacaaaaactttacaatcagcttgttttatatctacacaatacattgctgtgattttgatgtgattgcattgactctataggtcaaattgggaaaaacttgacatctcgacatattaagtcctcctatccatgaacaagaaatatcactttatttttagattgtctccaacttctctcagcagtagttctccatatgtacatcttgtacacattttgttagatttgtacctaggtatttttgggtgttgctaatgtgaatgatattgtatttttttttaaattaaaatttgatagtatttgaacatcaattcagaaatttgtcttgttgacaaatgtactttattcatagatttttctttcaattttttatgtgatagaatacatataaaatttgccattctgtttttaaatgtacagctcagtggtattaaattccttcataatattggcagttatcaccaccacttaccttcacaattcttttcttttatagaactgaaactctataaccatcaaacaataactccccattttcttctctctccagccctgccagccacttttctaagtccctcataagtagagtcatacattatttgtctttttgtgattggcttattccatttagtataatgctctcaaagttactccatggtgtagcatgtgtcagaatttccttcctctttaaggttgaataatatttcattgtatgtagcatatactacattttgtttatccattcatccatggatggacacttggattgcatccacattttagctattgtgaataatgctgttatgtacatgagtgtacaactatttcttcagttccctgcttttaattcttttgggtgtatagccagaattgaattgctggattcttttgggtatatatccagaattgaattgctggatctaataattctcttttaatttttttaagtaactgccatgctattttttatggtggctgcagcatgttacattccaatcagcaatgtagaagtctttttttatcgtcacatgctcatcaacacttgttatttttctttttcgttgtaaaatagtagccattctaatgtatgtgaggtggggtctcactgttttacttgcagttctctaattatcagtgatgttgagcatcttttcgtgtgcttattggccatttgtatatctttagagaaatgtctgttcacatcatctgcccatttttaaacttggttgtttgttgttgagttttagaattacctgtatgttctgtatattaatttcttatcagggctgggcacggtggctcatgcctgtaatcccagcactttgggagcccaaggtgggcggatcatgaggtcaagagatggagaccatcctggccaacatggtgaaaccccgtctctaaaaatacaaaaattagccaggcatggtggtgtgtgcctgagtctcagctactcaggagcctgaggcaggagactcacttgaacctgggaggtggaggttgcagtgagccgagatcacgccactgcactccagcctggtgacacagcaagactctgtctccaaaaaaaaaaaaaaaaaaaaaaaaaaaaattcttatcagatatgattttcagattattttgtcccattccagaagttgcctttttactctgttgatgttgtccatctatgaaattcagtctattttttttgtttcctgtgcctttgatgtcatatttaagaaatcattgctaaatccattgttgtgcagcttttgccctgtgttttcttctaaaagttttatagttttaggtcttccatttaggtctttgatctattttgagttaattttttaatatggtgttaggtgagagtccaatttccttcttttgcctgtggatatccagttttcccagtatcattcattcaaaagactgtcctttttttttttactgaaacaccagggtattctgtctaggtcctgctgctgcttggtgcacagaaagccaatcactgagacaagtgtggccaagaaacaaggctttaaatctggtgctgcagccaaggagataggagctcagtctcaaatccatctccctgactgactaaaactagggctttatatagcagggaggaaacataacaatatgtaagaaaataaaaactagagaggggtaaggaagcatctggtgctgtgatctgatgagttccagttatttgattctttttttttttttttttagtaggcctgaaggtcctttcctgagggaaggaactcagataaaacaaatatgagtttcaagctttaacagcagaagggtcaatttccatgtttatccaaaaacaactatctgtgggactcttgggttggtttcacttttttttgttggatgatcttggcactcttgtcaaaaattgagactgtatctgtgaggattgtttctgcgctctctattctgtttcgttggtctatgaatatgtcttgtctttatgcggtactatgctgaactttgtagctttgtactatagtaaatttgattactgtagctttgtagtaagtttggaaatcaggaagtgtgagtcctccagctttgctcctcttcttcaagattgttttggcaattaagtgtctcttaagattacatatgaattttaggatggctttttttttatttctgcaaaaaacaccgttggatttgtatagagatcacaatgaatctgtagatttccttgggtaggatcttaacaatactaattcttccaattcatgaatatggggtgtgtttccatttatttatgatggggtgtatttccatttatttatgatgtctttaatttcagcattgttttataatttttattgtataagtctttcacctgaagttaattcctaagtattatattctttttgatgctattgtaaataaacttatagtttctttttttagattgttcattattagtgcatagaaacgtaactggtttttatgttaactttgtatcctgctgctttgctgaattcagtttttgtagactgtagggttttgtacatgtaaaatcatatcatttgcaagcagaaatcgttttacttcttccttttcaatttggatgccttttatttattttccttgactgatttctctggctagaacttctagtactgtgttgaatagaagtggtgaaattaggcatccttgcctttttcctgatcttagagagaaagcgttccttctttcatcactgtgtatatttgctgtgggttttgttgcatatggcttttattatgttgaggcagtttccttctattcctagtttaagtgtttttatcatgaaaggggttgaattttgtcaaatgctttttctgcatcaatcgagatgattgtgtggcttcccccccgccccactttcttcagtttatatggtgtgttacattggtttttcgtccttgcattccaggaataaatctcacttggtcatgttgtataatccttttaatataagatataatctaatatgtagaaaactgtaaagatgtcacacaaaaaactgacttaataaatgaattcagcaaagtagcagaatgcaaagtcaacacagtttactgttatttcattgaggatttttgcattaatttataagtggtattagtccatggttttctcatagtgcctttgtctagctttggtgtcaggctactgctggcctcatagaatgacttaggaagtgttccatctttaattctttagaaaagtttgaaaagcagtggtactagttctttaaatgtttgatagaactcaccagtggaaccatcaggtgcagggcttttgtttgccaggagatttctgattactgattcaatctccttattggttataggtctattcagattttccatttccttgtgatttcattctgatgggttttgtgtttctaggaatttgtctgtttcatctaggttatggtattaggtttgtaatttcaaattccacttgttcattgctggtatactggaaaataatggagttttttgttttgttttgttttgtttttgacatggagtcttgctcttgttgcccaggctggagtgccatcttggctcactgtaacctccacctcctcccaggttcaagtgattttcctgcttcagcttcctgagtagctgggattccaggtgcacaccaccacacctagctaatttttaaatttttagtagagatggagtttcatcttgttggccaggctggtctcaaagtcctgacttcaggtcatccacccacctcggcctcccacagtactgggattacaggcatgagccaccgtgcccagcctagtcttatttattgactatgtatcctgcaccctatgtatcctgcagtgttgctgtgattgcgtgttagttccaacagtgtttttatttatttggattttctacgtgggcaggcatgtcatctatgaacagacagttttatttcttccttcccaatcagaataccctttatttctttttcttgtcttatttcattagctaggccttctattatgatgttgaaaaggagtggtaaggggattttcttgccttgttcctgttttcttgccttcttgccttcatggagaaacttctggtttttcatccaccattagttaaattcttagatgtagagattttgtggatgttctttatcaagttgaagtttccctctgttcctagtttactgagagtttttgtcataaatgactgttcaattttgtaaaatgttctttctgcacctattgatatgatgtgattttcttcttttgcctatggatgtgatggtttatattgattttcaaatgttgaaccaggcttgtgcacctgggataaatcctacatgatcgtggcatataattctttttatatacagtcatgtgttgctaaacgatggggataccttctgagaaatgtgtttggtgatttcattgttgtatgaatatcgtaaagtgtccttatacaaaccgtgacagcataagcctactgcacacctaggctatatggcatagcttgttgctcctaggctgcaagcctgtacagtatgtaactgtaatgaacactgtagacaactataacacaacggtaagtacttgtgtatctcaatgtatctcaatatagaaaaagtacagtaaaagtatggtataaaagatttttttaaaatggtacacctgtgcagaatacttaccataaatggagtttgtagggctggaagttgctctgggtgagtcagtagtgagtgactgtgaaggtctaggacattttgtacaccactgtagccttgaaaaacaacactaaacttaaaaaatatttttctgtcttcagtaataaattacctttagcttactgtaacctttttcactttataaatgttttgattaaaaactttttttactcttttgtaacaacacctagcttaaaacacaaattgtacagccatacaaaaacattttttctttatacccttatcctatacattttttcctttaaaaatttttattttattatttaaacatttttgttaaaaactaagacacaacatacacattagcctacgcctactcagggtcaggatcatcagtatcactgccttccacctctacatcgtgacccactggaaggtcttcaggggcaataacatgcatagagctgtcatctcttatgatagcaatgccttcttctggaatgcagttaacttttttttttttttttaaataagtagagggattacactttgctaaaataatgctaacatgtatagtatagtaaatatataaacataacatagttgattatcaagtattatgtactatatataattgtacgtggtacacttttatgctacgggcagcacagtagtttatttacaccagcatcaccacaaacatggaagtaatgttgttgcactatgacattgtgatggctacagcttcactagggattaggaatttttcggctccattataatctgtgggaccacccattgtatatgcagttcctccttgactgaaatgtcatgtggtgcattactgtatcattggattcgatttgctaatattttaagattcttacatctatgttcatgagatatattggtctgtagttttctagtaatgtctttatctggctttggtattagggtgatgctggccttatagaatgaattaggaagtattccctttgcttctgtcttctgaaagagattgtagatgattggtataatctctttcttaaatgtttggcagaattcccccagtgagcccatctgggcctggtgctttctatttgggaaggttattaattattgattcaatttattttatagaaataggcctgtttagaatttccatttttttcttatttgagttttggtggattctgtctttaaataattggttcaattcatttagtttatcaaatttctagatacggagttgttgatagtattcttttattatccttttcatcaatacagatctcatagacatgaaaaggataataaaggaatactatcactaaaaagtgattctctctttttatcttagtctaattggaggcttatcaatttaccttgtcaaagaactagcttttggttttattgattgtttgtttctccattgattttctgttttcagtgtcattgatttctcctctagtttttattctcttttcttctgcttactgtggatttaatttgctgctcttgttacctaaggtgtaagatcagatgattgattttaggtctttcttcttttctaatatattatttcagtgatacagatttctgtctctaagcatttctttccctgcatctcatgaattttgatacattgtgttttcatttctatttagtttaaatattttaaatttatcttgagattttttattcatgtgttattgttcaaccttacatatattgagatattccaattatctttctgttgtgaatttctgggttccattgtggtctgagagcagactctttatgatttcttttcttttaaatttgttaaagtatgttttatggcccagaatgttctaccttggtgaatattccatgtgaatgtgagaagaatgtgtattctgtggttgttggatgaaagagagaggtgaattctatccagttgattaataaatagtgttttgagttcaagtgcgtcctttttaaccttctgtctgctggatctttctacttctgatagagcagtattgaagtctacagctacaaaagtagattcgtctatttcttcttgccgtactgttagtttttacctcatgtattttgatgcactgttgttaagtacatacgcattaagaactgtgtcttactggagaattgagccctttattattatgtaatgcccttctttatctaataacattatttgctttgaagtctgttctatctgaaattaattcagatacttctacttacttttcattagtgttagcatggcgtatttttttccatctacgtttaatgaataaatgtctttatttaaattgattttcttttagataccatataattgggttttatttcttgttccattataataatctgccttttaattggtacattcagatcactgattattgatataattggattaatatctgccatatttgtaactattttccatttgtcacctttgttcttttttgctatatttgtcttctagtcctttttcttgccttttgtggtttaccagcatttaaaaaattattattattattattttattttattttattttttttttttttgagacagagtcttgctctatcacccaggctggagtgcagtggtgcatcttggctcactgaaagctctgccttctgggttcacgccattctgcctcagcctcccgagtagctgggactacaggcacccaccaccattcttggctgattttttgtattttttttagtagagacgggggtttcactgtgttagccaggatggtctcgatctcctaacctcgttatccacccgcctcggcctcccaaagtgctgggattacaggcatgagccacagcgcctggcctgtatattttttaaggtagggtctcactctgttgtccaggctggagtgcaatcgtgcgatctcagctcactgcagcctcaacctcccgggtttaagccatcctcccaccatagtctcccaagtagctgggactacaggcatatgtcaccatacctggctatttttttttttttttatattttgtagagacctggtctacaaaatgttgcccaggctggccttgaactcctggactcaagtgatcctcctatctcagctcccccaaagtgctggggttacaggtgtgagccactgtccccaaccaacatatttcaatatggcttcttttatctccctttgctggaagcaaaagagatttttctcgagtatttactgagagaacctggtttagctcctgtaagtaaaactcacaaaagcatgggggcctccctataactaggtccccctggagtttttatcactggggcttgtccacacctagcaatttttgtcagctacagtttgtttttctgcccctctcccagtttctgtggaggtttctgctccagcctgttgtgattctctgtatccacctgactgtctctccagttctgggagcagtggtgtcttagcctgttttcacactactatcaagaactacctgaaactgggtaatttataaagaaaagaggtttaattgactcacagttccacattgctggggaggcctcaggaaacttacaattatggtggaaggggaagcaaggcacttcttacatggcggcaggagaaagagagcaaagggggaagtgccacttttaaatcatcagatctcatgagaactcgctatcgcaagaacagcatgggaaactgcccctcccccccgatccagtcaccgcccaccaggtccctcccctgacatgggattacaattttagatgagatttagtggggacacagagccaaagcatatcaagtggtttctcctgtgacctcactgaagtttttgagaaatacatgcacgtgtattttttaagtcatcaagagcaagtaagtataatgctaaacaagaagttaataaaaacttcatgtttcctcccctctttgaaaatacattagcaattgtttttagatagagtgtacatttcctggagtcattgtttaagaataatagacaaacaagctgggcatggtggctaacacctgtaatcccagcactttgggaggccgaggtgggtggatcgcttgaggccaggagttctgagacgagcctgggcaacatggcaaaaccccatctctactaacaatacaaaaattagccaggaatggtggtgtgcgcctgtaatcccagctactggggtggctaaggcaggagaattgcttgaacccaggaggcagaggctgcagtgagccaagatcacgtcactgtactccagcctgggcaacagagtgagactcttgtctcaaaacaaacaaaaaaaaacacactacaaacccattttgcttctcatgaattgaaaatcattatatggtgttgtcaggagatcttagactctgtgaaaggcattttccagagagttgccgaaaattagaagggtgtgggggcgctgaaatgcctaggcagagaagataggtttgatatagtaaagagtaaggagtcaccaaagtgtcttagcaaggcaatactctaaaaatcatgttttaagaagagattctaccatctttgtccaaggtgtgtgtgttcatagagaaaacctagcctcccaaaacaagcaaggaaaatcatggattatgaaaggatctttctactaaaagagtcattattacttctctattttgcaaactctctcagtaccttcagaatatttacagccttccaaaatgtaatgtatacccttctcaggactatgcataatgcagttcacttaagaattgtgctatgttttacatagactgacaggttcttgttcaaattctttgtgataacatcttttcattttcttttcttttttgggtagttttaaatacattttcctttttaagaaggctaggatgtttggggggaaaaatccttgtactttttgtaagccacttataacacagattaacttcacagcacataaaaagaatactggagaacccttacatgattaaatatgcccctagaggattaagtttttccacatatttttaagccagtgctattaataatgttccagcattaaactttctgtacatcctcattatggaggaggcctttttttgtttttttcattctgcccttgctgttagtttttccgtggtcagatatgtagcactataaaattatctgtggaaacatacaatctgaatgtttaactggagtctaacaaagtatcatgtctggggctcttccaatttttattcaaagatgttgtcaatttttcaaacttaattgttcttttgtcttactggaaacctggcagaagatggctatttacaggcatatcttagattatggggcagaccaccacaatgcagctaatattgcagtaaatcaagtctcacaattcctttggtttctcagtgcatataaaagttacatttttactatactgtagtctattaagtgtgcaatagcattatgtctaaaaatacatgcataccttaagtaatacaaaatactttttttttttttttttttttgagacagagtctcacttgttgcccaggctggagtgcaatggcgcgatctcggctcactgcaagctctgcttcctgggttcatgccattctcctgcctcagcctcctgagtagctgggactacaggtgtatgccaccttgtccggctaattttttgtatttttagtagagatggggtttcaccgtgttagccaggatggtctcaatctcctgacctcgtgatccgcctgcctcagcctcccaaagtgctgggattacaggcgtgagccaccacgcctggccacaaaatactttttttttgctaaaaaatgctaacaatattgagctttcagcaagttgtaatctttttgctggtggaggttcttgcattgatattgatggtggccacctgatcagggtggtagttgccaaaggttggggtggctgtggcattttcttagaaaaagacaagtttgttgcagcagttggcttttcctttcagaagatattcctctgtagcatgcagtgctgtttgatagcattttacccacagcagaacgtctttaaaaattggagttgtcctctcaaatgctgctgccactttatcaacatgatgttctaaatctttagttgtcatttcaacaatgttcacagcatcttcatcaggaatagattccatctagaaaccactctctttgcttacctgtaagaagcaactcctcatctgttcaagtttgatcctgagattgcagcaattcagtcacatcttcaggctccacttttagttcccttgattttttcaccacacctacagtgacttcctcttgaacccctcaaagtcatccatgagggttggaatcaacttctttcaaactccttttgatgttgatattttgacctccttccatgaatcacgaatactcgtatctagaatggtgaatcctttccagaaggtttttaatttgctttgatcagatccatcagagaaatcaccctgtatggcagctattgccttattaaatgtattttttaaataataagacttggaagtcaaaattactccttggcacaagggctgcagaaatggatattgtcttagcatgcatgaaaacaacatttatctctttgtacatctccatcagacctcctgggtgaccaggtgcattgtcagtgagcagtaatattttgaaaggaacctttttttctgagcagtaggtctcaacagtgggcttaagatattcagtaaactgtgccgtaaacagatgtgctgttacccagattttgttgtttcggttatagagcacaggcagagaagatttagcataatttttaagggccctaggatttttagaatggtcagtaagcattggcttcaacttaaaagtcaccagctgttttggtcttgaccaagggagtcagcctattttttgaagctttaaagccaggcattgacttctcctctgtagctacgaaagtcctaggtggcatcttcttccactagaagacggtttcatctatgttaaaaatctgttgtttagccacatttctcaattttctgagctagatctcataataacatgttgcagcttctacatcagtacttgctgcttcgcctctcacttttatgttatggagacagcttctttccttaaacctcattagccaacctctgctagcttccagctgtgcctctgtagcctccttacctctctcagccttcatagaagtaaagggacttttagctttgctctggattgggctttgccttaaggggatattgtggctggtttgatcttccagatcactaaaactttctctgtagctcttttactttatttttgtgtgttcattggagtagcacttataatttccttctagaactttcccttggcattaacaacttggctgtttggtgcaagaggtttagcttttttttagcatgtctcagcttttgacatgccttcctcactatgcttaatcatttctagctttttttttttttttttttttttttttttggagacagagtctcactccgttgcccaggctggagtgcagtgtggcgcaatctcagctcactgcaacgtccgcctcctgggtttaagtgattctcttgcctcagcttcccaggtagctgggattacaggcgtgcgccactatgcccagctaatgtttgtatttttaatagagacggggtttcaccatgttggccaggctggtcttgaacttctgacctcaagtgatccacccaccttggcctctcaaagtgctgggattacaaataggcatgagccaccgggcttggcctatttctagctctcgatttaaagtgagaaatgtgtgactcttcctttcacttggacactttgaggccgttgtaattggcctacattcagtattgttttgttgcaggaaataggcccaaagagagggagagagatggaggaatggccagttggtgaatcggtcagaacacatactacatttatctattaaggtcgccatcttatataggtacagtttgtggtgccccaaaacaattacaatagtaacatcaaagaccactgatcacagatcaccacaacagatataataataatgaaaaagtttgaaatattgtgagaattaccaaaatgtgacagagacacgaagtgagcacatggtgttggaaaaatggtattgattcctttgctcaatgcggggttgccacaactttcaatttttttttcttttgtaatcactaaacacatagtactcaacatttcaaaaaagatcacttaatttcagtggacattttttcctgacgtaacattctggtttataaggaatcttgttattactgaggaattgagttatttattaaatgccttttttttttccagggggttaggctgtcaaattaatttcccatggctaatcagcctgggcttgactctacgcacgtaatggtcctacactcccccagctctctaggacttgcagtctctctgatcctaacagcctgcaggtcttttcttaccagccaggactctttcccagtcccttcagtggtgctcaccagcccctcagtttctctgaccttaaccttttgatccttattctgccagtcccttggcttagatgggttcttaatttcttttctccccaaatttgtatttttctgtcctgaccagaggcgtcagattgttccacactgtttaaatgtgccagtcaacctctcttctccgactctctgcacagctgggcctcagggtcaccactcttctcaagccccatagtctaacccttctcgggtcacagaggacttcctgccagctatctagaccctagagctcccctgcctcccgtcgcctggtcctttcgcttttcactgctgcagctttgctcaaccttccctcctcattcctgcccctgggggagagctgcccctcctttccagtgccaacctcttcatcagtgctttagagttctgcctcagcactaaacaaaaacaaaaaccaactaaagattttagtatttttatattaatatttaaaattgtctaattttaataaatgttaaataacatttggttttaagaaatattaaatattcaatgttaaataatattgtttattaacattaaataaaggtgggaggatcacctgaacccaggaggttgaggctgcagtaagctgtaattgtgccattgcactccagcctaggtgacagagcgagactgtcaccaacaacaacaaaaaaaacactgattgcagcaacaaaagttagaaagcactaccctttaacagagagctgattaaattatggtgtatttattatcggtggcaattaaataattttaattttaataaatattaatttttaatattaaatatttaaaaatcttattttaataaatattgaataattattaagtaacacatgcacatggatttaaaagttaaagtagtataaaataatctacagaggctactatttgatgtcagtttgtgtgtatttgcattctgccagagatattcttccatagatgatacatgcataaacaagtatgtacatccatgcatttcttcttcttcctgtctcctccttccactctttttgaacacaaatactatctatacacagtctagatattgctttttaaatatattgctatgttttggaaaacaatttgtgtcagtactatagacctgcctcattcttttaatggatgcaaaatatcccttttttttgtttttgaagactctgtcacccaggttggagtgcagtggtgtgatcataactagttgcagcctcaacctcctgagttcaggtgatcctcccactttagcttcccaagtagctggaattacaggtgcactccaccatgcctggctaatttttaagtttttttgtggagacaaggtctcactatgttgcccaggttggtcctgaactcctaagctcaagcagtcctcctgccttggccacccaaaatgctaggattacaggcatgagccatcgtgcctggcccaaacagtgtttcagtaagcatccttacaacataagtctttgtgcccatgtacagctttatcattatgaagtcttaaaagtggaattgctagattaaagggtgcctgcattttcatcttctgaaaagaaaaaaaatctatttcttgtataattactgttctggtctgtttatgcattgttgatttcttagatatgtcttcaatgtctgctatctttttaaagcattcatctctttatttcttgtgagttcccagagaatttctgaggcattctggttcagcgttctacgtttcacagtccctgtgatcactgaattcctaaatgtgatactcattgtttctaagaactctttactgttctcctagtctcctctcaagtgtataggccttttatttcttaactttctatgtaaggataacatatatccaaaaaaaacacataagtcttctgttcaacttaatgaattctcaagaagtacaccttatgtaaccaatgcttagataaataaattattgccagcaccttggaatgtcccttgtgccccttacagtctctctgtgggtagccactatcttttctcctaacaccacagattcatgttgcctatttcattttaattttatataaatgtaattgtacagtacatactgcttctttcttttgtgtaacattatgtttgaaggtagtttgttctcactgatatatagtattccattgcatgactataccacaatccatttgttcattctactgttgatggtcacctcaatggtttctagttttgggctatcatgaatagcgctgctgtggacacttttgtttgtgtcttctggtgcacatatgtacacatttttgttgggtgtatatacacatagagtagaattgctgcatcatagggcatagagtcctggttgttccacatccttgccagcacttggtattttctttgtcattttagtctttttgataggtgcaaagtagtgtttcattgtggtttcagttttcatatcaactactcatgccatggagcccattttcatgtttattggctctttggatatcctcttttgtgaagtacctattgaaatttatttttccattttaaaattatttttaaaaatatatttggctagctcgtatgtcacacttttttgacaaaatcctttttctcctcccttctcatttatccttttaaatttattttcttggcttttctctcacctgttcttttctaaccactgaactttagagccactaactactcctaacttttctagaatttttagtgaatttgcatgaaacttactttgagaaaacattggtactcaaactggaagataatgttattgttattctaagaagggaaaagatgataaatactaagccgtactagttttttggccactagattgcattattatccccatgtttaattctcattttaattttatttttgacaagagcttgttagaagtgaaagtcttttaatttgcattttaagtctggagactcctttttaaaaaatgtaaatgttttacaggttcttgatcaatatgaacgagaaggatttaacttcctagccaaggtgtttaattcttcacattccttcttagaagacttgactggtcttacattgctgcatcaagaaacccaagctgctgaggtaagaacaaaacaagctttctgtagtgaagactgacatgcttaaaactatttgatattcgccatatggaaaaggaagaaagcaattaattttaatttttgtaacttagagcaaatatcactaaataagtctgctagttaccagagaacgaataaccctcagcaagtgctggatactgatgtgtgtaggttgctgtccagtaggtgcctaatacacaaaatcagtgtgataaaggaagtataggttgtagatttccaggcacctcttgtccttactgaagatctgcatgtgtatgaccattggagagagttggctttaatgtccatatatcaaaatgtaagttggtaaagacattggactccagctatgttctttagaaagaaggtattggactctggccatgttcttcagaaagaacatgcctggctttttcacgatttgatcagtcttcttagaccctgaaccccaccatgaaatggcttccccagacacaacccgagagagttatgctttgtttctcagctaaaatattttgcagatcttaatttcctgggtcattgcatcattttttttttttttttaaagactgagtttaagaaataaattatcggccgggcgaggtggctcatgcctataatccaagcactttgagaggccaaggtgggtgggtcacaaggtcaggagtttgagaccagcctggccaacatagtgaaaccgtgtcttcactaaaataaaaaaattaggtgggcatggtggcaggcacgtgtaatcccagccactcgggaggctgaggcaggagaattgcttgaatcctggaggcagaggttgcaatgagccgagattgtgccactgcactccagtccgggcgacggtgcgagactccgtctcaaaaaaaaaaaaaaaaattattgtgtttttccaaatgctcgctgttcttagaaaagggaatgctgtgtatggtggtagagctatttggatcacttggcaaaatgtgcaattcctcagaattgatgagtgagattaaatcaatcttttccccttagttacctggataaagaagccatgaggagaaatgtagcttatgttgtgtttccacaaactatataaggaaaaccttgacttcctgtgtcctgcaggggtagtgcacttgccattagtccttttaagttgcaattcttcccaccagctaaagagaaatatataaattatttctagctaggtggcaaaactcccccagccatcttgtcaaatgattgcatgggtgcaaagatctataaattcctccataggttgcatatcctcaccattcagggaggccccaagttgtcaatgaatagatggccaggcccaatactggaccagccagtggtgaaagggctgctgtttggagaggtggagctagtgctgagtataggaagaccatgtagaaataccaaagtcagacccattggaggtttgagcagattgtgagatttttcaggtacaccagggaggcaagatagtacatctctagtgctggacttaaactgaaggcagtccttctttaaattgttttggtgccctctgggcattaaacagatgcagtcttccacttatggccaatagttagagccacaaagagtctatttcaagtttcaggagatgaatggcatctctgctgctctttgagagactttaaggtatttttcccctgaattgtgattgggttcccaggcagggttcagaacattgtgtttattgtctgccgtattatcttttaagcaatgctgtactgcctgatggtatggaagaggtaacatagatgtttgtaaacatacagtcatttgatggctaaggaagttttgccacccagctagaagtaacttatgtattgttagctagaagaatttcaacctgaaattgacccaatttttcactctttaaaacagagcagttgctagaatagtgggtaggtttctagatttaacctggtttatcttacattttagttggtcaaaccttaatggctttttcaaagacttagagaaagtttaaaagcaatagtgactaaatagatggtggagcagaagggagcatggtttcatccacgagcctgagttttctttttgaattttcctctactaaattatatctttagttttggaatcatacgtcacatcaaattttagattagagatggtaaactgtttggcctgtgagccagatacggcttgcaggtatgtattttttggcctgcccagtttgttaaattctgaataaagccatcatttaaaaaccacaagttttaggcggggcgtggtggctcacagctgtaatcctagcactttgggaggccgaggggggcagatcacctgaggtcaggagtttgagaccagcctggccaacatggtgaaaccccgtctctactaaaaatgcaaaaattagtcgggcatggtggcacatgcctgtaatcccagttactcgggaggctgaggcaggagagtgacttgaacccgggaagcaaaggttgcagtgaaccaagatggcgccactgcactccagcctgggcgacagagcgagactccatctcaaaaaaaaaatcacaagagggtctgaattttcccatttccaactttgaaaaatcagatctgggaactccagacatgcatctcttaatagtgatggttagctagagccaagaagcaaagtttatagataatgcacttgatataaaatttaaaggtattacgaaatactctgggctgggcatggtggctcatgcctctaatcctagcactttgggaggccaaggctggtggagtgcctgagctcaggagtttgagaccagcctgggcaacacggcgaaacctcatctctactaaaaatacaaaatctagcccggtgtggcaatgtgcgcctgtagtcccagctactctgggatgaggcaggaaaattgcttgaaccagggaggcagaggttgcagtgagctgaaatcgcgcgactgaattccagcctgggcgacagagcgagactctgtctcaggaaaaaaaaaaaaaaaaaaaattctgtgaaaaggatatcttccttctatacaggtcccttagctcctcagttcctttcctggagacaaacactgttgttactttcctgcccagagatattctttaggttatattctttatttagatgatgccctttagtaggtgacccttaataggtatttgagcttataacccgtcttcaaaaaggatcattatttttcttaactctgaataggactgtgttttaagataaggtttgaaatatagtacttagtagaggacctcctagcaacaaaaattactgttctaactacatcattttctattactttgaaaaatgtgtgtatgcgcatataagcaaaatatataaatatatgttaaaatatatatatacctttacgtatatctgtgtaaaagtagtgttttgatttacatacttgattctcaatgcgtttacaggtggtcagtaataaaaacacagaattctgcattctacgtagaaaggtctccacttatttattttagcaacacaatcaagatgctaaattaattctcattttgggttaactatttacatcaatcaacattggaattgcaaacgattcaactagataattatatgtgacattaccattatatactttgtttataaaatacgtgtttaaaaaatatactgaacatcttttgaaaatctgataccaagcactgtgctagtaactgaatacagaagttaatgagacactgaccctcaagggctcatagtctagtgtgagaagctgacatggaaatagtgagctctaatgcaataaaaaatgttttagtcatttgtatattaagtgctgagagagcagttacttctgcctaggggaataggatgtcaagaaaagcttcacaggaagagaacaaatatttcacttagttttaaaggatgagtagactatttttaaaaataaaagttggattttggcagagaaagagtagagaagggaagggcaagaagcctagggcgttctagactgaataaaggtctccgaggccaagtctttagtatattactcaaaatcatgagtagtgtgatgtacttggagccacagttacctgaagtcaacataatgttttttaataatagctttattgagttataattcacataccataaaacacaccattttggctgggcgcagtggctcacgcctgtaatcccagcacttttgggaggccgaggtgggtggatcacttgaggtcaggagtttgagaccagcctagccaacatggcgaaaccttgtctctactaaaaatacaaaattagctgggtgtggtggcatgtgcctgtaatcccagctactcgggaggctgaggcaggagaatcacttgaacccgggaggtggaggctgcagtgagctgagattgtgctgttgcactccagcctgcaagggcggggggaaaaaaacaaccacacacaacacacacacacctttttaaagtgtgcagttcagtggtttttagtatattcacagagttgtgcaaccattaccactctctgtttagaaaattttcatcccccacacccaaaacaaactctgaacctattaaaaggtcactccctgttccctcctccttccagcccctggcaaccactaatcttctttctgtctgtaaggatttttctattctggacacatcacataaatgatcctttgtgtctggcatcttctatttagcacaatgtttttaaggtttattcatgttgtagcaaggtacgcaattgtttttcatttaaagaaaaagtctcaatgctattacaattttccatattctttgcacctgtggtctgtctccctaaatatagcccctttatgaaggaggaatgcaaagctgatccaactagagactacaaattcctttatatttatatagaaaggggcacatagtaatgaattggaagccatatccaagctagaatcatctagatttagtgagattgactagtgcaacccaattttttgcactcatcccctgtccatcaggtacctggaaatgattgcaatgattttgaactaggttactggtataatcatactgctgttgagattagcaggcaaattaccaagttagttttttattggagggggagaggtcaatgtgtgagggtgcatagtggagactggggaccaggctgacaaagatgaattgttttaggtagtgatgactttgaggtaatgggataagtgagtgaaaatgactggttggcgttggagatgggatggagatggagcttggagaaaaagaatagcactagtaaatggatttagctagacaaaggagatttaccctattccatttagcacagtgaggagaggctagacagctaggatgcaataaaaaaaattttaatgagaaatgtgtgtggtagattaattttattaatctcaagttatagattaaaaaatttaagtaccacataaatgccatttgcctttgctaatgttacatttttatgaagaaggagccttgcataagaatgatataatggacttttgggacttgagggagaagcttgggagggggggtaaaggataaaagacatattgggtgctgtgtgtacactgcttgggtgacaagtggactaaaatctcagaaatcaccactaaagaacttatctacataaccaaaaatcacctgtaccccagaaactattgaaataaaaaaaaagaaggggacttggacagatagccgtattctttgccaaattatagttacattctgctcatgggggattaggaggttcaatggaagaaaggccccactcagctttcttccctcttaaaatgttgccttgtaaattagggaattttgcataaagctctgacctttacttccaaggcctttactgagaatgggtttggatacttggagatagatcctgactccctatccctcctagatctttatttatcctatttggaacccagggaaatggccttaaagctgatgaaccacagggtgtccaagtcatggagctattgaggttctccccaagtatcttttaaattgctgcatttgggatgggtacagtggcttacacctgaaatcccagcactttgggaggctaagttgggaggattgcttgggtctgggagtttaaggccagcctgggctagatggtgagcctctgtctctatttaagaaaattagaaattagccaggcatggtgacacaccagctacttataatgctgaggcaggaggatcacttgagcccaggagtttgcggcagacagtgagctatgattgtgccactgtactccagcctgggtgacagagcaagaccctgtctcttatttaaaaaaaaaaaaaaaaaaaaaaaaaagctgcgtttgttgaagaaatgctcagtctaaatcaaacatatgaacaccttagccatgttccacaaaaatttgctgtgacttaccttcttagagttatttctcatcctatgagtagaataagtatcagttcacatgtatttatttgttccaactgtgggttcaacatcatactatgagaaatgccaaaatattttctaactgaatgtaactagagataagactaatttataagagagttaatagaacaagctatattggtatatccctgagaaattcaaattcctaagtccctttacccaatttccctgaaatacttcattcctattcatgaaagtttgcacgttccatgattccaggattaattttaggctgttttacttccttgccttgaccatattgtcagtatttgatgttgtaccatgcagttatgatttcagggttgcaattacagtgcaccattaatataatttgcattttgtcaaggttgtgctaaatagaacttcctttctgcagatttggggattaatgaatgatcatctaaaaagaaagcaacaaccataacataggctataaaatcataaacagaccagcagaaatgaacagggctgagctgattaattggttatgaattaaaatgtagattgtgattcattcactatagaactcagaattctagaaaatgcccatttctctcatagccaaaaagtcatatgaaaaacattacggtcatgtgatatgacttcattggcacagcaatttactattcagcaaagtaaataacacaattaacaagtgtttctgctgggccttttgcacttacactgagattttggcctctcccccacacagctggttttgatttggttcctgtggaatatttttgttttgttttgttttgcatttaacaacagtcagatatttatgtacagcttcatcaagagcctctgatgacaaatatgcctttggaggccagcagaagctgtgggaaacccccgtgtcagcactcagacctgtttccaatggagagaaatcgctctggggactgaactagcctgctcatgaatccagttcccttttcccagagccttctgctagctcacttccaacccatgctggccatcctgggactgtgccctgccttgatttttccttatgaagcaatccctcaagacacagccttggccctctctcctgagtgagggaggaaaggcagaaacaggcagaaagccatttacttcttagattggaaactagagcctggtttttgaaataaagcttggcagtatctcacttataacttactttataaaatgtgtaccttttatttgctgtcagagttatctacatgaatttgagatgtttggataaatcgttattggggaaagttgcaattggaaaatagacaatgaagtctgggcagagttccccacccttcggaaaagagtctcggatggtataatccgcttggagaagtctaagcgagaaagaaggggggaaatcataaatgctgaaagcaaagcaaagacagctaatattaggaaacagaacatgggaatccagtccttcttacattgtactcctggttccgccagtgttctcatgagtgaccttggatgaatccttcagtgtcctgtgcatgcttccccacttaaaatgagaggattgaatcatgtgaaattctttttttaagcctcctttctagaaaaaaatgaaatgcttttcaactctaatttagtgattttgattcaaatataccatgtataaccaaaaaggaaaaagatggataatttttacataaaagtgtttaaaaatatatcaaagtacttactttttatacattttataaatattctttggtatctattatatctagctaccattgccagaaacaactttttgcagattttgagatttacatctactttgagccttaatagaacattgcttatactttgtattgatgtgtgtcactgtacgtataaatctaaaatggtgtaattcagcctaataacttacctccttcaccagactcggtgccacttttgacttctttataaactcaaatccaccctggccataactgggtatgttcatgaaacatgctactcactacccctcagtacagcttccgaagatgagttccaaagccctcttactttaatagcagcatccttagaatgctgaatgtgtaataacaggagagttactttaataatcagccatattacattagaatactcataaagtgtatgagtaacccgaatcctggcctggtcagaaggtctgagttcatacctcagctcccacacatagccaagactgccatgttcctctgtgtgggccgtgtcaggcaggaccgtgtgcagcagtcatgtgagaccttgggttatttacttcattgaccttcgtttccatcattttgtaggatgtgattaataattcctactcctcacaattaccatattaagtaagaaggcaccttacaaaagaaaaatactggactccatcaaaattttaaattttgtgcttcaaaggacataagaatacgaaaaagtgggccacagtataagagagaacagcattttgcaaatcatacctgataagggtgtggtatctagaatatagagggaactctaagctgggtgtggtggcatgtgcctacagtcccagctgcttgggaggctggggtgagtgtatcgtttgagcccaggagctggagaccagcctgggcagcacagtgagaacccatctctaaaaacaacaacaaaacccagaatatatagggaactcttacaacttaataatataaagatacagaactcaattaaaaatgggcattagatttaaaacaacatttctccaaagaagatatacagataatcacatgatagcataatcaaataagatgcccaacatcaatagccattgggacaatacaaattgaaactactgtgagatggcattcatacccagtaagatggctataatcaaaatgacaacatccaatgtttatgaagatgtagggaaattagaagcctcctacctactagtgggagtgtcaaattctgcagccactttggaaaactgtttaacagttccttgaaaaattaaacatagaattaccatgtgacccagggattgtacccctagatatatacccaaggctactctggacaccctgcctatagggtagccctgttccacaaggaacagtaccaaaaattgtatatgtgtgtgtgtgtataaatatagcccagagaaatgaaaatgtgcacacaaaaaatgtacacagtgttcctaacactattatttattcataattgtcaaaaagtggaaacaatgcagatgttcattagctgatgaatggatggataaaatgtcagctattacgctggaataatggagtattcagcaataataaggaagtactaatacatgttatagtatggatgaacattgaaaatgttacactaattgaagaagccagtcacaaaaggacacatattgtaggatctcatttatgtgaaatgtccagagttttaaagtccatatagtcaagaaagtagattaatggttgtcagcaggtggggatgggggattaagggaaaatcagtggctacttaaaatgtttcctttcgaggtgatgaaatgttctaatcttagatagtgatgatggttgcacaacggtgattatactaaaaccattgaattctatactctgaatggatgaatcatatggtgtgtgaattatcaatacagatgtttaaaaagcaagacaaaaagtgcccatagttggggcattttgtttctccttccctctctcctttctctggttctctctgcatgcaatgttgattttctctctgtgacaggctgtcgtaggatgttagctcattgtttttaggaatgcgttttctgtagattatgacaaggatctcttccatttttattgtgcctcagttttcaaagccttagtctctgtgcacctcctttagccttttcttatgctatggatagcctgtaaacactgagggaagagatggaggggcctaccaaccaaatgcctcccctctgtgcttgctgtggggagagaaagccacagttggctccatccatagaagacatcgcagataaaggggttaggggaagatgagagcacgttgctatctgtttgtgtaagtttaagcaggtgtttagaggatctaaatcccaacctggatctgaatttttaaaatttccctgtttaccacaggatttttcccccaagattttttagcttgaaaattcccaaatataccagaaagttgaatgaaaagtacagtgaatacccacatactcctacctggatccaacaattaacattttgccacatgtggtttatctctctgtgtacgtgcatgcactcccccgacgtcttatcacagttcgcatatatacttgctcgttttctcttttaaaccatttgaaagcaagttttatatacagcggcacctcacccctaaattttagcatgaatctgctaagaatatagacattctctgatgtaaacagagtaccatcatcacagaacaacaaagaataattccataataccacctaaaatccagtacatgtccgaattttcccagaaatgtacaggattttaaactattgtttgctttttcctcaagctggtaatattatacttagagttttttccaataatacttaagcactggtcatacataccaagtgatatccacttaagcatatctttttaattcccttgacaccctcacgctcctctctaaatggggagacacaattaccctattaggcaacatgcccctgaggtcctgctgctccagcaggcctcttctaggtgagcgtcttctctgggtgtcaccagggcatcctggtctgattgaagcagccctgagagccaaccagccctgagcagtggttcccacccatcctccatccagggtccccaatggtggaggcttttaaggaggtaggaatgggactatgaaggctattttcaatattttgaaaagtcaaacaggagtaaaacatttaggacttgaaaagattacattgaccaactgaactatcaagattttagccaggcgtggtggcttgtacctgtagtcctagctacttgggaggctgaggtgggaggatcgcttgaacccgggaggtggaggttgcagtgagccaagattgtaccactgtactccagcctgggagacagagggagaccttgtcttaactaaaacaaaacaaaaataaagattttttttctttttaacctaaattctgttgtctcagaatggaatggcatactgttatctgacctggccagaagctctgattggtagttatgaatccctttgaattattaaaaaaattaggcaaattagtgcatttgctgggtaggagaggtttttcaagatctaatatgtgagagagaaagtgaaaactaaaggaattcttggagatcaggaagtggagaatctctggcctgtggcgctgctgagcctaacttcctggcttcacatcagcagtggaggcttccctgggaggtgttcttgcagtttgccctgtgaccgctattctaggggctgtatttttacagctgacccttctcacttgcaaacataacagctgctatgtgttgaatttggggagtttccatattttgagactgtaaaattaaattgatttttagttctgagctcttagtcttattttctttttcttttctttctttctttttttttttttttttgagacagagtctcaccctgttgcacaggctggaatgcagtggcgtgatcttggctcactgcaacctccgtctcccaggttcaagcgattctcctgcctcagcctcccgagtagcagggactacaggcgcccaccaccacgcccggctattttttgtagttttagtagggatggggtttcgccatgttggccaggctggtctcgaactccttacctcaaatgatctgcccgtctcagcctcagaaagtgctgggattacaggtgtgagccactgcaccgggcctgagctcttagtcttgatccatcttgcttctcagctgtaggggagcagggagggaagggaatgtgaaatatcctaaggtgtgtgttttttaaaattaaatattgttgatcttttatcatggcttctatcagtcaacagatatttattgaccctttgctgagttcatggtgtgggagtcaaagaggtacaagccaggcttttaggaggcagacgcagtatagttggggagataggacaggaaagtcactaggactgcaaggcagtgggtgtgcacgtggtgcagtaagttctgcagggtttcaggaacatcaggagcaagagagagctccagggaagagttaggttttgaggtgcgtcttgaaggttggagctccaagtgcaggagagaaaaagctttccagaagggcctgtggcatgaccacatccaagtctctgatgaagagtaccaagagaggtatagcaactaatgttaattgcgttatctgtgattttcagggcgcttttgtacctgcccttttgatgcccataacaatcttaggaggtgactattatcccattttatggatgaagttgtcaagactgtagctatgctcaggatttatctacatcttgaggtttacagtacacttcataaggctggaatcagagaggaagaagtgcatagggtgatgcagaggcattctgctttatagaacatatctctactttcatattgagcagtttccaaaagcggttttgctttttgtctgtgtccttacaactacttctcagatagcatagtttctttcactgtaccatcctggggccttactgtactttcttactcttaaactggcttctaataaaatccgtgggaatgagattttacttgtagatgaacttgcgactccaatcccaacttaccattgggaaaagagcaggtaagagataagtcctttctttctggcctttactctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctttactcttaatttccctttacaatttagggaagagttggtccccatttgcttttttttttttttttttttttttttgagacggactttcgctcttgtcgcccaggctggagtgcaatggtgcaatcttggctcactgcaacctttgcctcccgggtttaagctattctcctgcctcagcctcccaagcagctgggattacaggcatctgctaccatgcctggctagtttttgtatttttagtagagatggggttttgccatgctggttaggctggtctcaaactcctgacctcaggtgatccacctgcctcggcctcccaaagtgctgagatataggcatgagccactgtgcctggcccccatttgcttttattcagctatctggtgaaaaaaattcagtattaaactagaaatatttatatcttattgttgcaggacaaagttgttgagtttctaataacaaatatgtaaactgctgtgggatatttttgttttgttataatttgctgctagctttcaagcatctgtgtttatcctaccttaatcctctttgaaagaggccatacttaattttacccaatgctttattaaaaggaaagaaagttggatttttaaattttttatttattaattttttgagatggagtctcactctgttgcccaggctggagcgcagtgacatgatctcagcttactgaaacctctgcctccaggtctaagaaattctctacctcaacctcccgaatagctgggattacaggtgcatgccaccacacccagttaatttttttgtatttttagtagagacaaggtttcagcatcttggccaggctggtcttgcactcgtgacctcatgatccacccacctcggcctccgaaagtgctgggattacaggcgtgagtcaccgcaaccagcctgcattatgttttaaagcaccagtttggaaccaatcttttagaggtaactgttacaagtttctgtacccaaatattggtttatctgtactctgtttcttccttcccctttctcctttttttttttttaattttttttttttttgagacagagtcttgctctgttgcccaggctggagtgcaatggcgtgatctcagctcactgcaacctctgcctcccgggttcaagcaattctcctgcctcagcctcccaagaatctgggactacaggcgcctgccaccacacctggctaattttcatatttttagtagacacaggtttcaccatgttggccaagctggtcttgaactcttgacctcaggtgatccacccaccttggcctcccaaagtgctgggattacaggcgtgagccaccgcgcctggcccaatttttgtatttttttataaagatgaggtttcactatgttgcccaggctggtcttgaactcctggcctcaagccattcacctgcttcgacttcacaaagttctgagattacaggtgtgggccatcacacccagactcttctctttctttcaacggtaacctgtggaaatacaatgttatcatccagtaccatgatcgctaggctgaagtaatagtaagccaagctctcttcagcccttagcagtgtgggcccagaaacagggtggtcttatggaagggagcataggatgtgggtcctgaagagaaggtgttcactcctggccccatcgctagttgcatcacttcatcttgcctggatttcatctgtaaaatgggataatgcctactccacaaagttgatgtgctttgaaatctttaatacaaacatttgttattggaaactaaatacaaacgaaccaaatggaaaactagatttttttcataaaaatgtttcgggatatatatcataggcctttgaacgtaaatatcttgaactttaaacaatcattagccattaaaattttaatgtgtattaaatggatattattagactgtcaaagtgattagcaataggtggtttcattgtagaataacctattttaaagtattttagggccaggtgcgtgggattacatgcctgtaatctcagcactttgggagtctgaggtgggaggattgtgtgagactagaagttgaagaccagcttgggcagcatagtgagactccatctctacaaaaaaaaaaaaaaaaaaaaaaaaaaaaaaaattagccaggtttggtggcacatgcctgtagtcccagctacttgggaggctgagatgggaagattgctagagcccaggagttcgaggctgcattgagctaagattgtgccacttcactccagcctgggccacaaagcaagaccttggctgtacaacaaacaaaacaaaaggaaaaacaactatttgattttagtcagggtgtaagaatatgtattattgttcccaaaaaaatctgtgtaaaaacttcatagtgtgaaacagtggcaactgcttgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctggcactcctactagtcttaaaccattatctcccttgaaaaatgagttctggctcactccttactactaaggctgaggggcaaaggagattatataaatgaaagcaccatgcatgtttgaggtggtttccttttcttcgttgttgttttttgagacagggtctcaccttgtcacccaggctggagtgcagtggcacaatcttggctcactgcagcctcaaccttccaagctcaagtgatcctcccaacctcatcctcctgagtagctggggccacaggcatgtgtcactatgtctggctaattttttgtatcttagtagagacagggttttgccatgttgcccaggctggtcttgaactcctgggctcaaatgatccacctgcctcagcctcccaaagtgttgggattacaggcctgagtgggattacaggtctgagtcactgcacctggccgaggaggtttgtattattacttgtgaatggaggaataacttgagctttagaaaagttaaagtgacaaagatcaagaaaatttccccccctgcttttttctcttatattttaatatttccaaatgagctataacatatgcagaaaaaagcttaaaacattttatatagagaacaagtatgaattaaacacccaggtcaaaaaatactctcgttgcccttcacccatctcatattttactttctgaccacaggcctagaagtaactagtaactagaaacagtaaacttttcctgtacaacttcagtctggtatatgggtcttaaacaatataattctatttgcctgactttgaatttttcaaacagaattatgctataatatgtagattctttcgtgtcttgttttgcccaatattgtaaaggttacccatttgctgtgcggctaaagttcattttcgttgctatgtagtgtttcataattggatatattgaaatttctcctctacggtagcatttctagtctcagattataatgaagtgtgctgtttggagcattctggtatatatctcctggggttcatgtgcagcatttctctgggtgtttctcaaccttcttttcattatcactcctcctagggggataatttaatgccaacagtttagaatttaattaatactaaagaatagggtttgtcagatagggctgagctttggagagccactaaacactgtcatatctaagatttcttttgcctgccaaagaccaatttttgctcctttgggggtgatatcaccctctttgtgaaggcatactgtaagttatttatctcatactagaattgttgggtcgtagaaaatatgcctcttctggaccatggacttaaatgtaaaacccaaaactattaaaaccctggaagacatccagacatcctggcccttacttctggacataggaacaggcaaaaatttcatgatgatgccaaaaacaattgcaacaaaagcaaaaattgacaaatgggatctaattaaactaaagagcttctgcacagcaaaagaaactatcagtaaatagataatctacagaatgggagaaaattttctcaaactatgcatctgacaaaggtctaatatccagcactacaaggaatttagacaaatttacaaggaaaaaaccccattaaaaagtgggcaaaggacataaacacacacttctaaaagaagacatacatgtggcgaaaaagcatatgttaaaaagctcatcatcactagtcattagagaaatacaaatcaaaaccacagtgaaatacatctcacaccagtcagaacggctattatgaaaaagtcaaacaatagatgctggcgaggttgtggtgaaaaaggaacgcttatacactattggtggaagtgtaaattagttaaatcgttgtagaaagcagtgtggagattcttcaaagacctataaacagaaataccatttgacccagcaatcccattactgggtatatacccaaaggaatataaatcattctgccataaagacacgtgcacacagatgttcactgcagcactattcacaatagcgaagacatagaatcaacttaaatgcccatcagtggtagactggataaagaaaatgtagtacatatacaccatggaatactatgcagccataaaaaagaagatcatggatggagctggaggcctttatccttacaaactcatcgaggagcagaaaacctaataccatatgttatcacttataagtgggagctgaatcatgagaacacatggacacatgggaacaacacacactagggtctggtggaggatggagggtgggaggaggaagaggatcaggaaaaataactaatgggcaccaggcctaatacctgggtgatgaaataatctgtacgacaagtccccatgtcatgggtttacctatataataagcctgcacatatacccctgaacttacaagtttcaaaaaaagaaaatatgcatcttcaattttattaaatcatgactgttttccaaagcagttcactgacttacatgaataccagtagtatatggtagtttctgtggtcccttatccttgccagaatcttggtactgtcacattttaaaatttttgccaatctgtataacagtatcatattaggcttttactttgcattttcctgatcactgatgatgttaaacgtcttatgtatattacttatttggattcttcttttctgatagtttctctacttcaactccaaaaattttcatatgttatgcttgtgtagcccctgtgaaaagaaagcacagtaggatgacctagttattcacttgaaaagtatgatggagcccagcgacctttgttctaatcccagatgtttgacttggtcagagtcccacacctctggccctcagcatcctcatttgctaaataaaagtattggctgggttagagcagcagttctgaaccttggctgcccatcagaattatctaggatgctttaaaaaaatgtttagaccacatctgcaccagaaagcctgattaaattggattaaaggttactatatccatttcaacattctgtgataacgatagaataagtctttaacacctagatttcatggtttcaatcatcttccttgtctgcaccctgaattaagtatgccagagactctttatttgtaagactataatctacttttgtaaatgcgttatataaaggaggagactccttaatttagtccgtaggggaaacttggcgtcatcattcaaaatactttattgtatctggtttacttttagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaatttactgcctgacatcaagtcagtggtgttttttagtgtccgtctgtcacatgtaaccatatcacatgtgatcagtatctgacacttgggtggcaccttgtctttttcagagggcatttacttgcatttactcacttgatcatcatagcagtcattttcagtgaaaaaccttttgtagccatccataccctggttacaagtgatagaaaccaaaagcttgaactctttttagcataaaagagtaatttattggctggacacagtggcttacgcctgtaatcccagcactttgggaggctgaggcgggtggatcatgaggtcaggaattcgagaccagcctggccaacatggtgaaaccccatctctactaaaaatatagaaaaaattagcctggtgtggtggcaggcatctgtaatcccaactactcaggaggctgcaacaggagaatcacttgaacctgggaggtggaggttgcagtgagccgagatcacaccattgcactccagcccgggcaacagtgcaagactccgtctcagggaaaaaaaaaaaaaaagtaatttattgcttaatgaaaccaggtcatgaaatctgggcttcaaggactctagatgggggcatttagtgtcaagaccatcttagtgttcatcagctctgttctttgttggctttattctctctcactaccaacaagttcttttcttccccatatagcaagaaacatggactcgggcagttccaaaatctcattcttacattaagaaatctttcctagtggctccaaaaagaaaatcccagataaggactgtgattggccaggcctgggtcacatgccatctctggacagctggcagtagaaagggaagggctgccatgattggccagcctgggccaggggcaggtcatactgattggcagcctccctcagaactacacggttggagtgatgggggatggtcctcctcaacaaactgatgcagatggatgggtgttgggcatatatgatagaagtccattgtaagttcagtctcctcttagttctattcctgtgtctgttcctgtcccttccaaacaatgctgcttttctatcagcaattcattattaaggagttgagtgaaagtcatgaaattccagtccccagatttgtccccaagcttgactcactctgctttctggatttacccccatcttctcacctaaccacagataccagaaaagaagtctttattcactgaggctttgaaaaaattagctgcacagtcttccttaccaccacctccaaacaaagaactttctctgagattggagcacagtgcctcctcctttctccttgctacacagaagcctcattctaggcttttcctccttccaggctcctccatgctctcctgaggccacctcttggggcggggaaggggagtgctctctctggctgcttctgctcacccagggtggactcaggagctggagcccctgaggtcagcatgaggcttcatctctcagcccagatggccaggctcagtgacagcatctctgcttcaggacatgtgcctttagtctcctccatagtctaaaaacttacttgccgtgctgaaacttgttgataaaaccaaatctgtaatcaggaacataaaccaacacaatacaggccttgcacaaatgagcagttgtggggtatcatgggcccctgtggattatttgactgaagagaatgatggaggcaaagctggttgttgttgaacaaattgctgccagatgtagatttcaataaacaccacactgttgttcccctgcccgaaggtgctatgaatttcttgaggcaacagaggcatcagtaaacggggcagtggggtgggtaagggggtcgctgttccaatatgaatggagcctcctagtgttttctgtccctggatgtttgtccacagaatccaaggcaggccctgggggtctctctcccctgcctgacattttacaccagagtaatatacttaaactgtagcaaccagactctgtggaacctaaaagaaacctggaattagggtaaaaatgtcacacaaagtctgtattgagggttaactgtaagacatgatgaacaaagcacatcatccttcccttcattgaacttacaaatgggagggagatgagtgctaaagcagtaattacaaataaataacagacaagccttcaaacatcctgtgaaggaatgcagcgtgagcttgtaatgcagaggccactgtctctgccttcaccatctgctaactaataagctaggtgggccaaaatatgagcctattagctgggcatgatggctcatgcctgtagtcccagctattcaggaggctggggtgggaggattgcttgagtccagaagtttgaggctgcagtgagctatgattgccactgcactccagcctgggtgatggaacaagaccccatctcttaaaccaacaacaacaaaaaaccctgagatttggggcctgtaaggccccagagtcttcactacccttggtggctgtacttttaagggaatgaaaaggagagagagattgagattgagactgagagggtgagagagagtatgattggttttagttagtatacaaagaagcttctcatgttccatacaatggagtgattctagagagaatgattttcccgacccttcccttgggttatggctcgctaaatcaagcatcagatgaacgcttggcataaatctaacgtgtgtatttggatcaccagagaactatgtggttttctaatcccgttgtcccagttagatgcaaagcttctggaggacaagggccacacctttccccctttgtgccctcaaacactaacaggcgctttgccatagtacttggaaaaatatatattagttgaatgataggacaaaaaagcggttgtagatggaaaacgcattaactgctgagaacacgttttcattttgagttgtctataagagtttaaggggcagggaagccctggagttgaagtaaattcaacagcatcaagttttgtgtttggccctcaataaactagtctctctgtacccctggcagggggtgggaggagtcctgggggagctcccttccaaatcttacagggtggtctgtttcttctttggataataatgatgtaatggctagtctcttgagaacttgctgtgttccatacattgtactaagcatttatttggattatctcattaaatcttcacaatcactttatttaacagatggagaaattaaggcacatggaacctaagtgttcaaggtcatggagccagtaagtgttagagccaagtcgtttggctccagagcctgtgttcttaactactactttgtagtgtctttcttacatattagttgggcctgtgtattgctagttgaattcctcttcccagtggcaggccttcacgtgtttgaccatggttttcatgttctccaaacctcagttctctagatttgtactttggtaggtcatcattttccacagatcctacctctttaggtcagaaaatcttgccagtttataaagattctctgggactaactcccacaaagcaaggtcacaagagatcaatgtacaaatgaagcagttcagtgagttttgtctaccattctccataagtacatgggagacaactgatgattggaaggtttggtgttcacctcatggagctgtgatatctcactcaccacacagatctgctcttctgagggaccatcttgccaatttccagagagttgcagggatattaaatttttgcacattaagcttcctctttccaagctgcacatgggccctgctaccgtttgtgaacagtcttctagagtgatataggttctagctttcttagttaagatcgtattttctgataccactcccttgtcactttgcctgaaatgagaaactcccaacctcaactgcttttctagtctcttccaatgaatgccttccaaagggctggtgtcctccagggtgtattagttgttactaatttcatcctccaaggctgatctgattttcaagatctgtagagagaccttagtatattgccttgcctgtaccaaatacagtcattatggcacaggaaaatctcaaataccttattggaaacccaggacaaatatttatttgaccttaatgaaatgaaaaagacattggatgcatacatttaaagaaaacccaaaactttggaatctttaccaaggagggtatcttttgaaaaggacaggctggaacaagaacttgataaaatagaagtaaaggttgacacttttttttttttttttttgagatctatatcactctgtcacccaggctggagtgtagtggcatgatcttggctcactgaaacctcggcctcctgggtacaagtgattctcatgcctcagcctcctgagtagctggcactataggcatatgccaccatgcccagctaatttttgtatttttagtagagacagggttttaccatgttggctagctggtcctgacctcctggcctcaagtgatccacccgacttggcctcccaaagtgaaagtcggcattactagccctgttcagcacatgagacagggcactggatggtgtctacctaatgattttcaacccaggggcccttggcccaagcgtatcactggtataaagggcctctgccagctaatgtgagggtgagtgtggctgttgtgtccatgagagaactcctgggagttctacactcagcaaacgtttgttgttggactatgaaggcggacacagattttatacgaatttgtaatgctaacatctagcataagaattggcaaccatagaaaatattacgtgtatatatatgtttatagtctcaaaaaaaaaaaaaacaaattaaaaaaaccccaggctgccctgtctctctctatctctctctctatatatatatacgcctttacatacacacacacacacagacacacacacacacagacacacacacacacacatatacatatctcttaaatgagattctatttttgtgaagtgttcagaatagacaatccatagaaacataaaaacagattcatggtcaccagggacttggggggttggggggttgtgggagggaaatagggagagactactaatgggtactgggcttctttttgggataatgagaatgttctggagccaggtgtggtgcctcacatctgtaatcccagtactttgagaggctgaggcaggcagattaccctgaggtcaggcattcaagaccagcctggccaacacagtgaaaccctgtctgtactaaaaatacaaaaactagctgggcatggtggcacatgcctgtaatcccagctacttgggaggctgaggcaggagaatcacttgaacccaggaggtggaggttgcagtgagccatgatcacgccactacaccccagtctgggcgacagagcgagaacctgtctcaaaaaaaaaaaaaaaaaaaaaaaaggaaatgttctggaattagatagtggtgatggtttacacagctgtgaacatattaaaagccattgaactgttaaattggtgaattcatgctacgtgaattatatctcaataaagctgttactttaaaaatgaacaagaaagtaaaacccataaaaaggtcctctaggcacttcagcaaacagcgtggtagggaaaagaccaaggagttcttagccctggaggaatggaaaaccagttaacatggtttattcacccaggcctgagatccataatgaaggccatttttaaagttgagtcaccacaggcttgaagactggttaggattggggaactgagggttagagagtaaagtagaagggatggcacttttcttgataggagataattattgcagatattagtgttaagacctattctttttagtatttttttaaacacaaagtaacacctccatgttaccagcaatatttcacatttcaccagtgttcactaagcacctattgtgtgccagttcctatctgctggaagtgcacgattccgtgggctgtagcgagcacagtagcagtccattgggcccaattactgctgacctgagcaatctgttaaaacccggaaagggtattggaagcagacagtccttcctttcttaccaagcctggagaatctacagctctgtccaccacgcctttagagaggcacacccaaattggaagattgtacagtaaaaagagggaatgtccagttcaatgttgagggggctgagagttctctgggttccccaggtggagaacagacggggggcgtgggccttgccatgtggtctgagcactgaatgtcctgaaagtgtggaaaggcctgtccccaagctttagtaactttttttccacctagaagcaagccaagtagtttcagagtaattctcagggtaatccagagccatcttcatgaaagataatactagaaaactcagagggataaaaggatatgcttgctaagaagattatttcccgccgtggctgtccctgcaagccaacaatagcacacccttcgtcaggatgtaacgagtgagagagaacagctagaaaagggtggagaagtaggcgggaggaagctatttaaaagaccctaaagtgctgcagctgttttggctaatttttctcatctcagtgatgttccaagctctttgtcttctatgtggggcgacatcatttagctctcttatgagtcatccttcccacaaataatctctcttggagtagcccttatgaaaacagacaattcacattgcattgtgtgaattggcaattgtgtgtcccttccctgggtgggccatcctgcgtctgcctgcatccacacatgtaggacttctaaggcctgagcaaaccctcagtgatgggggagtgcaaggggtgggggggacatctggagcctgaagcaggcatggaaagccaccaacagtgtgccctggtcagctgactgctccatcttaaaggtttctggataccgtagttgttacctttcctcacaagggttttatgagaattatctaggaaaaagcagacatcagaggaaattccgtgtaaataaatgtgactgccacttcaaacctcaatcttgctaaactgagcttttctttttagatagtcttttcttctgtctggctagcaggtctgaccagcattttaattaaggcttccctagagagacactgagctctttaagatagaaactagactgggtatctgctggtttttctgcctaggaaaatgtactctaatgggtaccttgatttttacccagagaagcccagggtctcactctcatcccatgtttttctggtggagttgactccgcccttggcccatggttggggcaaggtagttgggaccccaggcaatcagcacatcgtgtttccctggccaaaatgcttgggtcagaaatgggcacatgacccaatcttaaccaatgaggtatgatgaaactttggctaagaggctgcgattagaatttggaatttgacggcatgagtctgggctggggcagccttctagtgattgtgagtggagagccagtttgagtatggagaccacacatggaagagagctgagcctggctgggctgagagagcaagaggatggtcatggtattgttctctaagcccagaaccaggcttccctgaaggtaccattatcccggtctttctgggcatatgaggccacatttcccttttagcttgagtaaataaaggttgagatttctgtcccttgcaaccacaagttctgacttgttcaggggcagcgtttcaatctacctaacatctagcagaatgcctggcaggtagaaggaagctcagtgtgtgtttactgaatagattctcattgagttaaacagatgttcatcaaatgctaatgaggttaatggctaccatattggatgatacagatatagaacacttccatcattacagaaaggtctataggatagcactactatagagaggacaaactcaaaccctgcctcccagaagctctatttttgagggtttttaaaatattatcaaaactagatagcataacatatggaaagatagcctgacttactgatttataaaagttcagctttatttctctcgagtacagttatttacatataaattctaatgaaggagtttaacaacaattactatacagatagagtcacacattatacaaagtaaggtatgcctaaatattcttttacatatgaggaactggaatttactgggcctagaaactaaagcagtgtagaatgccttgttgattttttgcagccttttcatgaagcaagttattgattttaagtagaacttaactacagtagtaaagtcctaaaatttctcacagaacctattccatgtccttacccagtaagactagcacttgccacccagaatgatgacaattctagaataatgtggtttagagtagtcagtttctgcaggtgattcctggacatcccagtgcacctgttctgcttttgctggtccacatttggtggtccactcatacctccttcagagtagggcatctgagcctattctggcctccagcatactcattttgtataaaagccatccctgtgtacaattccttcttccggtgacatccatttttcctaaaagtgatgtgagaacaactgatcgtgagcttgtccatgtattgttccttgttggcctgaaaaccaggagcacttgtaaggctgaatggattctgcccagaccggggctgtcttaacccctcagagttagcccgagctggccacaactacatcttcagcctaatatctttagttctacagttatggatcccaccttaatcaagctgatttactcactgtcccagagcacctctgaccttgggctcacacccttccctactcatcaaccccacagatggttaattacttctcaaaacttacctcaaatacctaacctgtcttatgttctttcaaaccatctaagccagaaattctgtatcccttctttgaaccccgatggcattgtctatattcttgttttgttgtagtagctttatttagatgtaattcatatgccctacaactcactcttcaaaaatatacagttcaataattttttttaatattcagagttgtgtaaccgtcattgtctgtttagaatatttcatcacccccaaaggaaaccctgctaaagagcagtcatctctcagttcccctcacaccaccctctggccccctaaccctgagcgatgactaatctttcgtctcttcggatttgcgtgttctgaacatctcatataaatggaatcctgtaatatatgggctcttgtgactggcatcttccacttaacatgctttcatggttcatgcatgttgtagcattatcagaacttcattcctttttaaggccaagtcatattccattgtaggatctgccacatattgtttatggattcatcagttggtaggcatctggattgtttccacttttttgctgttatgaattatgctgctgtgaacattcgtgtacaagttgttgtatgaagtacacgtttttgttgttttgggtatatgcctaggagtggaattgctgtattgtgtcgtaacttttttgttctattcttttggcaatatgatatattctgatacttaaacccatggtgtttcgcttaacactaatacaccttgcctcccctaggaaatataaacccttgagagctgaaaagaagccttatttctttctactccccccactaccgaccactgtgtctaacaaaagccacaattactgtttggactcaaaaatgtgacggaaagaagtagacacttgtgaagtttttttcctctctttctactttaaccctaaactgtgtcacattttttcgcgttcacactgtatgtgtacccttttctgaaagtgcttgtcctctctgaggccccagtattggaggctactggatgtgtaagtagttggtatacagcacctctcaggtgtgaccattccaagggaggagatcagcttccagcatgtctcctccagacaacaatacacactgtcctcctgctgaacagtcagttgtggagtaataatgcacctctgcaaggctttgcagggtttttactcatgtatcaccaaggatgaaaatggggcaggacacagtagaagccgttaaaaggaaattatgtcttcttgccttttctcccttgatcagaccctaagaaaacagcttacccaaatgagcggaaagatgccaggtttataaaatggagtctagcagctgtctttggttctaccttgggatgaggttagaagtattgtttcccaaactcttgcggcgggaagatctgtactaggtgggactgccggtaaatcactggggaggagaagcagctgctgtgaactgagtggtgtggcaactctggcttttgattccccagcagcagatggcaactttgagtaatgacacacacaagatagaggctgtgcttccttatctgaaatgggaatttcaagtgaaagataactggagtctcttcttggggcataattgatctttcatgagccattatccagggtttttacagtacctacaaaaattgttctgtacccaggagttcaataaacactaaatgtgtgaaagaatttgcattctttgcctccggatcagggggaaacatttccggaacatacattaagaacttcaaattgcatagcatttagtaggcacaaagtgactatactagttaaggggtgacagatcaatttcaatttgtgtgcccctcgcttatgggtgtttggagggttgtgttgggaaggattgctgaggccagttaataaataaattaatacattggttatgtctgtcatgaacacctaagagactgtgcagtggtagcgcttgtgttgaatattttccctagaccttgagctccttgaagggcaaggactgtgtcttagataatataccctcaggaccggacctagtgcattgcctggtatggaggaagtaaccggtaagtatatattggttgaatgaatgatttgatttcctagtttttggaattggcccatgattctaagtgaatgagctcacctcagatgccttaatagtaaatgaaattttgcagcagaaatattttctaaaatacattgatttttatggaactagtgtcttgttttcaaaacagccctctgttttgctacaacaaaacatttcaagagtttcaaatttaaattggctactcaaagccaatttcttcatttttttcctatctcagtggtctagaggggcatcttggtgttttaagtggaacacaggcttagaagtcagacttgggtttttttgttttgttttgttttgatggggtcttgctgtgttgcccaggatggagtgcagcggcaccatctccgctcactgcaagctccgcctcctgggttcacgccattctcctgcctcagcctcctgagtagctgggactacaggcgcccaccaccacgcccggctaattttttgtatttttagtagagactgggtttcaccgtgttagccaggatggtctcaatctcctgacctcgtgatccgcccgcctcggcatcccaaagtgccgggattacaggcatgagccactgcgcctggcctagatttgggttttacttacagccagctcagctattaacacattgtgtgaccatagctagttacttctccatgctggaactcagttccctctaaaaaattggagaactgaagcaaatgagctctgtaattctatgaaaataaacgcacaggataaaaaaagagaacttgtttcaacaagataattctctgtctttggcctagttgaggggtccccaacccccaggccatggaccagtactggtccgaggcctgttaggaacccgatcgcgcagctgtaggtgagcggggcaagcgagcattaacgcctgtgctctgcctcctgtcagatcagcggagcattagattctcataggggcgggaacacaattgtgaactgttcatgcgagggatctgggttgcccgcagcttatgagattctaacacctgatgatctgaggtaggacagtttcattcatcacccccccatctatggaaaaattgtcttcctcaagactggtccctggtgtcagaaaagtttgggactgctggcctaggcgatcacttctctcatttcagcttcactttctgacacaggagcaataatcctaaagtgaggagggggagtcactttaaaaaaaaaaaaaaaacagcaaaaacatcagtcattatggtgaaatgtcaacacagtaagtcttttctaatatctctgcagaatgctacatgagatttgccctgattcatagatggctatggtatgtgtaatacataaaaatataatgtatcatctcagacatatgtcttggctgacattcagcaccaagaatctgacaaatgtttttatatttatgtacattctgcctgatttcaaaaacagatttaagatagctatactcaacatcatagaaataattaattctggacgtctttagaatgagaataaaaacaggagccaagtgtttttttttttttaagtgattatgttaggaaacttaaactctgagagcttccaaaattcaacatgaattgtaacttcatggttcctggaagccagagccaacagggaagtaatgggctgcctagctcttcttgtctgataacagccagagtaatgggctttgtggggaaaaggaaatatactggcacaattctacctcaggcctgttctgatagccttttgtcgaggcaatagccattcgttcataatgaaaccattgaattacaaacaagagtggcaacatagaccaagccttatttgtttgtggggattttactagttgtttggtagactttagccaggccacgtatagtaacagtagatgatgcttaatgtgccagatgctattctaaccgtattaacatattaaaaatccttacaagagccctgtgtgttaggaacagtgctttggggtctgtgctcttatccactgcaccatactgcctcttacatgtctcaaatcgtacagagatttatcttactgcagtcacacagctcagcatcccaactctgggtgatctcaggaaagaacatctcatttaaagcaataataaccagtttaaatgtaggcagcctcagtgctacatgaccaaccagatggatcagctgtttacttattgagtccactggttcttttggcgttgttttaaggtggcttcttgaatgttaaaggaacaatctaggctctatctgaacctccttttgcatctttcattggtgacatgaggagcatacataggccatgtgtcctcttgtccttcggtatcttatctacctttgggctgctaaatatgccaaatcagcttctcttgtgtgccagctcactcagcaggggtggctgcctagaagactgtgttgagaagggctctcaggcctggctcagatgtcgtgagagaaggggtcatgactgagcaacaatgcctgatgtgggcaagggagagggtagcaccagagcgttgcctttgccagccatggcctagttcaagatgagggcttgcctctatgctgcatggcttctgaggttattttccctcagagtacttcccattcaagaggagaacagaatgtagcaattcacagaattcattccataaaaatgaattccctccctgtacaagacacacaataggaagattaataagtcaaaatccctgccccctcccaaatttcatcccagtcaaggacatataaattttgacaaataatatctatacagtgagataatgattattcttataaagtactgagggaacacaaacaaaagagtcactgtctatgcctggtaagggcagacaggtcaggctgcatggagaaggtgccagttgaccctaaccctgattccatccatgtgtatggagcccagagggtgtgtgttttgagaaccacctggtatgaccaacatcctcaatatgtctttgcaaccttccttttcagaatatatacagtaccaccagtagtaagtcatctttttggagtcttgatataatgacacacatgagagaatggatgaatccaatctaccacaatgggtcaatattttagaattttagctgtggcaaagacctttagggaaggcaaagggtggggcagggtttgtggaagccatggatatagggtgtcagtgctgggcaggttgaatagacttttctaaaatgaagtggaaaaataagaaatgcagagacagcctgcactggcattttacccaaggccattctgtgtcccttaggaaatgtgttctttacagggatttgaaaactatagggaatagtgattggggtcagaaatggcatcactggggctaagaaaccaaagataaagtcactttggagctaacctttgtattcagagagctttgtcctaatcctgcttagaatttccacggcgtcttttcttcccttaagagaaatcaaaaggctttcacttttcccctctctgccctgtgaagacaggcattcaaaacctcgttttgcaggttaaggaaattgagttcatggtctaagatcacagtgaattgaacagactcaaaagcaagcatttaatctctctcactctctctcttaaatgtagttcttagaatgagaattcttagtggttttaagaaaatggtaatgtttgtactataattaacccccagaaacagaacatcaaaaccaagacactttggcaatcgtcttatccaatgttctcattttaaagatgtggactctgggccgggcgcagtggctcacacctgtaatcccagcactttgggaggccgaagcgggcggatcacgaggtcaggagattgagaccatcctggctaagacagtgaaaccctatctttactaaaaatacaaaaaaaaaattagctgggcgtggtggcgggcgcctgtagtcccagctactcaggaggctgaggcaggagaatggttatgaacccgggaggcagagcttgcagtgagccgagatcatgccgctgcactccagcctgggtgacagagtgagactctgtctccaaaaaaaaagaaagaaagatgtggactctgaatctaagggacaactccaaataactcgaggatatctggtcattaaaacctactcggctctcaaggtttccatttctaactggaagccattgccttcaagagctgtttaagagcgtctgccacccttctagaactcagtttaaggacttctgctggagccttggaaggttcagggccctctcgtcaccattgctaagggctgttttatgttcttttatgagatagtctgttaggtgcagccacaagaaggagacacaggagaggctcaggaagacaaagtttatcgtggtcacaagtcctagaggcaggagacatggcacaccatgcaggtccacaggggaaagacaccagggcagtcaggaggcagaagacaggagcaaggggaaagcattaaggtaaagccatgatgggggtttccttggaaaagtcaaggcagggcagcgtgaacactttagggttggctagtttgaataatctcaggggccctaagctataggaatggtccctagttgactgtacctggccctgggatgatgaaagcagaggaattttgcctcttcgggtgttgggccagatagaggaggtgtggctctgaattggttagttcgcatgtcagaagtgtactcctggctgggccctttgctggctctaagaattaactatcctctcgccacccccccaggggcagtcttcccagctagaaaggttttttaaaagatgttcaaacatcgtaacatacataaatatgtaacacaagggccctggctcctctcagatatttttatttatttatttatttatttatttatttatttatttatttatttatttatttatttttgagacagagttttgctcttgttgcccaggctggagtgtaatggtgcgatctctgctcactgcaacctctgcctcctgggttcaagcgattcttccacctcagcctcccaaggagctgggatgacaggcatgtgcaatcatgcccagctaattttgaatttttagtagagatggggttttgccatgttgatcaggctggtctcaaactcctgatctcaggtgatctgccctcctccgcctcccaaagtgctgggattacaggcgtgagccaccatgcccggcccctctcagatatttctatccattgtcatactcccactctttccctaactactactgacttcagcttgcagcagaaaattcagcctttgtaagcttgagaggactcaggttgctgaccaaaagcagaagaggcctcccttcaaaatgtatggaatgttgcaaaaagtagacagtgatcctcaataatcagatacttccctcagaatggtctgctaaaccttcagtcttgttgaaccaattggttcagtactttgtaacagaacttgggaatttctccaccctggatgggatatttcttatggcctcccatcccaattcatgtcagcccttcccgcatttagacttggttactttcaactctttactcctggcatcatttttaaatgattcaggactcttggtttcaagtgacataaacccaccttgaattatcataggtggagagtgttggagcattgaacataatggaaagaaaagttagcttttttctacagttctgataggaacaggttctctccctgcagactggcgtcttctgctagacaggaagtgtgactactggcagctccagagcctcataatccatagcttcagttgcctggcatgcactggccctggacttctcacaccccaaactctcatatgtgggcccagctggctctcttgctcattttgggaccagtcaagttagactagagaggcagagtctgtaaaggaacgtggttggtgtgggggaaaaagcagtttccataagaaggtggtggtcccaggaagacaggatggtggcaaaaccaaaggtgtttgtgacaaacctgagagcatatcaggaagaggaatgattaaatcatttaagtgacaagagcaggttgaaaaacaacaggtgtagtatgcttttgtaaaaaaattggccaggcatagtggctcatgcctataatcccagcactttgggaggccaaggcaggcggatcacttgagcccaggagtttgagactagcctgggcaacatggtgaaaccccatctctacaaaaaatacaaaaattggccaggcatggtgttatgcacctgaagtcccagctacttgggagtctgaggtgggaggattgcttgaacccaagaggtcgagactgcagtgagccatgacttgcactactgcgttccagcctgggtgaacgagcaagaccctgtctcaaaattaaaaattaaaaaattatgtattcagtaaatcttttctaattgactttccattaatggaatgtcccagttggttaactccgcaccccctcggtaaagtacggggggaggctgaacattcttagctggcagcctggttcctaggacaccagcacacttctgctcccaccagctgaggcctgggctttccaagagtcattcttgtttcttgccaaacctgggaatgccagatggacttgttgttttaattataccatttaattaaatatcccccaaacgaaagacaaatacagaaagttatttctgtgaaagtcattgcgagtagctagaagcagtggctttttgcagaggggacagggcttttaccttttattgccgaataggttctggagtctgaccccctattttcaaattatagctctactgcttctttgctgtgtgacaccttgggcaagttgcagagtcatcctaggacttggcccctttactataaaatggaaatagcaaccttgtttgggtactgttaggattaagtaatataatgtatttgaagcactttgcacagttcttgggcacatagtaaacactcaacagatgccacatctatcatcatcgtcatcaacaatcacagccttattaaagatgtagagagaagtcattggctgtaaaggaaaaattttttttcttatcaaatcaatctctaaaaacctaaagtgtgtgtgtgtgtgtgtgtgtgtgtaaggacacctccagagagttctagagctgagtgaaaacctggtttattaaaatgagcctgggccgggcacagtggctcacacctgtaatcccagcactttgggaggccgaggcgtgtggatccagatcgagaccatcctggctaacacggtgaaaccccatctctactaaaaattcaaaaattagctgtgcatggtggtgggcacctgtagtcccagctactcgggaggctgaggcaggagaatggcgtgaatccaggaggcaaagcttgcagtgagccaagatcacgccactgcactccagcctgggtgacagagagagactctgtctcaaaaaaaaaaaaaaatgagcctgtaagtctgggtgcacatctgtaatctcaacactttgggaggccgaagtgggatgattgcttgaggctaggagtgtgagaccagcctgggcgtgagtgaaaccccatgtctacaaaaagttagtaaaaaataataataaaaaataaaaattagctgggcgtggtggcacacacctgtagtcctagctacttggagaactgagggggaaggattgcttgaacccaggaggtcgtggctgcagtgagcagtgattgcaccactgcacaccaacctgggcgacagcgagaccctgcttcaaaaaaataaaaataaaaaagcctgtagcccctcttccttccctaatatatttggcttctataaaaattaaaaacccagggataagaagaaggggagagaattggaaagcccctggttagctttaagggcctctcagtgcagcagaacccatgctggctctattcataactttgctctctggatcaatattctgaaagttggtacattcttttcatttgtgtctttcacagagggcagtaaaatttagctctaattatatttagggcatctggattctagtcagcattttctggctccgttttagaacctaaagtctgcggcttattcctaatgtggaaaatggaataatcccccaggcatgagaagaactccagcattgaggctgctgttcctctagcgagaagctgctgcagacatcacaagacttgttatacaaggaaacatgattacagtggattaaagaaacttgccaggggcttgaaggatttattgctttttgaattctgaatgagacataaatatgtttttcccctcttaattttggaccccatacgggtaaggtgagaaaattcttcagcaaattctagaatgcttagctgctaaagatcagttggttttgtgtccacgtcatattgcaaagggcatgaatacttgcttggcagagacacaaaacagtcactcatttctttctgttctgccaagttagttactgccttgtctcccagtgggagaaaaatgtaactccttggggactcttctggaaggcagcatggtgtaatggaaaaagcactgtagtcacaggcacgaggcctagactacagcgtcggtgcttataagttccattatttacaacaggtttcttaaactctgtaagcctttgtgctcttactgctcttttcggaaaaagcagttctcagagggttgtatgaaggattatagcacctttatgttcaatatcatctatagaaactcaactgttggatgcattagcatcagaatgacagcttgtagtacactcatttgtgttcacagatctcagaaatttttatgtcctaaatggagggacttttaaaaataatgatggagctgggcatggtggcacacacctgtaatcccagcactttgggaggccgaggcgggcagatcacctgaggtcaggagtttgagatcagcctgactaacatggtgaaaccccatctctacaaatacaaaaaattaggtgtggtggcgggcgcctgtaatctcagctgctttggaggctgaggcaggagaatcacttgaacccgagaggcagaggttgcagtgagctgacatcatgccattgcacttcagcctgggcaacaagagtgaaaccccatctcagaaaaaaacaaaaacaaacaaaaaaaactgatggcttcttaaccctatcacttctgcagattctttggtttctcaggaagccaaagagatagcatggggcagtggttagtaacaactctggagtcagaccaacctgagtttaaattcactacttattagctgggaagtctttgaacaactcacctaacctgttgttctcattttcctaatccgtaaaatggacataaaatattacctcaaccgtaatttgttttgtttcgttttgttttgagatggagtctccctgtgtcgcccaggctgcagtgcaatggtgcgatctcggcttactgcaacctccgccccccagcttcaagcgattcttctgcctcagcctcccgagtagctggattataggcatccaccatcgtgcctgactaatttttgtatttttagtagaggcggggtttcaccatgttcgccaggctggtcttgaactcctgacctcaggtaatccacctgccttggcctcccagagtgctgggattacaggcgtgagccaatgcgcctggccctatttttttattcctttgtcctgtttcctatgtgggacttatcaccgtttggcattattatttatttgtgttctgtctaccaccccagccccactcaaatataatccccataaaggcaaagacattatatgtcttatttactgctttatatgtcttgcctaacaaagtaactggtacattattgttacttaatatttttacctttgaatttttttgccaaaataatacagaattagaaagaattcctcccccagtgtcatggctaaatttatatacagtagctgacttggaaactgggcagagttgttttgcgtttggaaatactggtgttcttacagttgagtttctatttccaaaagatgcttactcagcctttgatggcacagtttgacttgtgacatcagaaggttgacaggcagaagtctgagtcagaaattcagctatagaagagcgtgactttcatccctgctcgccctttgaggtatggctggacacagctcagaaaggtcttggatttcaatttgtctaggaaggtatttagcaaattatttttaccatttggattttggtaccaatcacccgaggaatctgcagtctctgcgtaagtgaagaatgagaatggaaggggtaagtggagctagtgggagagcacaggccagcccgccacttccctggaagaactgatggctttttccaaggcctggatcatgcctcgcctatcctcctccccactccatgtccccagtccatcctctgacttttatttacttaccaccttggaagtcataagattctgaagttttccacagctgctgggacttaggcactgggccactgaggacaagctgacaggtcagtgtttgggctctggatttcacatcattcattagccctctcgatccccacagagagggacgttcatgctatgaactgtgtcatggagaaaacacagccctagaaagaggaactcttgatcccccactacttcattctttcaagccctgtgacctgttcctctaaatgcctgtgggaccacaggtgggcttgggatggggatgcttcctgaatgcccagggactgtacgcaaaatgttacgtgtgtgtattatgggcagccagggaggctcggtttcatcagactctcaacagataccatctttggtctaaaatagatttggaaccatgaccctgagtggacctaatgtatttttgtaatgtttgtagactgcacatttgcccctctggccctccaggctgtgtgtgggcagattgaggatggaaaagctgaagcggtgcacagctgcccaatcttgttgggttgttgcatgatggctctctcatctcttcttgagtttgcttatttacacaattaagctaggcccattgtgaatcaagtcctgacctgtcaacagaagatgagatggttgaagagggtagcaggcaattctgtgaacaaaatatagctatagatctggctttaagagtaaaataaggccgggtgcagtggctcatgcctgtaatcccagcactttgggaggccgaggcaggtggatcacctaaggtcgggagttcaagaccagcctgaccaacatggagaaaccccatctctactaagaatacaaaattagccaggcgtagtggcgcatgcctgtgatcccagctacttggggggctgaggcaggataattgcttgaacccgggaggtggaggttgcggtgagctgagatcgtgccactgcactccggcctgggcaacaagagcaaaactccacctcaaaaaaaaaaaagtaaaataaaatcatgccaccaacaaacctacctattagtccactgattttctttcctctgtgacaaaatgttcatctccatactcttaaaggagtgatgatacacttggcctttcacctgaggaagtataggatgggagctgcatgtcccagctcaggagtattgacgttcctcttctcagttagccctgtccactgcagcccagctaatgtcttacaggctattagagatggtgtactggggccaagcatggtggctcctgtctgtaatcctagcactttgggaggctgaggcggggtagatcatttgagttcaggagtttgagaacagcctgaacaacatggtgaaatcccatctccactaaaaataccaaaaaaagtagccaggcatggtggcatgtacctgtaatcccagctacttggaaggctgaggcaggagaatctcttgaacctgggaggcggaggttgcagtgagtgagattgtgccattgctctccagcctgggtgacggaacgagactccatctcaaaaaaaaaaaaaaaaaaaaagagagagagagatggtgtactgggctgtgcgtgcttcagctacccaacaaagcacctctaccttgtgcttacaacgaaattcagttaactgtaagatctggaaatccctggcaagtgaaaagctgctgcctggtgtgagtatgtctttgttttctagcagtgcaaattacttcatcttcagcaggagtgtggcacctctgtagtcacacatcacttaacgatggggatgcattgttaggcgattacatcagttgtcatagaatgtccttacacacccttaggtggcatagcctgctacatacttaggctatatggtccagcctattgctgctatggtggaaacctggatggcttgtgagtgtactgaacactgtgggcaactggaaaacaatagtaaggatttgagtatggaaacatagaaaaggtaccacacaaatgtggattttgtaatcttatggggccaccctcatatgtgcagtccattgttgaccgaaacgtcattatgtggtgtgtcactgcttactgagtgctgataacatgccaggctatgtgcagggtgctctacaaaatctatcatgtttcatcctgtccttttcctgaagtaaatgtcagcattcccattttacagatggggaagttgaggctcagaggtgtgtcagtgaacaggtctaagaaaatgtgtgggctgacataatgtgagggccacaggggccaccagaggacatggagtagaggccttccctgaagggcctcgggaactgagccgagccaggagaggagatgggatttaggctgaggagagaacacttgggaggagctcggactccaagtctgaggaaggcaccggcatttattactttcttgccgtattactctcgttcagtctttctcctttgaggtgcagatagtccccttctccagaattattctccagtcatctgcatgggatttgttttcagtgttttttgaattagaactgtagacacttccctcctagcctggcttttctccatcaaactccccatagccatttctcattgactagagcaggccctagcgagcccagcccttagtctctgtcccctccaggctaccctccatggtagcaaccaggcggcccttttggaaacacacatatgaatatgttactcagggacttccaaaggctggctagcctttgcttcagaatgagatcagctcttcagcatggcagcggcagacagctcctaccgctggccccagcttcctctcaagctggccctggcgctctggactcctcacacttctgcctggcaaacacctacttggtcttcaagccttcattcttcatagaggctacttgggttctgccccacacctgtcacctgaattgtcattatgtgtgagctccttgagaaaaaatatatgacttggtcatctttataccctcagtacctagcataacacctggcatgtagtcagcacttagtaaaaacatttaaaaaatttttactgtctccattttgcagatgaaaataagaaactttaaatgaataaaatgtttgactcttggggtcaaggccataataattagaaagtctcctttcactgtgtgttgtctcatttatattccccaggtgatggtcaaatggtataagaaatgcaggtggctccccagtctcggtgtctcacatattccaactctttttttttttagaactcagaaaagtacttcatagattggctttttagatttcttttttttttttttttgaaatgtagtctctatcgcccaggctggagtgcagtggtacagtctcagctcactgcaacctctgcctcaggttcaagcgattctcctgcctcagcctcctgagtagctgggattataggcgtgtgtcaccatgcacagctagtttttgtatttttagtagagatggggtttcaccatgctggccaggctggtcttgaactcctgacttcaagtgacctgtccacttggcctcccaaagtgctgggattacaggcgtgagccaccacacctagcctttttcagataatttcttcaagattaaactctacaaaattattatattagtctcttttgtttggaggttagactctcacacagatttaagcaaacatgagaatgtatttgttcttaaacctgaaaaattcatggagagttctaatgtaacctccactagatccaagtttttaaaaatgtcaatagcaaactttccatctccccctcttgcctgggttttccctgtatcgcttcatttttaggcaggctcttgcctcctgctagcaagatggcaattggtagctccaggcttacgtccccaagcttagtgactcctgtggaaggagagcgttgttcccaatggcactagctaatgtcctgcttgactcatccaccagtgaccctgtcactatggtagaggaagggggaactgtaactctttttggtcggatctgggatatattcttatctctagggttaggggtggaatagtcccacctaagtcacataatctgagagccagggagaaattggtgaaaaattagaaaaccggtgagtttatcaaagggctgagcaagcagagcaacagatgtccactgtggttatcttacctttcttttttgttgctaatacgtctgttatttcctagaatggtatgatagaccccaagcaggtggcttgtgtcgtccttttttggtaaatgcctacctcccaggacttttgaaaatggttcaactgctgtctttgacttttttaccccagcctttgtgattggtctgatagctccagtgtttgtgctggagacttggaatgccaaatgcgctgatttgcacaccgtttttcatgaaatcttatttttcttgataagatcagggaatccttaaaattcccagtggttttgagctagaatcctattgtgagttctctgatattacatagatttaaagcaaatgcatttttcaggagcatactttcctttcactttttttttgtaactaatcaatgatttctgacattcagtgactgcttgcttctgctattaggtgactttctgatattcagccctgactgccacttgtccctctgacctagccataaaatactaatatttgcagctccctcttatatggtgaggaataataaaacattatagcactttgggctttgtttcatttcttcccattgatagcttttttcctgccactgtcagcatagctatttcccagcatgtttttccctccagttctgcagccacatagtattttctgactgctatcacctacccaggaagaaaattgtcacttactgagtacctgttttctgttaagtataccaacaggactttcctgcaaatcatcccatttatttttcatagcatccctttgtgggatggatatcattatccccacttaaaaagatgtggaaagtaaggctaaagggaggataaataatttgccaaatgttttagaacggatggaaaaactcgggattcagttctgagtctactaaccctgaaaggccgttctccaagaataaggctagaagctttaagatactggaaaagtatgagaccccatttctgacctaaaggcaaggatcaagactaacacatttgaaacaatgagagtgaatttaagatagagtcacttctgagtgctgtgtgatatcatctatttgcagtgctgttgaaattcagaaaacagttctgcctccagattctatttatctttgaacctgactgggaatatatattaatattaaatcaagactttatttttaaatgtaaccctagtgccagtttcataatataccaattcactatttggttactgtgctgtgctcagacttctgttgaaccccaaaacatcagcgagccctcaatttctgtgcatacgttcaaacctcaggtcccctgctttgtagatcccgtgaactccctgataagcacaggtcacatttaccaactcttcattatacatctgatttggcaagacagtggccaggggaaggtgttaatctgtgcccaggttatatgccacttagttgagttcagttcagacttaccaagtgtgtagtaagccaagtgccaccacctggcaggtgatttgcagggctcactgggggatacgacatattcatccagtgtcttctgaatgctcagcactcttctaagcactggggacagtggcaagacagacaaggcagggcctctgttttcatggagcctacttttctagttctataaataaatgaaaaaagtcactttcagctagtgatgagcacagtgattaaaataaaacagaggctggtgcggtgtttcacacctgtaatcccagcaccttgagaggcccgaggtaggtggaccacttgaagtcaggagttcgagaccagcctgggcaacatggtgagactctggctctacaaaaaatacaaaaattagctgggcatggtggtgtgcgcctgtggtcccagctactctggaggctgaagtagaaggctcatctgagcacaggacttggaggttgcagtgagccaagatcataccactatactccaacctgggtgacagagtaagcccctatctccccatctcaaaaaaagaaagaaagaaaacagagtgtttggatgaattggtgtggagggtgggagtcgagaatagatgtcaggagttaatataaactggcaggttgtcagtaaaggtccctcagagtaagtggcttctgagctgagcccggaatgcaaagaaaggagccagacatgtgaggagctgagatgaccctcgtctaggcggagggaacatcccatgtgaaggcctaagcagggaataagcatgctcagtctaaggatggggtgggagtggggggccggagccagtatggcagcagtgcagtgaattagtggggagtggtaggaagtgaggttggcaatagagggagcacgtgacacgggctcttgcaggctgtgagacctagcttatgttgtgtttgaagcaggagagtaacaggagtgacttaacttttttttttttttaaatcctggccactgtgtggggaatggattgggttatagaggagtagaaataagaaggtttggggtgaatgctgggcaaggtagattatattgttattgttattgacatcatagaccaggccagggaatttggatttgctcctaaagctaatgatgtgtaacaataatagctcccatctcttgaatacctactgtgttccagtcatgcgggtttatgtgcattccctcctcaagtccttatacacacccacaaagcccctatccactgggcttattattaatgtcacttcttataaaggaggaatctgaggtggacagagcctaggttctgagcattccttagtgaggaaagggaaccagagctgcatgatgggcagggggctggcgagatgcgtcaggattcacatggcaggacctggagtttggcagggactttgaggtgcaaaagagaagacccctgttgggagcacacatcccagggcggcctgcatgtaaactgctgggaaaagggctgcgggggaggcttagataaaacagacgcggatgctaccctctgcagtctgcagatcagcaggtgatcaggtagacctctcacccaaagcagaacatggcaagctcctgaaggagaatttgttgatactgttaacttagcatgtcagaaaaatgtcccagtgtcagaattgaattcctatacctgctaggtcagttttaagctaaaatgatcttgcaaaacctgttgacccattgataccctgtaccctaagtaggcagttggtattatttcttaactttggttcgtctatgtccatctctctgtctctgagacacacacacacacacacacacacacacacacacacacaccccctcccagagtccgagcattctagagtttcctaacagtgcagttgtcctgtctgaaatgtttacattggggaaaaaatgaacccctgctgtgattttatttccccacaggctctaggggtcttttcatagccgcaaggcatcatcacagcttcccaaggactagggtgtttatgtgtgcacagaaaccacactgcaaagggtcaggtcctctcctttgtaccctaaggtgtagagaaagctggacctcaaaactgatgtcacctgtaagaacagtttttgctttggttctggctttttcttttccttcttccttgagagggcttactatgttgctgttagttttctcccagcattcattcactctagcaaaatctggctacatatcagtttgtagaaaatgggcacaattctaggaatagctgtcctaatgtgttagctcaatgccgtggatgcgtcaacaatggctggtagctgccaccagttgacctgaactttatgtggtttttctttttttttttttttggtttttccttagatgagaactactgtttgctagagctgagataaaaccatttcaattagaaccttgtatcagaatataattactcctcccagagatagagtcctggcctgaaaagtgagtacaaaaaataaatagggacaaatagaaggagaatgattactggtacaaggtagatggaatggtaactcactttattctcaatgatgttatacaaatcaaataaaactctattcccatttattttattttagccgagtattcttgtccaaaatgaaaatcagatgtttttcttctttttcatttttttccaaagcaaatggttacaaacacttacttaatataatttactggagcttttttctgaaagaacatttatgttaactttcttttatgcatgtagtaacttttgatcaaaacatgactccactcccttgtttaatgttgagcatctggattaaaggcttcttttaatcttaaatacagattatggccctctttccctttaagcaaactgccataaaaccctggcacctttccagttttccttattaaagccctctttattacagtgttttccgatggcagtcattaaatgattgttatgcacaatgggcacttgattataattatttaactggcaatcagttattgcagcaatttggtggtgtaattaaaagggagcatgtttgtacctgccagcatctttgagatcttcggctctggatgaagcaggagaggcagaacataaacaaatggacggaagaatcaagcacttctgtgaatggaatcttttattcctcgcccatctgattcttggctgctttgttccataaggtagatgaacaatgatgataaaataaaatgtaaataagaatttttgtgctacaaactcctgaatcgataaatacgttcagtaatgaatgtaagtttctccatgtgctgtgaaatgctaaatggatagaagtgtatttatataattctatttcttttaaacacaagcatcagcatgttttctccctctaatttataaatgtcagcacttatttcttgatatataaattgatacaggatgccacaaacaaaaagttgccgcaaaagataagggcgtttgttagacacagctggaaagctttttagtcactatagaagttagcaggaatgtgattccaaagttaagatggccctcctgagttattcagaactctttcagttgtaagttgcaaattttaaccaacctgaacaagggggaatttttttgcttatgtagttggaatgttactggaactactcataggattacaggaagaactgcaggaaccaggactcagggctaggaactgggaatcagtacagcctagacgcattctctgtccatgtctcagctgagcttgcctgtgtttggcttcattctgagaatagtcttacagcttatttctccctgtggcaggaaacaggcctgatatcagtagccccagactcccatcttcttagcttaactccagtggaaagcagtctctatcttctacctttcataagtcagtctcgggaaaggattctgattgcccctacttggctcatatacccatccctggactaattcctgttgccgagtaaatagcacagtatgattatcctgcctggatcccatgtaatacctgtgggtagggcaaggaagttggagtcctgtgaccgacagtcttgttagagacattattagtatgaccccatcggtggtagctaatgactgagaaaaacatggtgattattttcaaaaatgagtatgaaaatctaaagtatccaaacttaaaaaaaattatttaaatgttttcccagaatgaatctctatctctcttttagaaacatcccattttgtaagaccaaggtatgaaagtattcatctgagtttcaaatgattgcctaatcttacctgtaatcattattgagaaccaaacacccattaatggtgtggtctaaggacaaggtcctgaagagatgagactggcgcatattaaagatgcctgctatgatgatgtggctgtcatggctacattatcatgagggatttggaatctggggttccagagagcacgtttttagccactatctctgactattaaatcacttacaacagctttggataataaaattctctgtttctctcttggtttggttccatattagaatctgcaagtgcaaaggcaaaacagtcagcaaaacagcagacttaaatagaaaaaagccccaaaaggaaaggaaaacaattgaaaatttaaaagaaaaacacccccacccccaaacatgatctaatcagtcttccttatggagaagttatgaatcatcctacttagcaaataagacaattgaatgtgcaagcccaaacttgaattaaagttattctcaacttcctgtttctcttattaacatgcatttattatttaataagtatttatgtatataattgagatatttaagctctgggtaacttaagtggctgtagagtactacctgaacacacaaggagaaataaactttgaatatgtgcctgtatatttacaacacacacacacacacacacacacacacacacacacacacacacacacacaattttttactttgtggatactggccaccacttgaagagtttcttgggaatctaatcttctcaatggcaggctccagcattgcctttgccagtagtttagttcatatggacttgatgccaattttcttttcacatatatgaaataacagtttggcacatagtaaataaaacagtgattccacagagaagactggcacctttcaaaaagtgaattgggcaggttcagagctaattttttctttaggtgaactgagtttaaattaaatgttgcaagagattaccatatttgtgtgaatttcaagaagtcaaaggccgtggcaataaagtattttcattttatagagtttttcttggaaaggccacacaccatatgacagcagagtgcttaaaacccagagcctggtgccagcacaaaatccaaacatcgtaaagttacttccaaagcccagatattgaccgatcccctctcttggagcagtgcatctttcaactagtccaagtccaccagcccagaatcaccctcccagcctcagatttcaagttggaagcccaaagtaaggcatgttttctaaaaaggaaaggaaaagctattggatagcaattgtcaagagtcaaaaaataaataaataaaaataagaataaaataaaatcatccccaatggaggagctttagcaaaagaaaagggagacatgccattggtcactgctgcatgtatgcattgtccctcggttggtttttaataaacccagctaacctccctccaccaaattgcctgtatctctccttctccacttagggctgtgtaccattactagaatatgaaatagtgatttgaaggggtcatttgttcaggttttccaggcttctgcactgcctgccctggaatcaattttttttttttttttgagatggagtctccctctgtcgcccaggctggagtgcagtggcacaatctcggcttactgcaagtcccgtctctggggttcacgacattctcctgcctcagcctcccaagtagctgggactacaggtgcccgccaccatgctcagctaattttttttttgtatttttagtagagacggggtttcactgtgttagccagcatggtctcgatctcctgacctcgagatccacctgccttggcctcccaaagtgctgggattacaggcatgagccaccgcacccggcctggaatcaatttttaaaacctgtctgggtgtgggtggcttatgcctgtaatgccagcactttgggaggctgaggtgggaagatcgcttgaggccagaaggagttcaagaccagctgggcaacacagcaagaccctgtctctacaaaaacatttaagattggctgggcgtggttgtgcatgcctatagtcccaggtatttgggaggctgaggtgggaggattgcttgagagcattattgggagggggtgcgatggtttgcggcagggggccgaggctgtagtgagccatgatcacatgactgccctccagcctgggcaacaaagtatgagaccctgtttcaagaaacagacaaaaaaaccttacaatctgtgctcactggtttcctcgacttcacctaaagggtatctgggaaggttctgcctcccctctgggctgggaatgtatgcagaagacttctttgaaagctttgctcacaaggacttgaaacccaggcttctcagtgaatttccataacaattcactgccaagtcacacaaatctgtcaaggaaggctttcctgggagagcgaggagggcctatccactgggtgacagctcggcaagtagcctccagtcctggccggctgggcctctcttcttcccagtccagcattagacttcactaccacctgctaatacatctgaggagagcaagaggtcctggtcacagcagatgatcagagttggtgccaggagtgtaaacaagtcataaattactcttaattcttctaggcaagggatactattagtcttcagttgtggaaaaaatgtactccctttaatgtcttatttatgtaatagttgatcctcttgtatgactataaatttgttttcttcggcaagcatttcccaagcatgtgctttgtgcagagcactgtgtaagcacctactgttgagaacaaatataggagttagggtttaaccggtacaaggtttcagctgggggcagataagaagttctgagatggatggtggtgacggttgcacaacagtgtgaatgcacttaacgctactgaactgtgcagttaaaaatggttataattgtaggttttgttagatatattttacgatgataaaaaaatttagggttcttacacttttttaaagtcaaggtgaactatgtatttgctgtaagttttaagtttcacatatttcccctagcaaaatgtaagtgtatgtgacttaccacaaagacctagaatttcacatttcttatattttacgtgcaggtgctgaggtcattatttctcagatttgtcctgttatgagaatattacctaagatcttatctaagttaacaaattattatcctttgcatcagaaataagagcaggatctcctctaatgaattgtataacctttcctgggttgggccttggacttaatgtcagcaccaccacagtgccaagaatgacgagagctttgttgagcttggagcacagggcttcagctcctatcttgagacttggtgaagtggataaagccctgagctttaggctctggttcctgcctctgcctttgagtaggggtgtggctgtgcaccagtcatttaatctttgtggaccgcagtttatttatctgtaagatgggagtgaaggccaaaggcctttggcctggcaagagttgtcaggcccaaacacgggaatgtttgtgagagcacttagtgctatgctggggacctagcaggtggtaagtcagtgtcatgccccttgcccttgaggctcctcctgtgacaaagggctgtaatgaaatggggcttcaaggagcccttaattctccacgtgtgggagctcatgagcggtcctaagaatcctcttctctctctcctgatgccccggttccttctctcatcactgctttctgtgctccgctctgtcccgcttccttccaactggaaagttcatgagagaagtatattgatgttctgtgagaaggggaatggctctccctgagcccttggctgggcgccacagcagctgtggaaacacaacagcgctcagcatctcctggtgtttgggctccgagctctttcaagaaacaccccatgtcctcaccatcttactcttcagacccaccacctttcccttaggttggaatctcttcccttggcttcttctgacctcttgtccctcagtctgtagccagcagcaaagaaagatgcttattactaccgtatctttttggtgggtactttggcctgctgactccttcagtagaatggaaagttgtatctgggggctgtcacccttcccttcctccttgtaggtccccctgctccacctgggtctagggtacagttgggccttactgagagctagaattccatttgttgaaagactagagtactttgataggtggtgtaattgatcagcctccccgaatttatagtatccttgtatatcttataaacatctgagtgatagagagctgacctcttccatactagcaccatgatttataggggatatctagtgccaggctactaatccagtgcttttcaacccttttattatcatttttgtacctttttttttttgaggtttatatcatttgtatacaattaagtgcatatatcttaagtatacatctcactgaatttttgttatctatatacctatgtaaataccacccagattgggagatagaacatttccaggacttgagaagcccccccttgagccccttacagtcagtacccctaatgataactacaattctgacctctatcaccctagttacttgggattctcaacgtttttccacctatacccacctctaagtcccacctctcctatttaatatgtaagaatgcaaaattatcagctattgtggcaaaaagaaaccaaagtagtggtaaatttagaaatcccttttctgctctccttgcccctcacattttaataagcattctccccgtccccctgcccctaacccaggtcatggagaggtaaagtgatatccccatcctctctggtcagtcttggcatcacagaagcttgacgagaagagaaacagacaccagggcagcttcatcctattttccagctgcccaaaatcaccatatagtctttctaagaagaatcagactgtggttcttagaattgtcagatatccactgagctcccaacacgcacagatcttgctttcctttttctgtcaaagtaggattatctttcccttgattatgtttgagttttcttgggggtagggaatacatttgaagaggagtaaccactgcactccccttccgatgtgcgaatgtcaagcatgttgaattgtcagtggcaaggaatgtgatgagcaggttattttacaggaggtacacagaaagcccccattttggcttcttctgccatattcaaatccttgtatatagaagtggagcttaatctgtttatcctagagtaaaaatatctacaagacactattattatattgacactggagccaaataggaaatcggaggactcacagatgttatctgctttaatgcagtgggttttgtacacaatgaccctgcagccaatcaggatggactctacggtagaatttaaagaacatcttattggcacaatgtttattccttgggcttcgtaggctacattgtgttcccagcattctgagggcaagaaagatggagagagagaaaatgaacctagcaagaaagtattgggataaattccatcattaccctaaaaatataattatagcactctttgatatagggtagaatttggtataatttgacaattacttatgggcatgtattatatgggtagtattgcacaaaggatagtttgcagcctaagaggaaggtgataggccaaaacggttaagtcttcaggctgggcacagtggctcacacctgtaatcccagcaatttgggaggccgaggcaggtgaatcactggaggccaggaattcgagaccagcctggccaatacagtagaaccccgtgtctaccaaaaacacaaaaatcagccaggtatggtggcgtgcacctgtaatcccagctcctcaggaggctgaggcaggagaattacttgaacccaggaggcggaggctgcagtgagccaaaatcatgccactgtactctagcccggatgacaggagactccgtctcaaaaaatgaaaaaacaaacaaacaaaaaaaccacaaaaacgacaaacccaaaagggttaagtcttcaaagctgtctttttcagcattttaatccataatttaggacaaaattggcacatctagcagattcttggtgatccaggatattttctttttcttttattttattattattatactttaagttttagggtacatgtgcacaatgtgcaggttagttacatatgtatacatgtgccatgctggtgtgctgcacccattaactcatcattcagcattaggtatatctcctaaagctatccctcccctgaccccacgacagtccccagagtgtgatgttccccttcctgtgtccatgtgttgtcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttgttggacagttgggttggttccaagtctttgctgttgtgaatagtgccgcaataaacatacgtgtgcatgtgtctttatagcagcatgatttatagtcctttgggtatatacccagtaatgggatggctgggtcaaatggtatttctagttctaggtccctgaggaatcaccacactgacttccacaagggttgaactagtttgcagccccaccaccagtgtaaaagtgttcctatttctccacatcctctccagcacctgttgtttcctgactttttaatgattgccattctaactggtgtgagatatctcattgtggttttgatttgcatttctctgatagccagtgatgttgagcattttttcatgtgttttttggctgcataaatgtcgtcttttgagaagtgtctgttcatattcttcgcccacttttcgatggggttgtttgtttttttcttgtaaatttgtttgagttcattgtagattctggacattagcccttcgtcagatgagtaggttgtgaaaattttctcccattttgtgggttgcctgttcactctgatggtagtttcttttgctgtgcagaagctctttagtttaattagatcccatttgtctattttggcttttgttgacattgcttttggtgttttagacatgaagttcttgcacatgcctatgtcctgaatggtaatgcctaggttttcttctagggtttttatggttttaggtctaacatttaagtctttaatccatcttgaattaatttttgtataaggtgtaagcaagggatccagtttcagctttctacgtatggctagccagttttcccagcaccatttattaaatagggaatcctttccccattgcttgcttttctcagtttcgtcaaagatcagatagttgtagatatgcgacgttatttctgagggctctgttctgttccattgatctatatctctgttttggtaccagtaccatgctgttttggttactgtagccttgtagtatagtttgaagtcaggtagcgtgatgcctccagctttgctcttttggcttaggattgacttggtgatgcgggctcttttttggttccatatgaacttttaagtagttttttccaattctgtgaagaaggtccttggtagcttgatggggatggcattgaatctataaattaccttgggcagtatggccattttcatgatattgattcttcctacccatgaggatggaatgttcttccatttgtttgtgtcctcttttatttcatgagcagtggtttgtatttctccttgaagaggtccttcacttcccttgtaagttggattcctaggtattttattctctttgaagcaattgtgaatgggagttcactcatgatttggctgtttgtctgttattgctgtataagaatgcttgtgatttttgcacattgattttgtatactgagactttgctgaagttgcttatcagcataaggagattttgggctgagacaatggggatttctagatatacaaccatgtcatctgcaaacagggacaatttgacttcctcttttcctaattgaataccctttatttccttctcctgcctaattaccctggccagaacttccaacactatgttgaataggagtggtgagagagggcatccctgtcttgtgccagttttcaaagggaatgcttccagtttttgcccattcagtatgatattggctgtgggtctgtcatagatagctcttattattttgagatatgtcccatcagtacctaatttattgagagtttttagtatgaagggttgttgaattttgtcaaaggccttttttgcatctattgagataatcatgtggtttttgtctttggttctgttttttttttttttttttttaatttatttttttattgataattcttgggtgtttctcacagagggggatttggcagggtcatgggacaatagtggagggaaggtcagcagataaacaagtgaacaaaggtctttggttttcctaggcagaggaccctgcggccttccgcagtgtttgtgtccctgattacttgagatgagggattggtgatgactcttaacgagcatgctgccttcaagcatctgtttaacaaagcacatcttgcaccgcccttaatccatttaaccctgagtgggcacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcatacctcccagacggggtggtggccgggcagaggggctcctcacttcccagtaggggcggccgggcagaggcgcccctcacctcccggacggggcggctggccgggcggggggctgaccccccaacctccctcccggacagggcggctggccgggcagaggggctcctcacttcccagtaggggcggccgggcagaggcgcccctcacctcccagacggggcggctggccgggcggggggctgacccccccacctccctcccggacggcacggctggccaggcgggggtctgacccccccacctccctcccggatggcacggctggccaggcggggggctgacccccccacctccctcccgggatggggcggctggccgggcggggggctgacccccccccagctccctcccggacggggtggctgccgggcggagacgctccttacttcccagatggggtggctgccgggtggagaggctcctcacttctcagacggggcagcctgccgggcggaggggcatcctcacttctcagacggggtggttgccaggcagagggtctcctcacttctcaagacggggcagccgggcagagacgctcctcacctcccagacggggtctcggccgggcagaggcgctcctcacatcccagatggggcggcggggcagaggtgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgctccttgccctcgggccccgcggggtccgtccgctcctccagccgctgcctcccgggcggcactcgccggcgcggcggcaaagactgagacagctccgctgcccgctgaactccatcctcccggcggtcgggcagcggcggctgcggtcggtcgcggcagcggctccgcttcatatctgcagctggggcccgcgggtgtcagcgccgcgactgtcccggctccgcactgccccgggccgcagcgcagcggcgccaaccaccacccgcggccaccatggccggacgggctccctaagccaccgaccccagcccgcgggccttcgagccttctggggcctccggcgccgtgacctcctctcaagatgtgaatgattcttctggttctgtttatatgctaggttacatttattgatttgcatatattgaaccagccttgcatcccagggatgaagcccacttgatcatggtggataggctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgaattagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagaaattcaacttcttcctggtttagtcttgggagggtgtatgtgtcgaggaatttatccatttcttctagattttcccagctgtatgctgggagaaccactgctctcttcaaagctgtcagacagggacatttaagtctgcagaggttactgctgtctttttgcgtagaggtgtttgtagtattctctgatggtattttgtatttctgtgggattggtggtgatatcccctttatcattttttattgcgtctatttgattcttctctcttttcttctttattagtcttgctagtggtctatcaattttattgatcctttcaaaaaaaccagctcctggattcattaattttttgaagggttttttgtgtctctatttccttcagttctgctctttagttatttcttgccttctgctggcttttgaatgtgtttgttcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtgatctgagagacagtttgttataatttctgatcttttacatttgctgaggagtgctttacttccaagtatgtggtcaatgttggaataggtgtggtgtggtgctgaaaaaaatgtatattctattgatttggggtggagagttctgtagatgtctattaggtccgcttggtgcagagctgagttcaattcctgggtatccttgttaactttctgtctctttgatctgtctaatgttgacagtggggtgttaaagtctcccattattattgtgtgggagtctaagtctctttgtaggtcactcaggacttgctttatgaatctaggtgctcctgtattgggtgcatatatatttacgatagttagctcttgttgttgaattgatccctttacaattatgtaatggccttgtctcttttgatctttgttggtttaaagtcttctatcagagactaggattgcaacccctgcctttttttgttttccatttgcttggtagatcttcctccatgcttttattttgagcctatgtgtgtctctgcacgtgacatgggtttcctgaatacagcacactgatgagtcttgactctttatccagtttgccagtctgtgtcttttaattggagcatttagtccatttatatttaaagttaatattgttatgtgtgaatttgatcctgtcattatgatgttagctggttattttgctcgttagttgatgcagtttcttcctagcctccatggtctttacaatttggcatgattttgcagtggctggtaccggttgttcctttccatgtttagtggttccttcaggagctcttttagggcaggcctggtggtgacaaaatctctcagcatttgcttgtctgtaaagtattttatttctccttcacttatgaagcttagtttgcctggatatgaaattctgggttgaaaattcttttctttaagaatgttgaatattggcccccactctcttctggcttgtagagtttctgctgagacatcagctgttagcctgatgggcttccctttgtgggtaacctgacctttctctctggctgcccttaacattttttccttcatttcaactttggtgaatctgacaattatgtgtcttggagttgctcttcttgaggagtatctttgtggtgttctctgtatttcctgaatctgaatgttggcctaccttgctagattggggaatttctcctgaataatatcctgcagagtgttttccagcttggttccattttccccgtcactttcaggtacagcaatcaaacgtagatttggtcttttcacatagtcccatatttcttggaggctttgttcgtttctttttattcttttttctctaaacttcccttcttgcttcatttcattcatttcatcttccatcactgataccctttcttccacttgattgcattggctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatttcctcctgtagctcagagtagtttgatcgtcagaagccttcttctctcaactcgtcaaagtcattctccgtccagctttgttccattgctggtgaggagctgcgttcctttggaggaggagaggcgctctgctttttagagtttccagtttttctgctctgttttttccccgtctttgtggttttatctacttttggtctttgatgttggtgatgtacagttgggtttttggtgtggatgtcctttctgtttgttagttttccttctaacagacaggaccctcagctgcaggtctgttggagtttgctagaggtccagtccagaccctgtttgcctgggtactagcagcggtgtctgcagaatagcgaatttttgtgaaccgtgaatgctgctgtctgatcgttcctctggaagttttgtctcagaggagtacccggccgtgtgaggtatcaggacagggacatttaagtttgcagaggttactgctgtctttttgtttgtctgtgccctgcccccagaggtggagcctacagaggcaggtaggcctccttgagctgtggtgggctacaccaagtttgagcttcccggctgctttgtttacctaagcaagccttggcaatggtgggcgcccctcccccagcctcgctgccaccttgcagtttgatctcagactgctgtgctagcaatcagtgagactccgtggtcataggaccctccgagccaggtgtggaatacaatctcctggtgcgccgtttttaaagcccatcggaaaggcgcagtattagggtgggagtgacccgattttccagttgccgtctgtcacccctttctttgactaggcaagggaactccctgaccccttgcacttcccgagtgaggcaatgcctcgccctgcttcggctcgcacacggtgctctgcatacactgtcctgcgcccactgtctggcactccctagtgagatgaacccagtacctcagatggaaatgcagaaatcacccgtcttctgtgtcactcacgctgggagctgtagaccagagctgttcctattcagccatcttggctccagcccctccaggatattttcttgacaccctttgctgagggactcgtgacaggggttccctgtttactcagtccgttgtgctcaactcctcgcgggagggagcacgtgaatgaataagttcaggaaccagctgctgcttcgggcactggcaggagcaaactcccttaacttgggtccactcactccaccctcactggagggaatgcataggtgagcaagtgcaggaactagccggtcactttagcactggcaggaccaaactcttgtttgctcaggcccatcgcactccaccccttgcgggagggagcatgtaggccagcaagtgcaggaactgactggccactttggtgctggaaggaacaaactttgtgcagaccccacggcagtgtccaggtgggggtgcctgaaactccaaggccccagagggcatgttacaatgctctcttagctccgccgtccatggacagcagcgtgttatcagcttagtgggccctttgccttgtcacatggggcagatgccctccaccagcaagggcaaagggccagtgtgacagcctttttgggtacccacacttggtggatcccaaattgttgtccaatgccaaaaaagaatgaggtcacgtagacgaattgaagttatggtgaatgcagacaattttattgagtgatgagatcagctctcagtggagaggggagctggaaagggggtgggaaggccaggtcactctcccctgaagtcaatttgcctctctgcccctcttctccaaagtcaagttgcccctctctttgccatccagccaccatctctgaaggcaagtcgcctctccccaacatccagctgcttctcctctctgccagctgagcctggagtctttatagacacaggatggggggacagggctggccataggtagttttgcaaaaggcaacattcaattggtaaaaagacattattcagaaagaatgactcaggagagagcaggcaaacaggagaatagaagttctcaccctgggccaagggtttcaggctacttctggcttgaaggtggggtttccactggggacctgcccctgtctgcctagagtttctctgccttctgcctccctcaatgggtgatgctaaaccaggatgagtagtaaaatcaggatcagagagatcaggacagataagagtctaagcctaaccaggtaaaacacagcaggcacaaggtaggtaaatacttagatacaaaaaacaaaagtttccgtgatacagcctaggggaaacatgactaagtagtcctgtgaagaagaggtttttgatgcttgcaagcacaatctggggcatcacaaagagattcggtaccaagttaaacttctagaagttgaatggagagaacccatgcctagaggactgacttcactgcagattactacacttaaaactactgaggggtattgagaaccatgactggaaactgtgttataagaagcattcttaaatgtaaggagtagtagttaggtgaaagagaaaaccaaagagacaccaatatcccatcctcaaatgcaagaaggtgttaccaaaatgccagggattcagtctgggtcctgctgcttgccacacagaaagccaatcactgagacaatgactgttgccagggaagaaggctttaatcaggcgctgcagcaggcaagatgggagatcagtctcaaatccatctccctgactaaaatcaggggtttatatgccagagaagaaatgaaactacatgcaggaaaacaggaattagggaggggtaaggaagaggagttggtcaacaggaagcaggtggtcacttaggcaatcatgatgggtgaggggtctggtgtctcattgtccagctgtaattatcagctccttgataccatctgggtaggcctgatggttggttttctgagaagggaactcagattaagacaaatgtaactttaagtttgaaaactgggagagtccatttctgtgttaattcaaaagaaatcataaacatcggttctatgggacagctgggccggtttcaatgggctgttctgtatgtgaggcaggtgccctagaaggcaaagctaggattaggaagaagttataggaaatagtctttggttccatttggcaaagtcctttttcatcactttaagctgttgagcagagcagaatagatcatctcttgatggaacacagatatggaggactcacatttatggaggttgtgtcagatactagtcatagggctttggcagccatttgtcagaggtgttgaggaggggactcatgcactctgtaaaggcttgaacaggccaggcatggtggctcacaccagtaatcccagcactttgagaggccaaggtgagtggatcacgaggtcaggagttcgagaccagcctgaccaacatggtgaaaccccgtctgtactaaaaatacaaaaattagctgggcatggtggtgcacacctgtaatcccagctactcgggaggctgaggcaggagaatcgcttgaacctgggaggtggaggttgcagtgagccgagattgcaccactgcactccagcctgggtgacagagcaagagcaaggctccgtctcagaaaaaaaaaaggcttgaacagatgttctctaaggccctgtccaaacctgacagtctatgactgcttatgtgctcatgtaatcaaagcagacagggcaggctcagttgggtacgtggcttagactccccagggaaggaggcagggattgtcatggaccttgaagtatggacagaattaaggatcatgggatgaatgatgaataaaagctggacagtaggaaatggagattggggcttcctgctacaggtagtagtgtactgctaaagctttaccgggtgagggataaagtgtctcatcctgaggagagatgaggcactgaaatccatggacacccttgctctcaagtggtctcatacaaggagacaggctggcagagacccccagacatcttgataatgccagcaactccctgcgctgttggtcaatagagagagggtgcccagaccaagccactgactagttgtgctccagaagggtgcaggcagtttcctaacgactggaaaaagacaaactgtttaggagatgaggaattagacttaatgatccacctatggccgtatttgaggtttcacatttctcctaatgctgtctttaaaactcctgaagctgtaagtcagtcatgactgatggccatcattctaacagccgtggatatcaccaagtttctattttgccgtgtttcataaatgtggttctagagaactctagctttgttctagccactagcacacattttcaagttttatttaacttcccacattctccctttattttctcttaatggaatggccaacagcaagatgcaaaatatatataatggatgttaacgcagttcatgtgcaccgtaaggacttatactatattgtgtcattttcataggcgcgtcacgctagcatttccaggcactttccacatggtagccctatgacgtaagtaaatttgggcatgctccctgcatcacagatgaggaggctaaagcaggagagtttaagtgacacagtgagagtgggtacacaagtacagagaatagcccattccgtgagaggaaaggccattaaaaggaggacgttatcgctctttaactaaaaaaaacatccacagagaaagggtttggcattggcaaggccaagttaaacaggatgcagcattctctccaagcgtttccactgctatgcagcctctcctcacaccggtgcttttgggtcacttcctaatccctgaatgggttcgctgacctgtaaggagcagtgggaggtggagattgcttgcataaactcattgagggaagtgatcctgcaagtttcccaaggataagagaatgttttccctccctcccttcctttctactctccctcctcccctactcttgaaacaaccctatcccacctaccatagcacaagctgtaataccaagttgctcttctctgagggctgctgaggctgggactttgtgtcctcgctggaccagtgcattagggactatcaaagagattacaatagccaagggccatttaaagaaaccagagaatgcctgcatgactcttcatgaaaccttgacatttaataatcccatcacaggaggggtcccaaatactgtctcatttgatcttgttgtaccctgtttgagtaaagaattgagagtgttttatgggctaattctgtgggatgtattatcatactttctgaagctggaaaagaaaaataaagctgttaatacttggatctaaaataaacaaaaatccataggcctttccttatgtcatgtctttttattattttttattttattttattttttgagatggagtctcgctctgtcacccaggctggagtgcagtggtgtgatctcggctcactgcaacctctgtttcaagtgattctcctgcctcagcctcctgaggagctgggattacaggcgtgcaccaccatgcccagctaatttttgtattttagtagagacggggtttcaccgtgttggccaggctggtctcaaactcatcaactcaagtgatccgcttgcctcggcctcccaaagtgctgggattacaggagtgagcccccacgcccagcccctaatgtcatttctgatgaaacctttattgtatatttctcatgtttgtaattatttcagtttcaaaatatgttattctggccaggcacagtggctcatgcctgtaatcccagtgctttgggaggccaaggtgggtggatcacttgaggtcaggagtttgaggccagcctggtcaacatagtgaaaccccgtctgtactaaaaatactatatatatatatatatatatatatatatatatatttagccaggcatggtggtgggtgcctgtaataccagctactcaggaggcaggagaattgcttgaacctgggaggtggagtttgcagtgaaccaagatcacaccactgcactccagcctgggtgacagagcgagactccaccaaaaaaaaaaaaaaaaaaaaaattctgtccccctatttcccctgattttccgtagtctttaccctatctcacttggatgttattctatcttaatgcaactcgtacagtgcttgtctagtccctcgagatacaaagcagatcagttacttaattttcattttaaatgttgtttgtgagccgttgttgaagggcaactttggtacacgaggctggttttagtttcccatgtctctgccaatattcccatctgctgtatacattcactgctattataataataatagtttacaggagcccagattatgatattttaataatatagagccctttgttgacataaatggttcacgaaagttgaaatgaaatattaaagccacaattttggttctacttatcattgcatggaaaagactggacctgactcgtcgggtagacgtgagccttctttggagatttaatatttctttgcatcacaagtcattgagtcctcattttaagagtgatgttgagggctaggaccctctttggtggtcaaattagaattcaaccccagttaaatcctgactctcaatccagtattcttcctcctattccatgaaatccctgcatatatacacacatatacatacatacatacatatgtacataacccacctctttctctagaattgaggctgtagtctccaaacagaatttccaaaaatttgattccagtgtgcccctattagaattccaaaacagcaatcttcccagcacaatcaagggacacaattcctgctatctgggatgatatttttggcagctttgcagtgcagtcccctgtatggcactgctgctgaagaagcgggcaggcagctactctgtattgtcataggcttttgctgtgttggtgaatggcttttttcaggtgctataatttccttcacttgctatatgggccacctgcctctaccttctcattcctccaatccatccaccacctccactaggattaatcttccaaaaacattggttttcaccgtgtcactcctgtgaccaaacccctccccactgctaccagattaaagcttctaacgcctcagctggtgctccaagacctgctggccagactggtgaggccaggtgtcctcactgactccagaagaggctgtgttaattcccaatcctctttttcctctttccccttctaattgctctttctcctttctgtaggtcagcccttcataccacacaggggccaggcccaacccacttgtttgactctgtcctaggctgggctccaggccaactgtgctccttctctctgaactcctgaaatggctgccgatcctaggagagtgtatgagccaaactgttcacatcctcattgatcactgccatgacttctggtctctgagttcagctatgagctcttgcagaacaagttctcaaacctgcttggtccctggtgctcctagagtctcaggaattactccacagagccctaaaaagaaaaaacagtccatagcagttccatttattaagtagttaggaccaaacaatttcataggtaattatgtcctaacaatttagtagccacttgaaaaactgcacataaattgaaagaaaatataatcattttattctgaaataaccacagttatttactaatgggctgtgtgctcctgttggggactacacagcttcccaaaccttgaagtcagatgagacattgccacattcctctatcctttcctgttctacatgggttttcacacatacttgctcttatgaaacgactgccaaaaacccagttttccaaagatatgagatcatcagaaggaatgcagattgaactaatgttgaagctgtgacccaccttgatctagtggtttgtgcagtgcctgacagatgttagtatcatgttgctttccttgaaaatctaaaatacggccaggcgcagtggctcacgcctgcaatcccagcactttgggaggccgaggagggcggatcacctgaggtcaggagttcgagaccagcctggctaatgtggtgaaaccctgtttctactaaaaatacaaaaaattagacaggtgtggtggtgcacacctgtagtcccacctactcgggaggctgaggcaggagaatcgcttgaaccgggaaggcagaggttgcagtgagccaagatcatgccattgcactccagactggacaacaagagcgaaactccatctcaaaaaaaaaaaaaaaagaaacaaaaaatctaaaatatcccatggtgcagattcactgcagtgcccagggcacctccacacgcagtttgggagccacagtgctagctgttacacaggtgtagtatcataccagtcttgtgcatcccccaagatgcattgggcaatgcagtcctcatagtaggtggccaacaaatattttatgagcatcttaatccttatttcctgatgggccacaaacgccacaagttcaggagtgttctgagttccctggtccagcaataattcaaataaaatccattttaacatcttctggggatgctgtaaaggatatatctgtactgagtggaggttggcttagatgaccttttaattcccttccagggctaatgctctttaattcaatagcagcaacgcgcaacataaagaacaatatgaacacagttgtatggcagtggtgaggatgtaatgtctcaaacccccatgccaaaatattaaaaatttgaattctaacatgtagaatttggttggagtaaggaggtggagacataaaactgctgtttagttaatatgatattaatgtattaattgatgaaccttcttagttgccacaaaaattgatcatatcgagtaggacaccaagaaaaccacagtaaatgccaaaaaaatagaagtaacaataacatatctgatcactatgcaatacaactaaaaaatacaaattaaaagactaaaaactagaaaataaaactccaccattgggaaattttaaaactccccttaggtcaacaagaaaatcaaaaccaaaattctaggccatgtagaaaatgatgtgaaagttctacacgtaaaatttttgagtatagataatacagtgcttaggaaaattcttcaacttaaggtttttttgtttgtttgtctgagacggagttttgctcttgttacccaggccggacgtctcactgcaacctccacctcccaggttcaagcaattctcctgcctcagcctccagagtagctgggactacaggcgtgcgccaccacacccagctaatttttgtatttttactagagacggggtttcaccatgttggccaagatgttctcgatctcctgaccttgtgatctgcccatcttggcctcccaaagtgctgggattacaggcgtgagccactgcaccgcccaacctaagtttttgtataaataacagaaatgaatgaaaataatagggccgggcatggtagctcaccctggtaatttcagcactttgggaagccaaggtgcgaggatcacttgaggccaggagttcaagaccaacctgggcaacatagcaaaatgctgtctctactaaaaataaaaaattggccaggtatggtgatacgcacctgtagtcccagctacctgggatgctgaggtgggaggatcacttgatcctgggaagttgaggctgcagtgagccatgattgtgctactgcactcagcctgggcaacagagtaagaccctgtctgaaaagaaaagaaaatcatagaaattttgtatcatgcttagggagttataagaggaacaagaaaattaacccagggatatcagaaaacctgagaaaagtgcctaatatatagaaagcagttagtagatactagctgttattatttgtcagaaggactgagaagtttctatttcagtgttatttttgagtggtacagaaaaatctacagtgttacatttagaaagtaaagttcatttttgaaacagttgaggaaatttaagtacggactccatattattaatagataatgatattaatagataggtgtgataatgttattatggttgtataggaaaatggttacatagtaaattatgtattatggttgtataagaaattccctttattctcagggaatatatgctgatatattctgaggttaagtatcatgatgtctgcaatatactttttattttttagacagagtctccctctgttgcccaggctggagtgcagtggtgcgattgtggctcactgcagccttcgcctcccgggttcaagtgattctcctgcctcagcctcctgagtagctgggattacaggtgtgcgccaccacatccggctaatttttgcatttttagcagagacggggtttcaccatgttggccaggctggtctagaactcctgacctcagttgatcccctgcctcggcctcccaaagtgctgggattacaggcgtgatcctgggtttacttttgatccctcttgaagcttcctaaaatggtagtaaacatatatacacacatacacacatatgtttatatatatgtttgctgtcatgtaaaataacagtaacatatgtcatttatgtgatatatgcaaaactctgaaggataatgagagaataaaagtacaaacaagagcaacaaaaattttggatcctgaaaagatggacaagaacgttaaattctttttttttttaattttaatttattttttattattattatactttaagttttagggtacacgtgcacattgtgcaggttagttacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacgtgaactcatcattttttatggctgcatagtattccatggtgtatatgtgccacattttcttaatccagtctatcattgttggacatttgggttggttccaagtctttgctattgtgaattgtggcattattcacaagaatgttaaattctaagccaaccagtagagaaagccagtatttcccatagagcctcctgaagacttggatttgggactatagatgcatctgaaagtgtgaagtatggggcttaaataggagagttggttgaacttcctaagaagcaattagatccccaggcccccaccttagcttttgtgcaataggacagacaactgccctctcttattccattttggaaactgaaagtttgctttctgttaagggtaaaacaggcttttggattaggatacaccagccagagttgaaagtagcgtgtataccactgaaaatatgggattaaatgaatgtttacataccagatacaggggtatccaagcttctccccacactaggatccaacaacacaggtggtcaggctcaaataccttccaggcaggagagtgggcagtccttctccagagcctctgaccagctcaaaagagcagttgtcgggggctctttgaatgacagtcggccagatgaccctatactgaaggccatagtggacttcagacagcttctgagtaccttctccttaagtaggagcagaaaccaagtattcccagatgtctaactcaaaaaagactagactaaatttgaaggaaaaaagacaatgtaaggagataaaaatgttacatgtcccaaaaaattctactatcatttatgttctcagtaagaacatataatatgtacatatatcttatccctcagtgaaagaggtactacattcatgaaacaaaaaatgctattaacaaaaaaaaggatattcaggccgggcgcagtggctcacgcctgtaatcccagcactttgggaggctgaggtgggcagatcacgaagtcaggaggtcaagaccagcctgaccaacatgatgaaaccccatctctactaaaatacaaaaattagctgggcatggtggcgcgtgcctgtaatcccagctactcaggaggctgaggcaggagaatcgccggaacccaggaggcggaggttgcagtgagccaagatcacgccattgcactccagcctgggcaacagaccgagactctgtctcaaaaaaaaaaaaaaaaaaaaaaatcaaatgattaaaagtactcttagaaattaaatatataagtttaaaattcagtagaaggattagacagtgaaatttagactatcttccagaaactaagcaaaaagacaaagaaatggaaaataagggagaaaagatgaaaagatggatcaggctagaagcaatattcaaataatagagtttgcggaaaggaaaacatagaaaacaggccagaaaaaataaggaagaaattaaaggcagttacccacaattgagagaaacaaatgtctccattgagagagtctaccaactgcccagaacagtagatgagactagaccaacactaaggttcatcatagtgaatttcaaaacagtgggaacaaaagacagtcgagagggggaaaaaagttgatatacaaagaataaaaaatcagagttgtttttggacttctgaataactacactggaaactggaaatcaatgcaacaatgctttcaaacaataaagggaaattatatctaatctacaagtctgtatcaagccaaaccgctcattgaatatgaacatagaatagatactttcagatacacaagatcagataaacaaaacatttgtctcctagtcaccctatgcaaaccattggaggatgaactccagaaaagtaagagtaaccaagaaagggaaagagatggaatatagggaatgggagatcccacaaaggagagattgaaaggcatcctcaaaacagtagcgaagggaagcctggggtggcagctgggcctgaagcactgaggatgactagaacagactggatccaggccagagggctctaggacagattgtgttaagatgaaatggcttgaatacctaatgtgtctgaacatatatttaggaggtttagacagttggcagagagtttgcgattaaattattgataagtacatagagacaaagtagaacaacagaaaagacagttgttaattccagggaaaacaatgttgtacaagaaagaataagtaatcctagtatattacatggcttacctagatacagcaattaaacagtcaaaataatgtcaacactggatgtagatctaaccaaaattatagtataattatgttgaaatggtggaaagatagggaggcaagagtttgccatgacaggggtaagggggctcacagcagtgaaagagccaaatcctcatttaccgagcaaaatgggaaatatatataatgcctaaacctgaaaagatcgagaagtcaagaggtgacaatatgagcacgttattttaacatacagaggtaactaaaagtatcaggtaagtctctacggagtatagtatggaagctgggagcctgttaattttcataacaagccttggaattatttggctctttaaactatgttcatacataattttactcaagtgaaaacgttttaaaaagaacaaaagtgctatgagaatgggcagactgggtttttaaaggacgagtaggagttctataggcctagggaatggaggagtgttcgcgcaggtagagaaaagaagactagcggtaagccaggtgtatcctggctctaaggaagcttgggatgtaggatatagtcacacttaagtatatgggcttttctcccttggtgtctgtgttgtttagaattgaagacatggaccttttgttactgataaaattataacctattactatttttggttattgttttaacataacattattctttgaattgatctcaaagagaggaaaatgagaggtcactgaaatgaccctggcagtaaaatttgctgaaaagcagcgtcctttacaagtccttacctccgaccgcaaaagagtcttctaaagaccactctcagccctcaagggtccttgcaagtcagtgacaccacaggaaatgggaaccttgccaagaattagggaaattcaggtgtctgcaagtccctaaaccctagggccaaaaaaaggatttggcagatgtttgtgtgtcctggaggcagatggatgaaagtatcagtaggctccgtggcttaagtgctagtcagtgctcgccattggtcttttgcagtcttgtcacttctgtctggaggcattcagagagctgaaaggtacacagtgcagtggtaacatctggaattgacccctggctccaccatcttcatgattagtaaagtcactaagcccctttgagagcaagatcaaggcagtcacagtcacaggggcattatgagtatcacgtaaagtcatgtattcatatatgggaatgctttgtaaatagaacatttctgtataaatcttgctttcagttagtgagtttgtgtattttttgagttggtctctctgtaaatgtgccttctttccctagtacatttattattactgagtccaggtacgtttgtgtattagttaaggtataggctaaggtactataatagaccccagaatatcacagtttaaacatggtagaaatttgtttctccatgtaacagtctagagctgcaccatccagtgcggtggccactaagcacatttgattatttaaatgtaattcgagcaaaataaaaagttaactgcctcagttgcactggccgcatttcaagtgcttagtagcctcttggctagaggttactgtattggacagcacagataaaacatttccatcattggttgggtgtggtcatcctatgtgcttatgcgtatcagcactttgggaggccaaggtgggcagatcacttgaggtcaggagtttgagaccagcctggtcaacatggtgaaaccccatctctacaaaaaaaaaaaaaaaaaaaaaaaaaaaaaacccaaaaattagctgggagtggtggcaggtgcctgtaatcccagctactcaggaggctgaggcaggacaatcacttgaacccaggaggcagaggttgtggtgagctgagattgtgccactgcactccagcccgagtggcagagcgagactctgtctgaaaacaaaacaaagcaaaaaaatgcttccatcatcacagaaagtttagttgggcagccctggtctagaggagtggtctagaacttgatgggtgctctgctgtacaaggtcatccacaggcctgagttccctaaatattattgctctgccattccctaggtaaggattcatagcattttttgtgccatggatcactttacagagtgacaaaggctagggaccacttcacagactaatgcttttaaatgtgcaaaatcaggctgggcgcagtggctcatgcctgtaatcccagcactttgggaggctgaggcaggcagatcacttgagatcaggagtttgagaacagccaggcccaacatagtgaaaccccgcctctactaaaaatacaaaaattagccaggtgaggtggcacgcacctgtagtgccagctactcaggaggctgaggcaggagaatcgcttgaacccaggaggcggaagtttcagtgagctaagatcacaccactgcactccagcctgggagacagagtgagactccatctcaaaataaataaataaaaattttgtttaaatgtgtaaaataaaacacagagttacaaaggaaattaattatgttgaaatacaattatcaaagtattttaaaaacccaaaatttatgacatagtaatatgtactttattaatacatcaaataatgatctagtgtcaattctaaaggctatttttgtaattccaaagtagtgatgagtatttgtgatatttcaagacaatccataagtataatgtgatatgaaaatacctataatttctgttattgacagagtcatggacactgctaataatgtggtttgttccctccattataagtgaaggaaatgctaaagttatgggtgttttttgtttttgtttttgtttttgtttgtccttccaaatttaaagaccagtgaattctattcatggactccttgagggtctgaggaccccagggttaagaagccctgctgggaattattaaagctagcccagcaattttaagtccacactctagatgtgggaaggaagagaggaaatggaaggcaaccatttcctgcttaaaggactggacctggcagttgctcacatcccatctcattggccaacattagtcacatggggtgtaaggcatgctgggaaacacagtctgtagttgggcaaccctgaaccttgctggtaattaaaaaaaaaacaaaaaaacaaaaaacaaaacaaaactgggagagttccatcagtaaaaggaagaagggaagaatggctagtaggataaacaacagcctctaccacagcttggctcatctctatggaattaaaacaaaagtgttttttcaaaaatgtgctgtttactctccgacactttgtataccttcaggtctacagcagatgtcaacaggaagcatttcactcttactagctatggacaggcccctatggtggtgccagttcgtgaggcacacagtgtctaaggtgggggggtgtccaatcttttggcttccctgagccacgttggaagaataattaccttgggccgcacataaaatacactaacgatagctgatgagcttaaaaaaaaaaaaaaagaaaaaattcatactgttttaagaaagtttacaaatttgtgttgggctgcattcaaagccatcctgggccacatgcgttagacaagcttggtctaagggatatagctttattttttaaataagagacagagtcttgctctgtggcccaggctggaatgcagtggcctgatcatagctcactgcctaccacaaattcctgggctcaggtgatcctcctgcttcagcttccgaagtagctggtgtaccaccatgcctgctaatattattattattttcttgtaatagagacagtgtctcaccatcttgcccaggctggtctccaactcttgggctcaagtgatcctcctatcttgctttcccaaagcgctgagattacaggtgtcagctaccatgcacagccctatgtagcctattttgaactaataatcctcagttctgtgcctgtagttgctgacagagccaacacttcacaagtgttggcttctgaagtgtgtttgtctcttgcttaaagcaaactcggtacaacgtgatctgcacttacaaaactaataacaaattaataacaaattagatctctgctcctgttaccaatgaccaatattctatgtgcaagagagcataagtagaaggagacagactttttccaaacaaacagatcccttgagcaaatgccctttaaactttaaaataacaacccccttgggttgtgcaggcctttaacttttcagagagctttaagtaccttaactcttcttattttattaaaacacccaggtcatgggttggttttttttctttccaagttagttaaataaataagcaattatgacgcagcgccacatggccaacagcttttagcttataaacatagagtttgaaaagcagtacttagaggccaacttggttggctgctgccggcaggagggagccgagctgttcccggcccagataacacttaaagggccaggcaggccctcatgcatgcacatttgtctacatccagggagctgttttttttctgatgcaacatgaatttcagtgtggttttttttttttttaagtgccaaattgtgagctcctgatggccagccacttgtgtcttataagcctccacaaagcctggtgcaactccttgtatgtcacagacatagacatgtttgctgacaaattgtttgtattttatgagcgtttataatggccttttaagtaagtgacgttttagagtttgctgaatgaagagtgatttttatttagtctcagaggcacagttgtttggtgtggttggttttttttggccacccctcccccaatctatctctaattttaagatgtgattcactaggaaaatatgattctgttaattgaattcattttatagccaacttttcaggaacctatctatttctgtaaagtgagagccacttgtaaatgtaccgtttggtgccagcactcaaattttccctgactcagttgctccagtggtgtttaaatatcttcccataaatcaggcagccagcgctccatacttatttactgggtcttgtgattcagcccaggatcctgatagtgatcttggatgggtgatataaatagactaggatttgccaatggctatttttatcagggaagctttctaagttgatttctttgaacccagaacaacttcctccctctggcttcccctgttttcctccaagactagggagatcctttctttattctgcccgcccatcttctgcccctcccccagccagctggtgtctgcagaaattagaaggaaggtacgtgcctgacacagagttgcctgaaatcatatatctttaccccctttcaggatcatctttctttcatccggcccaagaatggcaccttccccgcccatcaggccacctgcactcaggagtcggctgcctgtcctgaaatagatctctaccagctctcaagcagaacaattccttgcattcatacttgaatgtataatttgtgttattacctcttatttgtctttgtaagtttgtccctgccccagtttaaaaaaaaaaaaaaatctgagttactgctactgaaccaaagggcctcattcgaggtcttctttctccccaccccctcccccatcccagtgatacagatgctgccttgtctggtcaggccttcagggaggatgtcctgaccccctcaaccccccatctccaaagctgtcccctcgctctttgtgcaactcgccgcccacatccagcacagtaaaagcaggctgtcagctgggagaggctcgccttggaggactgtcctttctttacatcctcttcccagggcttcatgctgcaaaacagcacattctcaacatgaaacaaaaatggattctgttttctttttcacctagtgtttttggccatactgttcttggcagtcagacttccaggcttggggtagaatcgatagcttaaaagataaatgtttacactggtcagcaatgtgccatttggagccttggtgcccctggataatttgccagagtctgtggctttgtgtccggaattggtgggttcttggtctcactgacttcaagaatgaagccgcggaccctcgcggtgagtgttacagctcttaaggtggcgcgtctggagtctgtcccttctgatgttcagatgtgttcggagtttcttccttctggtgggttcgtggtctcgctggctcgggagtgaagctgcagaccttcgcggtgagtgttacagctcataaaagcagcgtggacccaaagagtgagcagtagcaagatttattgcaaagagcaaaagaacaaagcttccacagcgtggaaggggacctgagcgggttgccaatgctggctcaggcagcctgcttttattctcttatctggccccacccacatcctgctgattggtagagccgagtggcctgttttgtcagggcgctgattggtgcgtttacaatccctgagctagatacaaaggttctccatgttcccatcatattagttagatacagagtttcgacacacaggttctccaaggccccaccagagcagctagatacagagtgtcgactggtgcattcacaaaccttgagctaaacacagggtgctgattggtgtatttgtaatccctgagctagatataaagactctccatgtccccaccagactcaggagcccagctggcttcacctagtggatcctgcactggggctgcaggtggagctgcctgccagtcccgtactgtgcgctcacactcctcagcccttgggcggtcgatgggactgggcgccgtgagcagggggtggtgctcgtcggggaggctccggccgcacaggagcccatggcgggggtgggaggctcaggcatggtgggctgcaggtcctgagccctgccccgagggaaggcagctaaggcccagcgagaaatcgagcacagcaccggtgggctggtactgctggggtactcagtacaccctccgcagccactggcccaggtgctaagtcccccactgcctggggccagcagggctggctggctgctccgaatgcggggcccaccaagcccacacccacccagaactccagctggcctgcaagcgccgcatgcagccctggttcccgctcgtgcctctccctccacacctccctgcaagctgagggagtgggctccagccttggccagcccagaaaggggctcccacagtgcagtggggggctgaagggctcctcaaatgccaccaaagtgggagcccaggcaggggaggtgccaagagcaagcgagggctctgaggactgccagcatgctgtcacctctcagcttcacccacccagtgaccttgagtctccttaactttccaactagcctacctcccagaggtcccccacacccctctcccctccttcggccagccctgagggccaggccctttctcacttcctgaaccaagtactggaagtagaagaaactgttgtcaggctccgagttccacctctgggtcaagggctccagagcctggtgctgcagcttggccaagggaacccaaaaaccaggtcagcagtacatccactctctgagctttggttctgtcattgcacaggattaatgttccatctcagattaactctgaaatcaaatgaggtaatgtattagtacttgtgtgtacagaattggtgggttcttggtctcactgacttcaagaatgaagccatggaccgtcgcagtgagtgttaacagttcttaaagcggcacgtctggagttatttgttcctcctggtgggttcgtggtctcgctggcttcaggagtgaagctgcagaccttcacggtgagtgttacagctcataaaagcagtgtggacccaaagagtgagcagtagcaagatttattgcaaagagctaaagaacaaagcttccatagtgtggaaggggacctgagcgggttgccattgctggctcgggcagcctgcttttattctcttacctggccccacccacatcctgctgattggtccattttacagagagctgattggtccattttacagagagctgattggtgcgtttacaatccctgagctagacacaaaagttctccaagtccccactagattagctagatacagagtgtggacacaaaggttctccaagtccccaccagagtagctagatacagagtgtcaattggtgcattcccaaatcctgagctagacacagggtgctgattggtgtgtttacaaaccttgagctagatacagagtgccgattggtgtatttacaatcccctagctagacataaaggttctccaagtccccaccagactcaggagcccagctggcttcacccagtggatcccgcaccggggctgcaggtggagctgcctgccagtcctgcgccgtgcgtctgcactcctcagcccttgggtggtggatgagactgggcgccgtggagcagggggcggtgctcgttggggaggctcgggctgcacaggagcccacgggaggcagaggctcaggcatggtgggctgcaggtcctgagccctgccccgcggggaggcagctaaggcccagggagaaattgagcgcagcaccagtgggccagcactgctgggggacccagcgcaccctctgcagccgctggcctgggtgctaagcccctcattgcctggggctggcagggccagccggccgctcccagtgcggggcctgccaagcccacgcccacccggaactccagctggcccacaagtgtggcgtgcagccccagttcctgctcccgcctctccctccacacctccctgcaagctgagggagccagctccaaccttggccagcccagaaaggggctcccacagtgcagcagtgggctgaagggcccctcaagtgccgccaaagtgggagcccaggcagaggaggcgctgagagtgagcgagggctgcgagggctgccagcatgctgtcacctctcacttggagtgctttatgaaacgtagagagcataacaacagcaagaatatcgtagctgctgtcttatgaacatctactgtgtaccaggcactgggtttctttttttgaggcagcatcttgctgtgtcaccactatgcagtcttgatctcccacgctcaagcagtcctctcacctcagcctcccaagtagctagaagaactacagctactcatgtgccactatgccaagctaatttttttttggttttttagtagagacaaggtctcagccactgtgtttagtttaacacatgactgtctcatctaatcctgataaatacccttgaaaatattaacaccgctcttttataggtaaggaaagtcaggctcaaaaagatgaagtaagtggcccaggatgacaaacgaaggaaagtggttgagtcaagattggaatctggccagtgtgacttttagacccatgttctcatctactaagcaaactgttttccttcccataatcaggatttgcaagagaagcataattaactttgaagatgggcgtttgcaattcattttcttgggatgcccatctgaccttcccttttcagatcagcaggcagtttcctgtgcttaggactcattcccctctgcagaaggaactctggtgattttcccaccgggagagggagacatgagatgtggcttcctgttccaggaaataccgcccagtctttttacccaccctcagccaccccatgcactatgttagtcatagtcagtgcatggcgctagccagctctatggtgattctgccgggtaagccactagctgttgagatgaccaaagctcagaaagtgcttgctgcatttctgtttctgttgttgacagtggcctgatatgcatagcatacttacatagctccacttttcagagcctctggcaggtacaaattaatcaatcccctggcacagcacagtgctaaccacaaggagaaaagaaagagaagtatgttccacgcaggagaaactgccaagttgccaagtgcatctggtctaggtttttttttttttttttggagagagagtctcgctctgtcacccaggctggagtgcagtggcatgatctcagctcactgcaacctccacctaccaggttcaagtgattctcctgcctcagcttcctgagtagctgggattacaggtgcgcaccaccacacccagctaaattttgtgtttttagtagagacagggtttcaccatgttggtcaggctagtctcgacctccttacctggtgatctgccctcctcagcctaccaaagtgctgggattacaggcatgagccaccgcgcctggcctaggttttaaaatgcttcgttcctgagaagatctgatagaagttgaattttagttttaattcaagaaaagggacactataacacttagccacttttcagtgtgttcatgtctcaactgagaggtggtgtcggtgtttctactcactgtgtctcttgcgcgtgtgtgtgtatgtatgtatttttgagacagagtctcgctctgttgcctaggctggagtgcagtggcacgatcttggctcactgcaacctccacctccccggttcaagcgattgtcctgcctcagccacctgagtagctgggattacaggcccgtgccaccacgcccagcaaatttttgtatttttagtagagacggggttttgctgtgttggccaggctggtcttgaactcctgattacaggtgggattacaggcaggaaccaccccgcccagcctcaagtgtatattgacaagacattgtcccaggggtaatgacagaattgaaaatggtgacatggggcagtgggctgcacggccacatgtatacattaagcctcatagaactgttctctctttctctctctctcatacacatacacatcagttttatcacatgtgaatttttaaaatattttaagtaagatggacccttttcctcaaagagtgtaggtacagtttaatgggggataagacaatgaattctcttgctgggctaaagacagtctaaaccacaagagaagttgaaaaaagcagtgctgtggggcttgaagccagcatgagacactgctggccacgggaagtctcagccttgatggttgggtagtgtgtgctgaagatcagaaagtttgtggaagggcagggtagaggcatgggggaaggacatacgttttgggaacagctcacattcctttttaaaaaaaaaaaaaaacaaaaaaacataggacatagttcctaagctgatgtttgttgagcaccaactctgtaccaactgctatgttagtttctggggactctgagatggaaagaatgcatccccaactcatcagggaagatatacagatggcaaataaacacatgaaaagatgttccaatagcattaggagatatacctaatgctaaatgactagttaatgggtgcagcacaccaacatggcacatgtatacatatgtaacaaacctgcacgttgtgcacatgtaccctaaaacttaaagtataataataataaaattaaaaaaaaaaagatgttccacatcatatgcccattcaaatgactagataccatgtaaacacctactagaatggccaaaatgcaaaacactgacaacaccgaatggtagtgagaatgtggagcaacagaaactctcattcattgctggtgggaatgcaaaatggcacagccacttaaaactaaacacactcttactgtgtgatccagcaattgcactccttgagatttacccgaattagttgataataggtccacacaaaaacctgcacttgatggttatagcagctttattcataattgccaaaacttagaagcaaccgagatgtccttcagtaggtgaatggagaaataaactgtggtccatccagacaatgaaatattccatgataaaaataaatgagctatcaagccattaaagacatggagaaagtttaaatgcatattactaaatgaggcttggcgcagtggctcacacctgtaatcgcaacactttgggaggctgaggcaggtggatcacttgaggtcaggaattcaacaacaccctggccaacatgatgaaaccccgtctgtactaaaaatccacaaattagccgggtatggtggcacgtgcctgtagtcccagctactcgggaggctgaggcaggagagtcacttgaacctgggaggtggaggtttcagtgagctaagatcgcaccaccacactctagcctgggcgacagagcaagaccctgtctcaaaaaacaaacatattactaagtgaaagaagccaatctgaaaaaggcagcatactgagtaattccacctgtatgacattctagaaaaggcaaaattatggaggcaaaaattagttggggatggtagcgcatgcctgtaatcccagctactggggaggctgaggcaggagaatcgcttgaacccaggagatggaggttgcagtgagtcgagatcgcatcactgcactccagcctgggtgaagagccagactccacctcaaaaaaaaaaaagaaaagaaaagaaaagaaaaaaacaatgatggagacagtaagatcactggttcaggttaagggagagaagaggatgaataggtaatgcacagaggatttttgaggcagtgaattaaaagaaaaaaaactcgatccctgtccttacggatctctggtctagtcggagtcagcaggcacacagaggcctgctgagatggagaatcgatgctcagattcttcctctgtatccagaagaagccagaggagggtactgcctggccctgggaggcttcactagaggttttcgagaggaagatgcacgtctaaggtgtgacgggaaagggccagaaagagaatgagggaagaacattccaagccacagaaatggcacatggaagagagcagagatgagaggagaaaccatctgtgacttaggtggctcagcagagctggagagagtcgggcaattgagttgaagcacaggctggggccgtgccatgcaaggctttgccagctatacaagggcaccacatgccgtggggagaaccagagtgtttttagcagggtggtgtgatcagattcctacttcagaaagatgggcacagtgtgagggatggattggggtgatcaggctggctcaaggagtcccagtcagagagggcaggctagaaagaagtagacaattgaatcgatgttgaaaatatagaatgtacaggctctggtgattggttggatggtgagtgggagagaggaaggggaccaaggtgcttccctggggtctagtttagatgggttgagggcggggcaatcagagaaagactagttgtagagagagggagcaggaaaagggaaatagagctagaaagttaattagaaccatgctgtgaggatactgaatgccaaggtcaagactgtattgaaaaacctgagccgaggctgggcacagtggctcacgcctgtaatcccaggactttgggaggccaaggtgggtggatcacaaggtcaaagagatcgagaccagcttggccaacaatggtgaaaccctgtctctactaaaaatacaaaaattagctgggcgtggtggcatgcgcctatagtcccagctacttgggaggctgaggcaggagaatctcttgaacccagaaggtagaggttgcagtggcctgagatcgtgctactgtactccagcctgtcaacagagcgagacaccctctcaaaaaaaaaaaagaaaaaaaaaacctgagacaaaacaatcttagtgcagatcactctttgttactctgtttctttgctacatcagactttgaccagaacctgagatggagatggacatctgggagttgctggattctagaataaacatttgacagcctttcccagagtggcccatacccaaattgataatcaggattgtggaagcatagggaaacacttgataggagctgaaaagcagtgtacttttaagagaataactttcactgaattctaacaattatttctgaaagtattgaattcaactggtaagataaacaatcttaatctcctatgaccccaagtttctcagctggtaaatgaaggaaaaagacctgttgatctcagaattctcttgcagctctgcaattctagcctaataaaaattttcatcaagatttaaaaaaaaaatcttatataagtaaatatagagtccagtgctatttttcattgatcttcaaacatttttttccccaaattttaatgctgaaacaccaacttgccaaattttccagagtgcaaatcccctgcccagtgagctgttattatttgaaaatattgtggcctctaaagctgactttatctttaaaaaacaatttttttttaaccagcaaaaggaataaatttccatgtttataccaatgagtttcctgaaactaagaaaaactaaccattatattgtttcatgtaaggaacttgggtactatcataatccccattttaatgatgaggaaataaataggcgaaggtaattatttcagactgtgtttccttgacgcagtatttctggatggtgaatcttactcagattttgttttgatgctattcttgggattgacttgagaagcaccagtggctgactctttctttctcagtgcggaggggtaaattgggaacaagctgtcttgctttcatcatattatttgctgtcatcatgaaaggcaggcagtgagaggagttttttttttttttttttttttttttttttttttttttgagacggagtctctctctgtcgcccaggctggagtgcagtggggcgatcttggctcactgcaagctccccctcccagattcacgccattctcctgcctcagcctcccgagtagctgggaccacaggcgcccgtcaccgcgcccggctaattttttttgcatttttagtagagacggggtttcacagtgttatccaggataatctcgatctcctgaccttgtgatccgcccacctcggcctcccaaagtgctgggattacaggcgtgagccaccatgcccagccgagaggagtttttatactaccttaagcatcttttgtttcaaaccaaatcatcttcacttcctccttcccctccccacttgcagataatgacagattttttgggatcttaccacggaaatagctttggggccaccttcatacagctcaaggctgtgctgatgttgcaggagtgagggaaggagagatcccgtcccatcccccagatggcagctgtgtgtttgagacttttgcacatgaatttgtttaattttcaccaaggtcttgtgagacaaggaaactgaggctcagagaatgtcagtaaacccacccagagtcacacagctaaaagatggcagagccaggattcgaacccacttaggcagaccccagctcatgctccacacctcgatatgctcctctaccatgagtggcaagccctggtttattaaaactttcccagcagtgttagagaactcaaatgtccgaaaggccattctcttccattagtttattcactcagtaaacaagtggagctgatacatctacttccctcctattttgagggatattttgaggattaaagagctataattctgcttatagctcagcagcgagtgtgtgctaaccagtagctattatggctactgatggtggctgccgtgccaggcaccataccggatgggctggggacatggggatgaggaagatgccgtgctggccctggaggaacacacacacaggcagcagaggaaatggccccacagcaaacaacaagtgtgggtgaaagcagggcctcagcacacacattctacacttctgagctcgccctgtacctcacagcagccattatggccacctgacaagcttggtctcacagtcattctgtggatctgggccttggcttgtcagtaactggcaatgtgtttgggaagtgatttctctttcttcattatgtcagcatttaataataataaagaaaaagtcagcatttagtaggagccaccccacacctcacccgccagcattcttccctgagaagtaggcacagttggttgtgagtcttctccatggggccaacattctgcaaacaagtgagcatttccttgcacttaaggctgcctattagcatcaggggagtagtagttgctccaggccccacgcaggagcttgagagggagaatagcagagtggacagctgtagaccattgggttcccagtttccccttccatgatatggggaacatggtaaaaatgcctgtctcgcagcaatgctgagacatagttccaacagatgacagatcatgagataatacatgtgcagcatttcagatcagtagagccctaggcagccattggttgccataggcagccatgagttgagaaggccagtgccacaggagcacaggggcctaagaacgctggccatacgtgctagatgctgacaaagaccaggggaaagcagagtgtgactgggaccggcacaggaaagggtggctaagagtcacagagggtgacctcacctggactcataaacccaaagatgagggaggggtatgtggtggtggagaaaaagaggtgacgttttagactggggaaaaggcgcatcgcacagcagggcacggggaaggagcaagccaagcaagggatctgcccctggtctgctgccagggctgccgtgggagcagcatggcctggccagcccaggaagggtttttttgtttttttttttttaagacggagtctcgctctgtcacccaggctggagcacagtggcgcgatattggctcactgcaagttccacctcctgggttcacgccattcttctgcctcagcctcccgagtagctgggattacaggcgcctgccaccacgcctggctaattttttgtatttttagtagagacggggtttcactgtgttagccaggatggtctcgatctcctgaccttgtgatccgcctgcctcagcttcccaaagtgctgggattacaggtgtgagccaccacgcccggccccagcccaggaagttttgtggggaattttcctgacatggaatgactctagactgccgccgctgccgacaacaataacaaagtagataaagcctactggtatggcactcaactctttatgccgttggtcctcactgcagtcctgacgtagctaccattgttatctgcattttgtagaaagggacactaagggccatagagtattaagggacttgcccctaggttatcagctaataagtgaccaagccagggttccgtttcagatctgtctatccctagaactcaagcccttaacccaagcattacaaggttattcttgggaggagaattgtatgccttccaagtgcattcacctcctttcagctagctgtgccctacttgggaacagccctgtggaagaggtaagtcaccacgcagaggctggcagatcatgttgatggagtatcagggaactctgacaccctgaagctggggagaatcatgtatttttagaactgcccaccttttgtgccttcattcctttctgctaactataggtgggtttacagtaatttggagatgattctgggcttgctaggggacactggggaattccggaataagctcacgatttattagtgagatgagcggatgagcctcatactgtgcacagttctgcaggtcggctgagttagtcaccaggacttaggcaaggccactgagacactcctgtaagaagctggacagagctgggaggggcttgaaccagaaggaatcgtgccccaaggcagcagacataattattcatagaatttagactaaaattctagaggtcatttataccaaaatggtctacccaaagctttcagtgggtaatttcatatgactgtgaacagtaaattcaagtaaatcgtaaccttcaaaatcgcctgtcaaatgcccaccccaggcctagactgctctgagcttgtggtacagactgtgaacatgcatgctgttttgatttagtgtctgaaggcttcctttcacaaattagtagatagctctggatctagaacaaacgtatctgaggtcaggtcccagcccgccacctaccagccgcatgacctcaagccacttgcttttcctctctcagccctgttttctcatctgtaaaatggacacaatgataccttttagggcttttcagaggtgccgatgaaatagcctgtactttataaagtatgttgtaaatgttgctgacataattttgtgtcctgtaggaaatgcttccttgggtgtttgtattatagcccaatccaagtcatccctgagaacatccccaggttgtaaggattagtcagaagtcatgatgactgttctatataaatatttggcctattaactaaaattagtacctttccatttcttctctttcttgggcggggcagcgggggagtgcaggggaggggaaatagggaacgttcaattgtgttttaagtaatgctcataaaattcttagccaaagatgatcttgccctccaccttggtgacccaccgcatacggggtacatctatctggcctgtctctaggcctagacagaagaaacagggaggattattgttaacttttaccacatgtatgacttgttcccggacaacccattcttcctttaggcagaggtgatatgcactgaagtgtttgatttagagtgatggaaaagtctgtgctgccattcctcagggagtcctaaacgttgatttgcctttgggagggccaggcttcacgaaaacctgatttacggtgttgctctgggcctgatttcctttgcacactctggaggaagtgctctggtgatgttggcactgagcaagcaacaaaggttttaaaatgtcggccctggaaacaaaactgtaccttgtgatgttagaataattataccacacttgatctctgattacggccaaaacagcagttgctaaatccagctaacatggaaaaactagaaaaagtgaggggaaatcagccaaatgcatagcaagggatggggaaagcggacctggactggacacagaatcttctgtttccacttgtctggtaataactgcaacacttcatggtccccagccccagcgcccaccccttgtctagagccattgcgctctgcatgttgacactagctgtgggaactctgtgatttaaagttgagttgaaagaactgcttttatcatttcaagtatgtagccccaggccaaaacagacaaaacaattttttaaagtctcagttcaaaagcagcttgaaatattctctgttccatcaaaaggaaccccaaatctctccactgttctgtgggcccctttcctctgattgtctacctggcaggctccccttcactagctgtgctgtggcttagttaagctgaagttgaaacacagacaaaggaaggcattgctttccagccacaatggagaagcccattcccactcttgtccccactgggaaactgggttagagttctgagaaatgggattttggggtttcccttcaactgtgaaatattacagaaatacacaagttccatacacaacggtgatagctgctacatatttctcagaaaagcagaattctaataaagaatgtatagtctgttttttatgctttaataaataccaggcacagtgactcatacctataatcccagcactttgagaggcctaggcaggaggatcacttgagcccaggagttcgagaccagcctggacatcatggtgaaaccccatctctcctaaaaataaaaataataataattagtcaagaatggtagtgcattagtcgagaatggtagtgcatatctgtagtcccagcagctcgggaggctgaggtgggaggaccagttgagcccacaagttggaggctgcagtgaattatgatcatgccactgtgctccagcctgggcaacagagcaaaaccctgtcatttaaaacaaaaacaaaaacaaaaaaaaacaaaacaggcattctgagtcgatagcagatccccattgtcctgtcatcctccaggtgaggttctgtgtcttacagattaagaacatgaccctaaatcagcagcagatgtttaaaataacacagaaacaaacctcgtatattctatattttccctagccgcttcagaatttgctatgaaatttaagggtatttattcctctgtctgtgcaaatctcactttatttatttatttatttatttatttttgagactggctctgtcacctaggctggagtgcagtggcgcgatctcagcccactgcaacctccaccttctgggctcaagtgattgtcctgcctcagcctcagctgggaccacaggcgtgcactaccacacccagctaatttttttatttttagtagagatgtggttttgccatgttggccagggttgtctcggactcctgacctcaggtgatctacccgccttgacctcccaaagtgctaggattataggtatgagccactgtacccagccagtgaaagtagaaattatttatttatttaactattccttgaaaagaggaaacaaaatgttccctctttagcctgaatgattaactttactcataagaggttcacagtaagacatgtgatttttttttttttttttttttactcctttgcccttgtatgtgacagatgctcatttgtttgttgattaacaccttttacacagccaacattaatatctagttatagcctttttttttttttttttaaacggagtcttgctctgtcgcccaggctggagtgcagtggcgtgatctcggctcactgtaagctctgcctcctgggttcacaccattctcctgcctcagcctcctgagtagctggaactacaggtacccgccaccacacctggctaattttttgtatttttagtagagacggggtttcaccgtgttagccaggatggtctcgatctcctgacgttgtgatctgcccgcctcggcctcccaaagtgctgggattacaggtgtgagccactgcacctcgccagttatagccatttttaaatcaaaagaccactagcagctgctgaaaagttctgtcacctttaattcctcatgtgtagagactctacctctctcacaggattattttgagaatttaaaatgttattgtgatagttgactaggcttggtaaactgttcagtgctgtgctgatataaatgtgataactgctgctctgtttcccaaattcacaggcagaatatgaaattctgtaatcttgaatcataatcttcatcaagggccaggcaccatggttcatgcctgtaatcccagcactttgggaagctgaggtggtcagatcgcttgagctcaggagttcaagactagccttggcaacatggcgagaccccatctctacaaaaaatacaaaaattagccgggcctagtggtgcatgcctgtaatcccagctactcaggtggctgaggcaagagagtcacttgagcccagggaggccgaggctttagtgagccgtgatcactccactgcactccagcctaggtggcagagtgagactcaagtctcaaaaacaacaaaaaaacccccagacaacaagaaacataatcttcatcaagaactcttaccataatagaattttgactattttttaagatgctaatttataagcaataggattattagcaatgtccctgattctactacattttgtcaaagtggttattattggtgtatagcaaaactattgatttttgtatgttgattatattccaccagcattgttgacctatcttgttagttgtaacagtttgaaaattctttcagattttccacgtagacagtggtatcttttgcaaataacaatagtttatactcttgttgtctgtgtacctcatttctttttcttgttttactgcattcactaaggctacaaaataatgttgaaatgaactgcttatggaagattcctgaaattgttcctgactttgttaagaatgaatctaaagttttaccatttaccatcatgtttgctgtagattttattaaggaagttcccttttgttactgattttctgttttattaaaattgtgagtgaaggtaaaaaactttttctgcatcttttgagatgtttaattttttgtccttttataaaaactaatagtgtggtatattaaattactatatatatagtatatatatgtgtgtgtgtatatatgtgtgtgtgtgtgtgtgtgtgtgtgtgtgtatatatatatatatatatatacatacatatacatatacacacatttttttgaggtggagtctcactctgttgtccaggctggagtacagtagcacgctctcggctcactgcaacctctgcctcccaagtttgagcagttctcctgccttagcctcctgagtagctgggattgcaggcacatgccaccacacccagctaatttttgtatttttggcagagatggggtttcgccatgttggccaggttgaactcctgacctcaggtgatccactcaccttggcctcccaaagtgctgggattacaggcatgagccaccacgcctggcctttttttcttatattgaaccatccttgtcttcctgagataatgtcattctcttctacctgtccctgggtaactatttaataccatagttaagaatttgcattcctgggaactcatgggatatcatcagtggcactgaactatttttcatgctacataaacacctcaattatcagtattatcaggattgcatgggaaggaatacagagatctgtggtcataggcatgagagttacaatgtatgccccacaatcatatagaaggcaaacatatcaaagtttgagaaaattctatcctagaaaggattttaactgctttaagatttgcctgtaacaaatgggttatagtttaaagaggctgagtaacactcttagttttaatttaaaaactcaagttacagttatataaggcctttcagatgtcttttctatttcagatgttgtaacagccaacataggtaagattttgttccaaagcaggtattttcatttccttgtttgtgactacaaacacagtaatgtgttgcccgtatccatgcagaaatgcaggagtgggctgatttgtgatgcatcctgcagtcctgcctgtcatcttgaatcattaaatcttccctgctttgcctgttacttgaagatcacccacgtgtggtcccttctgcttcaattgtgggccttctgttgccttctcatgttggggaccaacatgagaagtaaacgaacaacttaatgaagtaaagttctgtttactcttctggtttgaaagataaccatttcacggggcaaggttttctgcactgaatcttctttatagcctgcaacaatattgacttcattcaacaaatatatcttgagctgctgttattaaatcagcaaggagcagcccctgcttatgtgcccaggtttattgaagtcataatggcacatactttaaaaaaacataagatagctatcttaccttcagaggaatcgcagtcagtcacttacagtcaccaatatccgggaagtcagatggtcacgtacctcctatgtgtcagccatcatcagagaccttgagaagcctacagagaaaaatgcttacctctgatatcacagtctgacatagagtctaccagaggacacaatacaaaatgcatatagaaagttaaaatagtttgggcgcagtgactcattcctgtaatcccagcactttgggaggctgaggcaggaagatccacaaggtcaggagtttgagaccagcctggccaatatggtgaaaccccatctctactaaaaatacaaaaattagccgggcatggtggtgcgcacctgtagtcccagctactcgggaggctgaggcaggagaatcacttgaacccaggaggcggaggttgcagtgagccgagatggtgccattgcactccagcatgggcgacagagcaagactccatctcaaaaaaaaaaaaaaaaaaaaagttaaaacagcattatgagaataaaatcacaattcagggacacagcagaagataagtcataaataagatgttggactcatgactgcatattcggtcagactgtcagctggagggagagaggtacagataggctttctgcagaatggatgggaactgcaaaggtgggcctggaggacatttcaggtagaagaaataccatatggaaggcactgtggaaaaaagggggcggtacattcaggtgacagtggaaactacacgtgtaggtggacaggagggcatgggagggggacggggcaaggaaggcctgggaatgaagaggctgaggctgacatcctggggcacctccaaagccagccaggttgaagagttgggagtttgctttgttttttaagacttaacaaataaatatttaaagataatatatagccctttttgaaagtaattaagatcattgattgggaggaaaaatccaataacatttaggaaccgtaacacaagagaagctgcttgcccctcctaccacaagcagtaaagcctatagatgacattgattttatgttcccagatacgtggcttcaaacagagaattgttttaagtcttagtcatatgaatgaagggccttcttcaaaatcaggacttagaaatacagcagcttgtcctgttggccttgggctggtagtcagatgaggtcaagggcttgttttcatgagggagacttgttaaatacttggaagtatacgatgttatcagcaacgtgaagtttgtccctgtgaccacctggctcttgaataccacagccttaaaaatagggaacttcttgatttttttctcataattgaggcttcacctggttagcaacgtcctggtctcttcagtggcaagcatggcaggggacaccccacacgtcatcgtggtagcagtgggaggggacagggcagaaaggaccagagagttgatgtctctgcccgaaggtaccaaggatgctgagatggctctgtgctcgtcagcccctcaggtgttggctctgtcaccttttgctcctttgcccttttcttactcaccctagcatgacccatctgcaccaccatcctcttgcccaggagacaggaggggcccagagacttccttctcactccttttcttttgaaagtgcatgtatgtgttttggacagaggaggaccttctacttggatcagaggtgtcgttggcttttttgaggacgcctctcggtcttggctggagggtggtggttgcaggcaggcctgagaactggatgacccatgcagaaagagccagcacagatgtgttataatacccttcccacctcagcagacatgactaaacaaactctgtctgctttgaacaattaaagcatttgtcagagcggctcccagagagagcgaggccctgcaagcagtggcatgctctcagaggaaagcagtgtgtgtgcggtgcgcgtgcagtccctgtgctgttagcaggctgcctggccgtactccgagaagcactctgcatcgccaccttctgcatttaaacagccagaatgacctgagcttgggtacaggagtgtagcttccagactgtctttcatcagttttgagaaacttggatgctgaattgggaaatgatgatttgctttaaagaaatgcaagaaatgcaaagataaatacaagaaaaaccccaattctttccagtcggcacccattccagacttgatggtgaaatgaatcccctcctctgagaccaaccgctgttgccctcctgaccccaccctccagcagtgacccccactgagccagtatctttctctcttcaatccttcttaataataaataataatttccacgttctacctttaaaatgaagcctgagcctgtaatcccagcactttgggaggctgagtcaggcagatcacttgaggtcaggagttcgagaccagcctggtcaacatggtgaaaccttgtctctactaaaaatacaaaaattagccaggcgtgatggtgcacacctgtaatcacagctacttgggaggctgaggcaacggtgttgcttgcccctgggaggcagaggttgcagtgagccaaggtcacgccactgcactccagcctgggtgacagagtgatactctatctcggaaaataataataataaaatgaagactgccttcctcactcaccgtggtcctggctaagtgtctgctcaccacaggactatggagtcggcagagcgggcttcttgcctctctggctggttggcagggaagggctgaggcacagagaagttattctcctgcctggtgctgtcagcagtaggtacagagtcaagactaaaaccccgttgttctgccccaggtctggcagtctagaagaagggggggctgtgcagggtacccagccaaggcagagtccagaggaagtcaaggaagagtatgaatgtgagtgtggggcagggagcactgtgcattagcctgagaggtggggggcacagaggaacaggtcacttaatgcttggcacttaggtctgagcctgtttatgaatgcactggggtgcaacccacctggcaaggcaaagcaccttcctgaggtcccaccaccccctgtgtgccagtccattactggctggcattagggtgctcacctctctgtagatttccttaagcccaaggggcaatcacatggtccgcaagtctgcatattggtttgcactaaactctaccctgacaacataccataaaaatggtctaggccaggtgcaatggctcatgcctataatccagcactttgggatgccaagggagttggattgcctgagcccaagagtttgagaccagcctgggcaacatggcaaaaccctgtctttgcaaaaaattagccaggcatgatggcacatgtccgtagtcccagctactcgggaggctgaggtgggaggatcacctgagcccaggaggttgaggctgcagtgagcccagatcctaccactgcacttcagcctgggtgacaagagtgagaccctgtctcaggaaaaaaaaaaaaaaaaaaaaagtctaataacagagcagctaacatttattgagtgcttactgtgtgccaagcactgcgctaaacactttgttggcatcattttatcaaatttctcccagaatcttctcttagaaaatgattagttgttttgacttagaaactaaaatattggattttattcctcctcctcctcttcctcctctcccctccgccccacacgccaccctgtaagggactgtggggcgctgcagggctggggttcttgcccccaaggttcctaagagtcaaaagaagatttgctcattcaacaagcgtgtattgagtatgatttctgatttgttgagcatttattgatgcaatgcaccacatgagatgctgcagacacaaaactaatgcatactcgctgatctcaaggagccggcacacatcatctgcaagggacaaaccggaagtgttgtgtgctatggcccaaaacagaggaggaaacggaggaggacagagctgagtctggaaagaggaggtggaggcagagagagggagatggaatcagtggtgaggaacacaggcttctcaggctgggtgcagtgcctcatgcctgtaatcccagtgctttgggaggccaaggtaggaggattgcttgagcccaggagttagagaccagcctgggcaacatggcaacgtcctgtccgttcataaaattcaaaaattagccaggtgtggtggtgcgcacctgtggtttcagctactcaagaggctgaggcaggaacactgcttgagtccccaaggccgaggctacagtgagtcatgactgtgccactgcactccagtctaggtgacagagtgagacctgtcgtaaaaaacgaaacaacaccagcttctctcccaagaaatgaggttaacaataacaccatctccccttgtggcaaggatgggtctagatactgcatgagatgtcgttagcatggtgcctgaaatgcaatcagcagttggtaaaaatgaattattttgttgagagttaaaagtgctttggaggaggacctgagtcttgttatctttgcaccaccccagcccccagagtcagcactgcctcacatgaacaccgtgccccaggatgctagctagtaaggtgtcacagacagggtggcgaggagaagcaagccccagcctgagcgggaatgactggaggaaaggtcagagacagagcagcccggaggtgcgctggtgcgcagagcagacagtggagggttcagtgggcagtgctcttcaccccgggtctgaataatgcccggggcttgggaggcccctttggctgggcactttctcagggtggccatgctgagctgctgacccccaagccctcctctccagctccctttcatcatcaccgtgagtgttcatttaaactcagcaagacccatgccaacaaaaacaaagaaaatgatctcttagtggttatttatatggtaaacctcctctggggtgattttttttccagtccagcttgcaataatttcttaagaaagataaagtgatttttaagtgtaattttaaggagcaggcccatacgttagcttgcttgctgttattcttctgttcatgttgttcacaacatgaactttgatttgtcttctccaggtagtttgggaccacagagaaaaatcccccttctgttaaaaaaaaaaaaaaaaagccattacacaaatacttgaaagcagaaactcttctctgaaatcttctctgaaatgacgaaaaactcattaaaaactgcttcctgagaaggtagaacagatgcaagggaacacatggagctgattctttaaagatgttattttttgaagccacagttgttatttcttttctgttagccaaaatgtagccttacattttgaacttagcacctcatatttatcagcagagaaacagaaaagagtaaaacaaaagaaactagaagcagaaaactctgaattgtttataaaatgggctttaaaaatacttattaagagaatgaaccatgctttcctattttgctcttaaaaatttaagcactttcaagtgatggctgattaaaaaaacttggagcgcatcttgaggcccaggtttcccaccatcagaaatgtgcagccacaaaggaaaagtccagaatttcagcacttgtgagccgtgccactgtcagagttggaaaagtactagccagcagaaagcctcctcctccccccccaggggaaagctgccagcctatccagttggcacagccatgcccctttgcccagggcttgtcacctgcacacacagatgaggatgttcaatctgaatgagaaaggaactggagattccagcagcaccctaggtctaggagtgaaaagctcccagagtcttagcactgtgcccttctgccgcaagctggactgagtcgattctgcggcagcaggcagatgcccgttctgcaaaggcatctatatttaggtagggacaccagcttgccaaggtaaagaagggcatgatgggcgtcgcctcagaatgctgttggtcttggaacagaggccctcagcatctgtcctcacatcttctgctcacaggcaggtcctgtgttgccctgtgggttagacatgctcatggaggagaggacacctccccagagccaaggcggtctggaacgcatcagggttcttcctgaatgtgcgtccttcatgccgggtggctacgtgccgccaggcagggactgcatactgcggtttcgtagtcgctgtgctaaggggagctgccacacgccgtctgttagcaggacatggagttgggccccaaatggccctagtggtgtcaaaagcagatgtcttcaacccacagtgggacgctgctccctcccagcgcagcctggtaggcctcttgaccacctggggggagtcactgtctgcctcgaggcacctggccactttgggactgcacagcaccccttctaccctagggaggagtagctcagctcagctcttcttccccaggctcagcccaatgcgcttcaggcccacgtaggcgcagccctgctgcggaggcgcctctgcctttccctttgtgacttcctggcagaagcctccactccagctgcaattcagtgctcatcttgcacattctcatcccaaggtctttgctcccttaatggccccagctgtatggtcctatccctgcccttgcgggtcacctcctcaggaaatctgtaaaggcccagcggattcttcctaagatgtgttgcttgggggccccccttgaggctgacatttctgctggaatatttcatccttcggggcctggacccgggccatgccctgctgagccttagctgagtgcccagccctttgccccctctagctcaggccagtctttgcaccccttcatcagacaccctgcctggtgtcatctgaggtgtcctttacctgcctggctggactgaaggctctcagagggaaaggccatctcgtgttactcatctctgtctcccagtggcacccagcatggtgcccaagtccctgtggaggaaccctggcttttgtgattctcaaagtcttctgcgtcggccctccctgagcaggtttgtatggcaatcacaggggccaggcaggtctcagagcaggctctctttgatggattagggggaggtggtgacagtgggacagtagccctgcctggggactctcaggccagtgaaccgaggggacagctacaagccctacaggaggactcagctcttcagcagtggacttgactgatgattgacagatgaggcacacagggtccctctgaggagggctcggccctctctcttttcaaccaggctccttggtaaagaagcgggggcgtgcgctggggggagaaccttgtgttctcagtcttaggagagctgttctcaattcccgccttcccaagagccctctggggcatttcagaactcccgtggacctgccagcttcgcacccttgcttgaatggtgaagcatatcagtcctttttaaagagtgtctgcagatcccctaaaacaggagccccaaagcttatgctccttagcagagaaaagatgattccatgtgggatgacgcagcgttgcctgccaaaccagccatcaggccatccagtgcagctgtgggcccaggagccccccaactgctggggcctccatctccatgggttctaaaggaaaggggcctcataactggctagttggggcaaggagaccaccctcccagcccagccaggctgttttctcagggctggtctgtgagggggaggaattagaaaggactgcccccgggccaggggagtgggattggaggagaaccgagaggttttcagtagattgagaggctcattaggggtgaactaggtagccaaagaaacatctttaagaactgcagttactgaatacagcccctcatcagcgctgaggttggtccacttaacctttggtccacttaaccttgctatcaatgtgggctcagggaatgtgcctgccaggacaggaagacagccttgggctaccggctccacctggccagcgccctgttcccacagcaggaccagctccttcctaactgcttttgttttgtcctgggacagagcctggattttgggttaagtttgtgccttccaggctggggaagaagccaaaacttctgtttcccatgcaaaacgccaccacacacctagggaggatgtttgtgttccacggaggtcgccacccatctgttttcagagtaaacgtttgtgtgagcgcactctggcggggagtcccgagagcggaccctcttgccactgcacccataggtgcggaacgaacctgctgccccgaccctgcggctccgaccggggccgagcagcgaaggaccaccctggtctggtcacctacgattctgggtccagctcagctggtgaccttgcttaggccacacccctctctgagcctccatcttcccttcagcagctgtgtagggtgaacttaatgttgtgcaagatcatgtccagctctggaattttaggattatgagcttatttacgatcagcctgttgattctacctctaaaatataatctgaacccgtatactcccctccatgtctcctggtactccatgatcttgtcgcttcctgcccgagttctgcagtttagaataaacccaggcccctctccgcggaccctctgatggcagacctccatccctctgcacagggcctcacccacccagccacgtgctctgctgtcagccccccggagcccctgggatctttgcacctgctgttttctccgtagagagctgccctccctccactcctggacgggctggctccttccttccttcccatctttcagagctcagcttcaagtgttggctccactgagaggccttacccccaagtccctttctaaaagaactgttcctccatcattccacctctcaccccatttttttcctatattttgtagctctttccttgggtggatctggttttgtgttagtctcttgtcacctccactaggcagggacctcccagggcagggacggacgcacctgtcccagtcatggctgatcagcgagagccaaacatatcatagcacatggggtactgtaggtgttcaaaggatgctggctgaatggatggagacttccttcatagagccccattttccttcctgatttcttagtctcagttcccattttctctcaaagatccaggggtcacaatgagagtgattataaaacaaactacacatgcaacacgaactcctcagtcaatcccaagagggctctcactccacacttcatcatctgccctgtgacctcagattaaaactcaggcttaacatttcctgaggccctgctcggtgccaggttctgggtctgtgctttccagttgttttatgtatccttgataacctctgtatggttggtggtaaaatggagagatgtattttcctgcggggaaactgagtcctgagaaacgagctagcccacagagagctggtggctggtagagcccggatccaaaattgggagcgtcttgccccaagtccagtgctgtttcctttatacccaatgccacagagccaaagtggtacctggccgagatctggccctgaatgtagaagaggccagggaaaggtggagggaagagggcataggtcccagtgtgggattccagatgacccctgttgtccagctggctaggagatatgtggaccccagggctgacagatgttcctgagggccacagggaacctgacggaaggttggtggcatttctagaggcaagtggtcagagagagcatgggggttttgtggggactgggaataaccgagggcctcgtggcaggctgggtggcactgccctctcaacgctgacctgtcagctggttcaggaaggcctttctgaggccagcacagactctatcacaccatggaccttcaagggatagctctcttggcaaaacacccttttgccagacctaattgccagaagctgcagtggaaatgagaacccaggacatgggacgagacagacctatgtgtggatctcagctctgccatttgctagctgtgtggccctgacagtcacctgccttgtgagctctgagttccttaagtgtaaaaatgccatggtatggtagagaggaaagagactcatatttgaatatgacacagaataggcccttagtgccagcctcaggggctcacacctgtaatcccagcactttgggaggccaaggcaggcaggttgctgaagcccaggagttcgagaccaccctggtcagtgtgatgaaactccgtctctaaaaaaaaaaaaaaaaaaaaaaaaaaaaattagccaaaaaaaaaaaaaaagccagatgtggtggtgcaggcctgtggttgcagctacccaggaggctaagatgggaggatcacctgagcctgggaaggtcgaggctgcagtgagctatgattgtgccactgcacacatactgggcaacagagtgagactcttgtctcaaaaaaaaagaaaaagaaaaagcccttagtaattcttgagaatgagtgactgaaggaaggaatggacacctacctaagatgtcctcctggaagagagcatggagaagggatctgagcttcttgctattttcaatgtgaaaagctttaatctggctgtaatacaaggtcgattacccacagcttccaagaacttaccacaaaatgttaatgatatcaactgagatttttttttttcaggttgtaaagttgtgttctccatcattgtaagcaagtaacaacacagatgatgtgtaccctgcatcaggtgcagttctgagcactttatgcccactaactcatttcatggtcacaacagccctacgagggagacagcatttttgtcctcatttctcagatgagaacacagaggcacaaagagattaaataaatagcctgaggtgacatagctagtcagtggcagagcaggacccaatcctggaagtctggcttcagagacagagctcttaactccacctgatagtgattaatggctatagcagaatcagatcagggtaagagaaggcatggcactgagccggggaggccagggaaggttgggctggaaggattctgttctccttaaaatggttgggaaataagacctctaactaaatgagtgggagactgcgttggtgctttaggggaagtgggcctgctggcggggggtcgcccactttccacctttggtggttctgaaaaagacacggtatttctcttatgacatttttggtaattattgtaaatatgtttttatattgtgaaactccccccgtcttaagctatattcgttttctcttatgaatttaaaaaataaaatctattgatgcgcatacaatcaaatatatgtaaaagtgcacatttctgagctttgagaaacgtactcgcttgtggaaccagcacagttcggcgacatcgagcaggtctgtctggcctgtcctgccctgcacagccgcctggaggttcacctgcatcattgcgtgtgtcagcgcttggtgcctttctgtcgctgagtagcgtctcgctgtgtgagtgtaccagaattgtttactcactcacctggtgagctgttcttgggttgtttctagtttggagctgttataaatgaagctctgatgagtgagtgtgttttcacttctcttgggagattatctaggactagaattgctgggtcctatggtggaagtgtatgtttaacttttaagaaactgttatttttcaaattcactgtgtcgtttttgctgttgccaccagcagagtttgagagttctggttgtgccatgtgcttgtcagcacttggaagctggtagtccttttcattctggccatttgagtagatatgcaagtggcatctcattatggcttttattgtagttctctgatgacaacatctttcccgcatctctgatggggaacatcttttcatgtatttatttgccacctgtagatcttcttatgtgacccttctttcaaatcttttgcccatgtttccatcgggttgttatatcttattgaactgtaagagttcttccaccctgagcaacatggcaagaccctatctctataaaaaataaaaataaattcactgggcatggtggtgcgcacctgtggtcccagctactcaggaggctgaggtgggaggatcccttgagaccaagaggtgaaggctgcagtgagcagtgatcgcaccactgtcctccagctagggcaacacagtgacaccccatctcaaaaaaaaaaagtcttatattttctagacatgagttttttggtcagatattggtattgcatatattttctcaatgtctttggcttgccttttcattttcttgatgttgtctttaagagaggaaaagttttgaattctgaagttcagttaataatttttttctcttacagttcctgcttttagtgtcctaagaaatctttgcctatgtccaaagtcttactgatttttctttttttttcctaaaaaatttatagttttagctttttttgggggggggagggggggagtcttgctctgtcgcccaggctggagtgcagtggtgcaatcttggctcactgcaagctccgcctcccaggttcacgccattctcctgcctcagcctcccaagtagctgggactacaggtgcccaccaccacacctggctaatttttttgtatttttagtagagacggggtttcaccatgttagccaggatggtctcgatctcctgacttcgtgatccgcccgcctcggcctcccaaagtgctgggattacaggcgtgagccatcgcgcccggctggttttagcttttacatatatgtttgtgattgatttcaagttaatttcatgtagggtatgagttaagggtgaaagttcatttttctctatgtggttatctaattgttccagcaatgtttgttgaaaagattgtcctttctcgtcaaattactgtgccacctttgttgaaagtcacctgcccgtgtttgtgggtctgtttctacctctgtattcctggttatcctcatctcagtaccaaactatctgctgcctgaagctttatagagtcagtgggtcagtgtctgccttgttacttggtctccgatggtccggcccagtggcagaggatgtcaccttgccagcacatgcctccctaggattggatcatgcccctctcctgagaagccatgtcacctgcatttgcattatttgaaggtgcaagatgtcccttctcaccaagtgaagttggtgtgtttatatcctgcgtcctccccacctcaccctggaactctgagctctccagttttcctcctcctcttctccctctctctgatgttgaccccaaaagccctttgaggtagagaacaaacatgtaaaagtgcctgcctttttaaagggaaacttttcaaaaacttttctaaggaactggaaataagaactacgtaacagaaaccatttcacaaccttcagcatggccatttatctcaataaccatttcgtttaaaatgtgggccaaacatataaatcatatcttgaaagaaagcatgtgggtgccacaaaaatcaccctgtattcttaccatctaattttaaaaatgtgtttcgaagcctggaaaaaggcaaacaagcctggggcccgtgccctcctcccacagggccagggatgcagcggagaggctggagcactggacagcataccccgttgctagccattcgcgtcagcgacaggagccactgctcttgaaacctccctcctctgcatgtcacttggtagatcaggagctgagagccccaaaaccagtctgcttctaaccagtgcttggacaagcccttgcacttaggcagtaaacactccaggagagatcgtgtagatattggtgcttatttagcgacatccccagagggagggtgccaaatatagcgggaccctgaggtccattttccagactaataagagggggagacctagagcagcctgtcgctgtgggctgggaattccagagtcttctgccggaaacctcactaaggattgcaaggctaagatgtcagcatttcctcttggcaggtttcatatttgcttcttagcacttcctgggagggaaaaacaaaagacaccggcagatgtaccttgccatgggccatggcccttcctgtggcccgtgtacctctcacctgggtccctggagacaccagtatccccactgctacactgacccttttttctcatctggtcttccatatttcctctttcccagcctagtagctgctctcaaccaccctctgcttccctcttgctcctcctttaagatgacagtcccctgggcatcctcccgggcaccccctcccgggcgtcaggtctctgtttccagcctgggctctgttcttgggagtgaagaaggtgacgtttggaacggctgagcataacctgtgcctcaagtgtagctcggaggtgctgaccttcctctgggtctaggttctgaggcatgagactgttccttcagactcctagctccttgtcagttgcagccctgagcatctttgtagggggagtggggaggatttgggggatggaatgcctctggaggtggcatgccagcccacacgtgtgcacaggcctggtctgctgcccccctccctggaggtgcctttaatcagctgcacaggccacagttagatggcggcgtcctccaaccgaccccacggtgcaggagcagccccaccctgccaacatgaaacctgtcgttttctccttttaatctcctcatccctggctgcccgatgttccttgtgtaagtcacgctttacatcttaccagccgccttggccatgactgtctttgtagtagaaccttaaccttgttcctggaaccccggagcagtgggtgtcatggggcagtgcacgtgctctctggactggcagcagggggctggggttggaaaggctgggagaactcctccctcagaagactagaagtagcccccacagttctgtttccttcttgctcccatcttcccccctgcctcagccctcagctgcctgtgtctggagagctgagtttggggcaatggttccctgagaagaggggtttggtcttaattcctctgccaagtctggtgcccaggctcgaggaggcagtgagtgcttagagtacaagagtgggaaggcaggcgggtgtctttccaaagggaggcaccggggtggtgtgttaggaggagcacaaggctggccgcggtggctcatgcctgtactcccagtgctttgggagactgaggtgggcggatcacctgaggtcaggagttggagaccagcctggccaacatggtgaaaccccatctctactaaaaataccaaaaaattagctaggcgtggtggcgcacgcctgttatcccggctactcaggaggctgaggcacgagaattgcttgaaccgcggacctctggggacgggagggggaggacccatttcatctctgctgaaggatggtgacaggctggggatggagggtgggcaggggcaagggctggggctgctggcagcagacatcaagggcacccaagtccctacagggcatgaaccatcagccccaggctggcctcaccatctgctctggccttccctgctttgtgcagtctgcctgctcccttccctcttggttcactccttcaggctgctcatctgcccgcaccagcagtctgaagcagtcacaccggccatccttggcccaggggtgaagggatctgggagcttttgcttctggattcattgtgagagtaggcagggctaattctgagttgccccaggtccccatgctgcgatggggctccgggcaggaatctgggagccaggaagtcagaccctgggccttcacccggcagcacttccctgtggccctctccagggcccaggtatggctgcaaaagcagacctgggtccagcaagggaaatggttaacccgtgaggccccccatctgcagagccccacagctactgccttgcagagcaccctttttctgaccagccccaatcctgcctggggcctcttagagtccagaagcaagaagtacccaccgctgtgtgtccctgtggcctctggcccagagccaacccacagtgaggccaggaaggggaatgagggcgtcagtggcctgggacccagacttccctcagaaagctggcctgccaccccagctgctcccgcctggggatgctcacagtgcttgcccccgcccacccctgtccttctgggccctggagtccaagggcctgacgtgctggagtcctcagaagccagctgggccgaggggcccgcccttgactgtgtgtgtctcaggtattatggtcacaccaaaaatccccctttcttttctgccctatggaatcatatccagaacagatggttctgaatcattgttcctgcaaagcctctctactagaccaggctctgagccggggctggggatacagtggtgaccagacagaccaggccctaccctcacgcagcacgcagtcccctggggaagtcagatgcacagactacaaggtgacagcaaattatggtggggtcgcaggaggaaccaagagggctgagaataaggtaggccagcagggaagtcgctgcagacccagcggagccagctgtgtgggaggggctgcggagaggagctttctaagccaaagaagcctgtgaaaaggctgagcaaggggagagccaggaggctgcggccgctggaatctggtgggccagagagagggtgccggggtggggagcttggaggggtgtgcagggccagggctgggggcctagggccctgaagagtttggacttcactctccctctgtgcaaggggaagattttgaaggctgcaaaacttgggaaagatgatgggattgtttttttgagaaattcagtctgatgccctgtgggtggaacagtgccagaggcttatggacaccccagaagaaccacggtgacggatacctgtggggacaacagatccttctcttgtgggcatcgagagcctgcgcagtgaccctggagcgagccctgcctcccatcctcggctcccggctggagagtctccacggcctgcagccgctccttcctctctgctctttcctgcccctgccaggccacctccctgtctcttcttgtccataaacctgacctaggacttcacggaccaagccctaacccacagccttctggccttggcagccccgccagccctgtcccctctctgggcctcggggctgtgcttgggctccgtgtcccgagcagccctgccaggcctagctctcctgggcgtgtgtctctctgttgtcagcccccctggcggttcttccttggaatcatcttctggatgtcccctctcctttttctcctctagtccctgtagccaccccctggcagtgctcagtaagggctagcaaactagcagcctcctgcagaagaagtgggggttagcacccccatacccccattgtttcccggaggcattttgggaggccaagccagaggattgcttaagcctaggagtttaagaccagcctgggcaacatagggagaccccatctccacaaaatataaaaaattagctggttgtggtggcatatgcctgtagtcccaactactaaggaggctgaggtaggaggattgcttgagcctgggaggtcaaggctgcagtgagttatagatggcaccacactccagcctgggtgacagagtgaggccctgtctcaaaaagtaaagaaatgccaaaactggatttttttttttttttttttttttttttgagatggagtcctgctctgtcacccaggctggagtgcagtggcgtaatctcggttcactgcaacctcttccttccgggttcaagcaattttcctgcctcagcctcccgagtagctgggattacaagcacatgccaccatgcccagctaagttttgtatttttagtagagagggggttttgccatgttggccaagctggtctcgaactcctgacctcaggtgatccgcctgacttggcttcccaaaatgttgggattacaggcgtgagccactgcgcccagccttattttaaatgtttacatttaacaaatgaacgcttttaacggacacacagaaatataattgtgccattcccaaggtaattacagtgtttataaaagaagaaccttagttcatggcatgcttcaggcagtgtggtccagaaatgggacccaagtttgaaattggatgatgagggctcctttcaaactcgtctgtctcctttggagagagttaaacctcaaggccctttgggtgtgtgtggtccaggctgagccttctccctcattccttgtgatgggcccaattgaaaggtccctcttcccctaatgcagagtggcagcccatccctgccctcttccattgcagggcagcggccagtggggagcgctgaggtgctcaggtcaggctgaccagaggggctgagcccacccttgccagcggagagcagcacaggctgatgccatcctctccctaactgtccaagccatgggctctgccttctgaactgggtcataccaaggtggggacttgggagccaggtcaggagctggcctgtcctttcggctgcccaggtttattcatggtgctggtgggtgtgtgctgttgctcttgggcacctattgtgcatttgcgtgacaggcggtgaatggaagagtgtctggggcccagagggcagaatcagagactgtccttaatcgtctttagagggaattatgtttaacaggaagtagtgagagaaagtggaaaaggcctcttccttcgcccttgctagcttggtctccttgacaagttctgctgttttctctgtgcttcagtcccctactttgtaaaatgggggcaaacatgtgacaccattgtcctcagggctgccgggaagagagtggaggcaggggtttgagtgacattcccctgtgtggacagaccacgtttcatttattcatcagttggtggaaactggattgtttccactcgtttcctattatgaattccacgtttaacttttatgaatactttcctatgaatactactgtgtttgtgtacaagtttttatgtggacacgttgtcatttctcttgggcagttacctaggactggaattgttgtaccatatggtaactgtgtttaatttttggggtaaactgccagctgttttttatgaggtggctgaaccatttcacatttccagcagcaacgtatgaaggttctagtttgtccacatccttgtcaacacttactatgatctggctttttcactgcagccatcctagtgggtgtgaagtggtagcttatggttttgattcacattttcctgatgactaattatgtttgagtatcatttcatgtgcttcttagcaatttgtgtctttttctggagaaatgtctatccaacatctttgcccctttttttgttttgttttgtttttgaaacagggtcttgctggagtgtaagtggcatggtcatggctcactgtagccttgacctcctgggctcaagggatcctcccacctcagcctccagagtagctgggactataggtgtgcaccaccacacccaactagtttttaaatttttttgatagagacaggatttccctgtgttttccaggctggtcttgaactcctgggctcaagtgaccttcccaccttggcctcccaaagtgctgaaattacaggcatgagccaccacgcttggacttttgccacatttttaaattgtgttttctttttattattgcgttgtaaatggcctttgtattttttctttaatttcttaaagatggggtctcactatgttgcccaggctggtctcaaactcctgtctttatatattctagatacaagtctcttatcagatacatgatgtgcaattattttctctcattctgtggctatcttttctctttcttaatagtgtccttggaagcacaaaaattttaaattttgactaactccagtttacttattttgttgttgcttgtatttttggtttccttttttagtctttaaaatatataagatatatgattcaaaattaaaaggcatgctcagagcagtctcgccttcatccccacctgccctctatagggaggcatttaaattaatttctccttttatcgttcctgtgtttatatttgcaaaattaaaaacctttttttcttaaacaaaggtggtatgctacagatactctgcatttctttcttcttttctttcactaaagaaatcccggaactgagcccccgtatcagccgattgaactcactgtgtttcagggccacagtagtccaggtgtggatgtgcatcaaatggtttagtcagctggttccccgctgagggcctcttgggcctgttcccagtcttttcctgtaagagatcatgcagcaggggataatatcctttcgtatagtggaggtgtgtcttcaggacagactcctaaaagtgagacggccgggtcaaaagttaagccgtaggaatcgtggctgttgccagattgtcctctgcaggggttggactgctctgtgtgtcaccagggaggtatgagagtggttccaccacaggctcacaaacagaacatattgtgaagcagtgaggttcttgccagcgttatctcagtgcagctttttttttttcaatcagctgtattgtgtgatttacatacaatgaaatacacccactttaagtgtccagtttgttgagttgtgacaaattatctacttcctgtcaccacagatgggtttttgcccttgtaggatttcatataaatgaaatatgaagtatgatgtcttctgtgttagggttgttttcttaaaaactgtatatattcaaagtgtgtaaggtatctttatatcacatagtgaaatggttactacagtcaaggaaattaacacatctgtgaactcccatagcatgtggtgagagcacctaaaatctactcttagcaaatttccagtgtacagtccagcatgattaacagtagtcctgtgctgtatatcagacctccagactattcatactacgtaactgccaccttgtacccctcgtacccttcgaccccattccccaccccttccagttgggcttccttgacccaggataaagacactgagattcatatgtgttgtcgcacccatcagtagtttaatggcttaggagtatccactgtacggatacaccacaatttctctgctttcccgttgatgatcatttgtgtggtttctagtttgtacctattctgagtaagactgctgcggacattctggctcaagtttttctgtggacatgtgttttcgtttctttggagtaaacaggagtggaatggctggatcacatggtgagcgcacacttaaacagtcactagaccttcctccaaagtggttttgccagtttccatccccactaggagcagtgtgtgggcccttcctgccccacatcctcacagacatcgggcatcgctggcctttagcttcagctctccgaggaggtggggtgcactgtctctttatggttttgatttgcatttccctgaggactgcaaactgcacgtcttttcttatttgccattatatttcctctttggtgaagtttctcttccaatcttttccccaaaaatcaagtttttgtctctttattattaagttgtaagagttctctttattttctaaatacaagttcttttaatatagagatattttctcctagtctgcaacttgccttttcattttctcagtggtatccttccaagatcagaaattttaattcttgtgaaatgcaaacccatttttttttctggttagtactttttgtgtcttaagaaacctttgcatttcctttattatgagtagggctgtgcatctttttttttctgtttaagggccatttgcttattttttctgagaactggccgtgtctttgtccactttttaaaaatttggtctattggtctttctcttcttgaattttatttatttctttgagacagggtctcactctctgttgcccaggctggagtgcagtggtgcagtcacagctcactgcggcctctacctcccaagctcacaccatcctcctatctcctgagttgctgggactacagacacatgccactatgcctggctcatttttaaaaaattattgtagagaaagggtctccttatgttgcccaggctggtcttgaactcctgggctcaagtgatcctcccgcctcagcctcccaaagtgctgggattataggcatgcctggcctctcttcttgatttctaagagctctttgtctattaccgagatgagccctttatggtatgttgttatgttttctctcagtttgcctttttgactgttttcccgtgcatattgcatgcatgtgtttttgcagagtccagtgtatccatttttttattgcttatggatttgggatcataggccttccctactcccaggctataatgagcttacccgtgtttgtatctagtattcttatggtttcattttctctaacgtttggatttttatcccatttggagttgattctaacatgcggggtaaggcatggaatcaattttatctttttccaagtgactctctacttctcttcatatcagttttttaaaaagtctatcttttcgtaatgagccgagatggcactccccaggccattatcattaaaatccttgatttccacatgttcttggacatggtcttctcgtttctgtactcgtcgtgtcctgcgggccgtctgagtgttccgtgctgacgcaccctctcctcctcgggggtttcatggcgtctccctcggcccatggtgggggcttctcaccgctcttctgttcggagggtttcctgggtgtgtctgcttcctgtttttccacatagcctagaaccagctcgcccggctccagaaaacatttgttaactttgaaaattgagactttgttaatgtattcactttgagaaagctgacatctttatggatgttgaatcgtcctatgcagaaacaaggggtgtggctctatctactccagtttacgtctttccaggagagattcttctaggactgtcgcagctgttttagaggcttcatatggattctgtacatccgatgttaggtttattcccatgtgtttagctttttcactgcttttataattttttttaaagtttttatttttatagagagagggtcttgctctattgtccaggctggtctcaaactcctggcctcaagcagtccactcgcctcagcctcccaaagtgctgggattacaggcacgagccgctgtgcccagccaatataatgggttcttttcttttcttttttttttctcgaggcagggtctcaccctgtcgcccaggctggagtatagtggtgcgatctcagctcactacaacttctacctcctgagttcaagccattctcctgcctcagcctcccaagtagctgggactacaggtgcccaccaccacgcctggctaatttttggatttttagtagagacggggtttcaccatgttggccaggctggtctcgaactcctgacctcaagtgatccacccgccttggcctcccgaagtgctgggattacaggcgtgcgccaccacgcccggcctctttcattctgttttgaactaaacattgtttgcactgcatgtggtgggttataattggttgttgtcaattttatatcttgctcttactaaatactttttcatttgtattctaaggatatcttagcacttattttattggggtttccaggtgtgctttgatattacctacaaagagatcatttttccttagggttgaatgtttttaaaggtttgtattacatattgccaaatcttttaaaaaatatggtaccaatttatacttctcttgtggcagtgttttgccatacccttgtcggcactgagtattgatattttttaaaatgtgccagtttactatgatcttcactaagaggacattcactgtgccccttctccacaccagttgcactgccaaggacacagctgcggtgaggacacagtagagcctgcagatcccagcccccagtcccactccagtccctgtccctatccccaggagtccctgttctggttatttcttgaggtttcaaatgaagatggctgctgccctctgagcccagccaatgggacgaagccagtggagagcccgtccctgccccagagattcgctctggaaaatccctgagtggttttgtaaaatgcattttacaaaataataatccccgcacaataagtcttctgggtgtctcgcaggatcccctgcacagctcaggcactgccagcagccgcatcccctcgagtggctcaatctgtccaggagcaaggggtcagccaggcaccttccagggccagtcccaggccacccagtcccagtgtggctgagcacctatgcctcttccccatagctaaaaacccagtaaaatggatgataaaatgggtaacacctccctgaaagtttctactttcctataaagcccagccccggcccaggcccgagtcctcttatgaacagaacaaccccaaccacccatttgcagagggcactgctgtttggtactgaccctgccctgcccaggctggcagccctccaaggaggctgggcaggaggtcccggaggacacggcccacaatgctcacccttttcattctccatcttgccccatcacctcccacctcggccccttcctccaggcagcccgccccgcccttttccacacacccctggttcccagcactgaagcttgcttgctgtgtgatctcaggccaattgccttacctctctgggcttgtttccatcttcacctcacaggtagatgtgaggtcacctcacaggtagatgtgaggagtgaaagagggagtattcgcagcaggtctacacagcgtgtggcacagagctggctacatgaatgtgtgttcgttgaatgggagagtgaaagaatggatggattgtgctggcaaaccctccaggggctcagtttcttccactcggaccatcagaacccagagatcagatccaggagctcctaaatgcaacctttgttagaaacacagctcccctgccctgcactgctcagtcccaccctgggggagtttccagccgcactgaggatgagctcggtggggacctgacccagagatagggacacctggtcactggaccgcagaccggcccatccacagcctggctgggctggcatctagacctcgcttggcagtcccctcccaagagctcagatagtttggcctcgggagacaggggcagtgagaaggctgcctcccctcagcctgggagctgggtcctcaggagagaggaaatttccttctatttattttcgacatcctcgactttgaaagccaagctggtgttgatatttaccttggccaggcctcccatctccccgggccagcctcgtgtaaacatgctgttccttctctcagctctgctagcactgaggtggccttttgcaaccaattctaggaatttggaagtctgaaggcgtaggttcagggactggccctccagggagccctgggtgccaggggccctgggacctgctgtgctggccttgggctctctccctgggggctgacaccaaggactgcagggaatgaatgggcctgggcccatgggggtgtcggccagggtggctcttgctgggtccctcagttctcctcacagccacgttggggcctcctgctccccaggttcactgcgaggctcagactcggaggacacgcattgagggactgtggcaggatctggctgtctccactgtctttgctccaggccacctccaccctggctggtggggagggcttgctcttgagccagctctctagtgtgagttgggagtgtgggcagctggactacagttagagggaacatggagcaggtgcccagggtgcagcctcccaaggcagcacgtgcccatgccagaattcctgccctcagggagcttgccttccagagggcaggtggaccacaaggagaacaagctggcttggggtgggggtgagtgctgcagaagccaggatgagcagaggctggctgggtcagggacggtcccccgaggtggacatgcaggaggtgagcagaggcacattccccagtgcaaatcccagccctcccctgttggttccaccaggtggttcacacactagtgacgccttggcaagtctgagatttggtttccttgtacagaaatggggtgacagtccctcagaaacaagggagtggttctgcaggtgggagctgccatgactgctgcggttttgaagcatctgtgtgccccccaccgggcagtgggacatctcggctgagcctctccccttctccatgcagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccaaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaa

SEQ ID NO: 2336 - DNA, 285130 bp, Homo sapiens; identical to SEQ ID NO: 2335
  source 1..285130: mol_type = genomic DNA

SEQ ID NO: 2337 - DNA, 285130 bp, Homo sapiens; identical to SEQ ID NO: 2335
  source 1..285130: mol_type = genomic DNA

SEQ ID NO: 2338 - DNA, 10260 bp, Homo sapiens
  source 1..10260: mol_type = genomic DNA
tctggtcaaactccctttttattaagggttatcaagctgtacacggtccctaccctgctccgctccgagttcgggcagcgcaattcaccactctcccaaagccggaccacagctgggtgaggggtgggacagagagtaggagcagtcccagcatgcagtgcagcagcccaaagcctcgggcgaggcatcgcccttcatcccccttcagggcacagcgagatgcgggccagagctcttttgctgggacgcacacagccaaggtcaccctccagcccggtctgtcccatgtgcaggtgatggggggtacgataagcagcaatgagggcccaggaagacctcagtctcctgggggcccatcctaaaagatggcaagggcagcaaagtatttccatcctgctcctacaatttagaaaccttcttttttagtgtcaaaatatagcgttgaggggagctggacgctagggtcttcaccctaacgcaaagcaaaagccgaacggaacgggagcaagcgaacagaacaggagcaagcagcacacacaggccagtgatgtgcaagaagcggagagaggtgagccggctgcagcactgggcgagaactgcgggtgaggtaagggccacagcctgacctgctcatctattgagggggctagggaaggttgcaggggttgagggtccaggcccaacctccccactccacagttggcacaggttctccctgcttggcagcttctatcgtgggcagccctctggggacttgcaggggtaggtgtaaaggtggcagtactggggctgggctgggggccagtttctagcaccacactctgagccaagggggtcctggggatgaggctagagtcccgtgtgccctcggttcctaggccccaaattcctctcctggggctgtggcaagcccagtgttggcacctcccttggccaggcacagacacacaaacaccacacacgtggggccagggaacactcagaggagccgtcccatggcaggcagacgggatggcagggcagcggtggcctccatcctgggccacaggaaccctgctcagccttgtctatacctgtggggagaaagggttggtaatggagatagtcttcagcttctggttgatacctgctagccccatagaaacctagaggtaaagggacaggaaaggttgattcctggggaggtaaggtaaggaaaaaccaagccctgcagagcagttgagaaaagaaggggtagtgtgttttggaagggagggtacagtatctctgtgtgggggtggggcatatcttccttcccctgaaaagctgttacctcaccctggaagttactatttctggcagtttttcctaggccccggggcccttaccttgtgcacctgagggggtagctcatcctccgagccctcttcgggcacgggctcagggtgccttgatgccgactgcccatcttctgcccaccctccaagaggcagccgagagaaatgagagggaaccctgggcactgtgccaggatctggagagacaagtaagagtaagcatactcatagaaggaacacaagaatgaggaacagggctggggggctgcttggggggtgagtctttgggcctgttctctcagacctctttcctccccttgagaggccctggaagaaccacccttccctgcagcctctgtttcctcctatacccccactggatacctgtgatgccaccgtagcgcctctggaagcccccatgcagggcagtggtctcaggagctccaggccggggtgctgcacagggatagctagcagagcgagggatagactggggggcccgggcgccctctcccccttcatcaggggcgctttctccactctcatcactctcccggcggtgccatacatgccgctcaggttcagcctgggcctgctgcttgtggagctggagaaatggggggctcgttagtgggggacagacggatgtccatctgaaacagctgccctccaacctggtatcagtcagttcccgctttaccccttccctgagaatccttgcctcagagcacctattatgttaatagtgtgtaatatacctctgatctttacaggttacattcacagcagatccccggaagaagcctgtgttgtaatggccctcattttacctattcatttgattcaggaacaaactgactgacggtctaagtgccaggcactcttttaggtgtggggagatagcagtgaacaaaacagacagaaatgccagcccttgtgaggcttatatactggtagaggagatatggaataagcaaataaataaggaaaaaacatgatatgtcacatggtgctaaatgctatggagaaaactaagacaggaagattcaggagggtgggcaagggagccttttactgagagtgatcagagaaagtctcagggaaacggcagctgcagagacccaagaagaaggaggaggccatctggatatcccagggaactggattctaggcaggggaaactgcgagtgtgtgaaggccctggatgagagcaggcttagctaaaaaggatattaagaaggtagatatgggagtggaggtggcagaacaagtaaatggcagagaagggtttggaaccccggtcttgcttctccgcatctaaaccctctactctcttttttagctgtgcactcacctggtgcatatagagggcatgcaggctcatctctgtggatgcatattctgacagcaccaggctctgcagctgtccttcccacacgctgctcccggagctggctgtcctggcatccaccctgtctctcccaacagagacagacagcagctgtgaacttctctgagacccacacaagctgctgagggctgccgtgccctcccatcttggccccgatttactcacccagagcctgtcatggtgctgtgagcccggcctgtgggcgcctgcccgggttgcagcggggagaaggagcgcagggcagaggcgacttcagccctgtgcctggagccctgcaggtctctgggcagtggagggccccggcaggatgagccagctaccacatttgcgataaggctcaggggctatgaacgaaacgggtaggtagaattcttgaggcaagagaaaggtctctggggtcccctagtattctgtatctcaggccccagtggcacatactgaagagacagcaggaagccttccaccccatgcccggtccctcaactcccagctcctgaagtccactctgcccatcatctcccagtcaccaggaacacacctcagactcagattgtaaggactggatagacgtaaagagggcattttcagggagcagacccccttgggcgaggctagcagctgctccatcccgctgaacctgctccttgaggaagcctaggaaggctgtgctctcacgtggtggctgccagccagggttggtgatggcaaagtgcatgagtgacaactctgtctttccatcctcagcttgctggtacactgaggcctctgtctgcccagcagatagccactgcacaaggaagagcagagtaagcagggctgttctcttccaggagccttcctgcacctttcctgttagtggggaggccttacccttggagaacggagaccacagtatactgtcaatctttcccagggcactggtgcccccccagacccaggaggggctgcactgcatgctgagccagttacttgtgttgtgccttttttttttttttttttgagatggagtctcgctctgtcgcccaggctggattgcagtggcgtgatctcggctcactgcaagctccgcctcccaggttcacgccattctcctgcctcagcctcccgagtagctgggactacaggcgcccgctaccacgcctggctaatttttttgtatttttagtagagaaggggtttcaccgtgttagccaggatggtctcgatctcctgacctcgtgatccacccgccttggcctcccaaagtgctgggattacagacgtgagccaccgcgcctggccgtgttgtgcctttcttaagggagcttggccaagggtgcgaattagggctgaaatccagcccaggctcccaagcagtgtgcccctggtataggactgcctttgtgtgactcaggagaggtgtctttttgcggttttcccaaagacactgtatgttccagcatcatcccaggccacctggctccctcctctcccagtacctggggatgaccatgctggcgaacatccatctgagcaaaggagcaggtatctcccacaccaacgacctccacggtgaagtttcggaagaagtctataatctccagggcccgtgggcgcaggcagaagatgaggatgaggggtgtgacaatggggctcagcaactcttccaaaatgaacacctaaaagggcgggaccaaggtcacaagcgagcaggagggagcccagccctcaccaccgagctaccagccagtctctagcaggccctaactccaactccactcactgccttgtactggaagagctgggcaaactcgtcccgggtctgcgagcggtgggcattaccctgccagtggtcaggcatgtagtggatgtgagcgaggatcacgcggagcagctgctcagggcagaacaccatgtgctggtccgggataaaggacctagtgggatcaggatcatggtgagatgtatgcctttcccaggaatgctagccggcttgctcccgcctgtggccctggcccacctgcacacggtcacggtgacccccaggagtgtgacggtggtcagcacatgttccacagccaacacatcttcgtcataaatggtgagggcaataagcacagccaggatggagccagcgaagaaggctccattcttggccagcagtgtcaaaagaggtgacaagaagcaattcatgtacttggaggcgggcttgtagccacggttgaggcgggactgcagctcgtgctccagctcgttgaagtggcggaggtagcagcggccatagagtgaccagcagcgtgctcccagggcccccggctcccgcttcagcacctcagcatagctgaagaaggcatagaggatttgccatatgaggatgagggggcacagcaggaagttagcgatgccaatccacaggatgcggttgctgaggcgctgggccagctctagccgttgccccccacgtttgtactcggccttgaggctccattcattgagaaacagagagccaggtccccagaagaggatcagctcaaagttgtacttgagaccacgggtgaagaagacagcttccccgaggccaggcaggcggaagcgcagaggcaggagggatttgttaaccagtgccaccatgtagttctggaaacggaggatgcggtggtagatgtccagttctgtcagctcacgtttgtggatgcagatctggtgctccttctgcgtctgcacgatccgggcctgcacttcttgccacgtgcaatacggaagggcagactgcggggtggggtggggaagagacaaggtacggaaggtggggttgttgcctcgacccctttgccctatattagaagtgagattcaggggttgtgagcttaagagacagttcctgatttgtcaatgacagataaggataactgatgcccaggaatacacccacacctcccaatacgtcttagactatgggctaactgcccaacttcccagtcttaccatagggatgcgcagagcgtgcaggtagaaggagtggatctcccagtagcagcaaatgttatagatgaacttgataagccggtggatccagaagacaccagcaatgaccaggatggtgataagggagccattttcctgaatcctggtggggaaaaagaaggggaggagaggtggccctcgaggaaggagtcttggcagagacgctgctatcctgaagtatttttgctagaccaagcctgagtcagttctggagtatgagttgctgcctcagactccactctattacccacctgctagcagaactcaaggctatggtgtcctcttgacttgcagcccttacctggcactacagacttgagcaggcaaaaaggcgtctggcagagtgaccttgacgggttcagtagggtgaagactgtggttcaccatcttgttggcaaataggatgtcatagtccacgcagctgaccaggaaggtagtgaaggcaaccacaaagaggaactgcctggggagttgggaagaaggggtgcagtctgagagccagagaggctccagtgaaacccagtgggaagaggagagtctggaggtggcagaacaagactgggaactggaagggcctggagaactcccagtgggccctctctgctcctcagccccacaggactgtctcaggcccactctttgctcttagcctcagctgccacagctgcagcctactttcctcacctcatggtaacctcagccaccactactggactctcgaaggtttcatcctgtgggtctctgatctccagtctctgatttccttttgaggttgtagttaaaagcccttgggggagttttctgattgagggagggcttcctaaccccttccccttcggcaatgctatatggcttctctctcccaggaggctctctgcctaggagcaggccatggaacaggcaaggcagaacagaggcttttctctgtggctggcatctctgagacctcctgactgaacaatgtacgttccattggagcgttgagatgatcaaggtcaaggcctgcattctttttttttttgagagagtctcactctgtcagccaggctggagtgcagcggcacaatctcggctcactgcaacctccacctcccaggttgaagcgattcttgtgcctcagcctcccaagtagctgggattacaggcgtgtgccaccacacccagctaatttttgtatttttagagcctcctaaagtgctgggattacaggtgtgagctgccgtgcccaaccaaggcttgggttcttttcatggaagagataaggcttggaaagcttttcttgtaagaaagcttggccgggcgtggtggctcatgcctataatcccggcacttcgggaggttgaggcgggcagataacccgaggtcaggagttcgagaccagcctggccaacttggtgaaatcccatctctactaaaaatacaaaaaaaattagccgggcatggtggcacatgcctgtagtcccagctactaaggaggctgaggcaggagaatcacttgaacctgggaggcagaggttgcaccgagccaagaccactgcactcctgcctgggcgacagagtgagactcactccatctcaaaaaaaaagaaaggtgaagctgtaagttttggtgccacacccagtccctgaactacaaaggtttacggagttttagcctaggactgagttgtactggcaggttgggccaagtgtgagtgcaaggagaggaaagactaagatgtattctttcaccacatcatctgtcccttcttatacttacatgagctcaaagatctccccgatgagcatacatgtgaagccattcttctggtgcagattataaacgtgtaattgttaagaaaaagtagtcagtaaagaaagcaggtaagagcacagactttggtgtcaacacactcaagcttaagtcctggctctgtgactttctagctgtgtgactttaccaagttacttaacctgtctaaacttttgtctgtccatggtggtacattaggaataaataacacttgtctcataggagtattaggtctaagataatgcatgtaaagcatttaacacagagctgacacagaatgagtcaaaagacgttacttattacgattatttacatcccatcaaaaaggaggctcggctgggtgtggtggctcacgcctgtaatcctaacactttgggagggcaaggcaggtggatcacttgaggtcaggagttcgagaccagccttgccacatggtgaaaccctgtctctatgaaaaatacaaaaaatagctgggcatcgtggcaggtgcctgtaatcccagctacgtgggagactgaggcaggagaatctcttgaacccaggaggtggaggttgcagtgtgttgagatcgcccctggactctagcagcaacagagacagactccatctcaaacaaaaaaaaaaggaggctcacccttagaaaggcttctacaaattaacaccacaaagtggacacaggcacacagatcttggtaaatgtgggctatcattacttaacgatgatttcaccagcctctttcagcctcaggatgagctccattcccgtttccaggtattagagtcaaacctacccccacctcccaccagagccccggcttagagagacattaaaggtcccagagctccaactcagaaacacaaaggatattcgagagaagaagaggtcaaggttttcaatatggtgccaaggtgctgtgggataggaacagagatgtcagagccctgggagaacacaagccccttgctctctccatgttcttccatcaactctccctatggctgtcatatccaagaactcacacttgctcccctcggcgacgtgcaccaacaggtcctcctcccctgggggtgaatcactataggaggcctctaggcgctggtattcagtgtcaaactgcgccatcaccaccgccccctgtccaccttgaccacctgccaataaggaggaagaagagaccctgattcagttccagctgctgcccatgggctgccctgcctactgccaaaaggagaaagtacccttgggctttgtccactaccagcctccttggctcagaggcagaggagtagtgacacaagaaaggcagtaagctcagggctgggggagccttaactctggccagtctgggtgtctactgctgctttcctggcccaaagccagaatctgtccctttgttgggggctgtttcatcttctatttaacggacagaagagtccctcccccgcccatcctgggaaccctggtctcccaagagactaacagtttggaagcacttcacaaacaaatgtttgagaaaagcacatggccctaccagctccatggacagtatgtgctcctctccagccctcgatgctctgcagctgctggaggagaagatgtcaggccccagagagtgggcagtggggataaaaaggaacccaaccctcccagccatccacaccccaccaagaggaggccaagcatggggcaggaaggctgcagtggggaagaagcacccttccagcccaggactacgagcacttcctctggctgtgctaaaccgggccactcttccaactccagggtctcaagaagtaacttagggaccccatggagaatgagtgggtacagacctgaggccaggggcgcctctggactatttctccattgccctaccttagcctcagaaatgacatacttctcagggtccacaaaacctcaagagtctttcctgaagaggacctttctggtcaaccccttctcttacttccctagcaccaaagatccagccggtgagcaaaccttctggatgggaaaccttgactgggtcagtgtagacccccgatcctaggtgaatttgtgggttccctaggtcctgtaagccaggcatggtcgaggtggtactcacctgtccgtgcagcccctgggggccgtggatcttggcccagcctggccccggtgggattccctgggctagtgagagccctgcccctcagggaagtcaccactcacagggtcagtgtggaccagggcccgtggagccccggccggctgggcctgggctcaggggttcctgcggatgttgcagggatcgagtcagccttacagctgatagcccgggtgggttggcttgcctccccacacccagccgcggcgaccgtggaccggagtccacctcgccccagggtcgcccggccccaggccaagggctggcagctcccaacagcggacaacctcgcgcgcggccccggcgcccgcgcgcgcccccgtctgcgcgcgccagcaatcaaaacattccggctgcgcgcccccgccccgccggcggcgccccttcctccgttacccgccgcgagctcacttagggctccgcaggcacccctgggcaaggccagacacggggcctgggattccaataaccggtctcacgtcttacctcaggaacagcgacccgggtgattccagaggctccgccggctccgctcggctcggctcggctcggcgcgacccgcggcgctaggccgggtgtctgccactcact

SEQ ID NO: 2339 - DNA, 10260 bp, Homo sapiens; identical to SEQ ID NO: 2338
  source 1..10260: mol_type = genomic DNA

SEQ ID NO: 2340 - DNA, 7885 bp, Homo sapiens
  source 1..7885: mol_type = genomic DNA
gggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggcggcagcggcggagcagcaggtcccgctggtgctgtggtcgagtgaccggtgagcgggccggggtgggatgcgctgtggcggctgaggcgccctcgcccgactccggcgctgtcctaggcgaggggtggtgaggcccggaggtggactgttccttgctcgggggctcgcagcgaatctgccggcgacagagctccagtccacatgcgcccccgtctgacagcacctcttctgtgccctgccagggacttgtgggctcctgcggccgacactcatgaaggccacatcaccagcgacttgcagctctctacctacttagatcccgccctggagctgggtcccaggaatgtgctgctgttcctgcaggacaaggtgcgcccgccccagcccactctcccccggtcatcgggaggcagccaggccccctccccccatgacactgacgcccattccccaagggaagcttcagtgaccttgtcccaactgtagggaggtgtgggtcgtctcatgggaaggcctgtagtaaacgcttcagtgggcatggcgacagcctcggaaatggcaccaacttgattggaggaagcgacggaccagaggccaggtacctactgagtaccaagcactttggatatctgacttagtccaatatggtgggtggggattatcgtccctgtttgtttatagatgagaagactgaggctggaggttaagtgacttgtccaagctcatacagctaatgggtggcagagttgtaattctagctgtgatgatcataataatgataattggaaaatgctcacctgtttagtgctttgtaggcacttgctacactgatgtcattatcttggtttcactgccaaggaaagtaaggtttgtcgagatacaatgtttcactacagttgatagataccactttggttccagcctgagtctgccaatcctccctcccaattggagctcataacccgcatgctgttttccttcccatccaggatctttgccccaaaagcaggcgtggagaccatgagatgactctaagatagcaagtctctgctaggccctcccttgttggtggcctgtatggctcattgcccttgtagtctcccttggttgctgtgtgggcagatggtggtggcctgaagtcttttcaggaggtggtaaataatatagtcaaataggaactgagtcctagttctaccatgtaaccagccattggaggcatgaaataatctttgtgaatgacagtttctacatctgtaaaatgaagacaccacctatatcagagggctgtgagtgggaaatcttttttttttttttttttgagacggagtctcgctctgttgcccaggctggaatgcagtggtgcaatgtcagctcagctcactgcaccctccgcctcccgggttcaagcagttctctgcctcagcctcccgagtagctaggattacagggcgcccgccactacacccagctaatttttgtatttttttgtatttttagtagagatggggtttcaccatgttggccaggctggtcttgaactcctgacctcgtgatccacccacctcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaattcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgcgctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaaccatcccccccaaaaacaacaacaacaacaaaagccacctcatactcttagggagcagagacgctggctttggggtagaaaggcctggggcctgaatgtcaggggctggggtgtgggccattttcttggtgagcctttatgggtatggcttgccagaggagagctgccagagaggtgtggggggctgggccaggcccactggcccctggctaactcaccttttgcctctcccctgtccccagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccaggtactgcccgcatggcccagccaccagcctcggggcccagagagcagcaaggccctgggctatggcatgtggtggcaccgtttggctaaagatgccagtactccccaccccctcacagcccttccagaaggtgccctgtgtggccagaagaggaggggagggcctcttctgtgactcaggagttggtgcctagcactgagctgggcctccagagatgaggcagatgtgagccctgcgggtggggagccttctcacctagccaggcccttgtcacagagcaggtggccaggacttgagtgtgactgagaagcctcggggtgggatgggcttccaggagggggcactgaggtaagagtgtgcaggcttggtgcgtggggctagtggggaggagaagctggggtcggggaagggtagtgggcagtgcaggtccaggccgcctgaggactctggcgctctgtttgtcttccatagctctggtctgatggcacccagggaagtcctcacaggcaacggtgagtagaatcagggaggatgcacgtcctcatctagcccttgggtgggggccacagagagagctggcctgcagttcctcggcctcctcactcccagggtggcccgcctgcttctcggggcagctggcagtggagcagggaaatgctggctcccaggaccagccagggaccacctgacagaagaccctgtccagccagaccccacttggcagaggggggcggctctctgtgctggaggctgtggagccagtttctgtgcaggcagcgtgaatcctagagttatgggtttaataagactgcagacatttggaaaaacaattctggggactcatctatttgcaataaaggacagtcactccccatggaaaggcagtcgtgaacctttcatgggtggatgtggagttttctgtattgatatgtattttcttatgtcacataggtagggcttggcattagggaatcgatgactgaagccacagttgtctctgggggaggctgggaatgggggtgggatgagaagtagctgctcctaaggatcctcagtggaaagtaaacacaccactttcagatggtctagaaggtttctaaagcagacagtggggagtgtttctttatgcagggtgcctggtgacctgagtctctgctctccttgttgaccctcagatgaggtcatcgggcaggtcctgagcacactcaagtccgaagatgtcccatacacagcggccctcacagcggtccgcccttccagggtatgtgcccttccagcaggggctctggggcgtgcagggagaggcagtgtggtgagtctgcttggaggtggggagtgtatgccacaggtaggctgcccaggaggcccagcataggggaagcatgaggcacagaacccctgtggtgtgactatttggagtggctgactctgggggcagggctaggatgagcactcaagtcctgcctccccattccaggggcagctttccatctcgtcctgtgaggcttgtgggtggcagacttggacactaagtctaaatgaccctaagtttgagggactaggaatgtcatcagggtttagggggcatcagggaaggcttcctggaggaaaggtctcctctggctgatgggactttgagatagtggacagggtgtcctgttgggaggggaaggagggcacgacaattgggttcaagtgtgacactctcccagggctgctgaaagaaggctggttgggtgtttctgcaggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaacctgactggctccttctggaatgactcctttgccaggcaagggcactaggctggggaggactgtgccaccacaggtgaccttcccatcactgtgggtcgcaggtggggcagggagccagggtcaggtctgtgttttggggtggggatggccatggtctggttggggtctgggcagcgtgaggatgtaggaggtgtcatggcatggggtgctgttggagggggagttgctcagacttctgcctccccatgcttgcgagtctttggttgggaccttggttgttaacacctcaaggttacctgggaacctgtcacctcccccttgagcaaaacctctgggactttgtgtgggcaaataccaggccagctatctgagccatttatggggcaaccatgcccttctgtttgctctcgcccccaaagcccagcccaggcaccttagtgaccctaagagggagtaaaaggaggggcagtgagctcaggggaaccagaggaaggacccccatgctggtggcaagggggacctgggtcctggcttccagctctgttccgaccttgcaatgtgactggatcctcagttttcctatctgtcaagtggggacactgcttcttcaggtggctgcaaggacccaaggcagcttaggtaggagcagagctgaggaacttgttcctctaagatgccaaaggccctcccagagcctcacagtgcgcctctttctctggccccacaggctctcactgacctatgaacgactctttggtaccacagtgacattcaagtgagtcctgggggtggttgaggtatgggtgggctggtgtggccccagcctccccagctcacctgacatccctgccaccttccccaggttcattctggccaaccgcctctacccagtgtctgcccggcactggtttaccatggagcgcctcgaagtccacagcaatggctccgtcgcctacttcaatgcttcccaggtcacagggcccagcatctactccttccactgcgagtatgtcagcagcctgagcaagaagggtagtctcctcgtggcccgcacgcagccctctccctggcagatgatgcttcaggacttccaggtatggagcgggcgtggcccagcttcaggtgggggagcccaggctagtggttgagagacgaagagaggcttgggcttgggcatgtagttgagagtcctgtccctgcgctgcccctgtcccagttcttgctgggcctcccaacggtcctttctgacccgtgtctgtgtgtctgccagatccaggctttcaacgtaatgggggagcagttctcctacgccagcgactgtgccagcttcttctcccccggcatctggatggggctgctcacctccctgttcatgctcttcatcttcacctatggcctgcacatgatcctcagcctcaagaccatggatcgctttgatgaccacaagggccccactatttctttgacccagattgtgtgaccctgtgccagtgggggggttgagggtgggacggtgtccgtgttgttgctttcccaccctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgc

SEQ ID NO: 2341 - DNA, 6673 bp, Homo sapiens
  source 1..6673: mol_type = genomic DNA
aatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 2342 - DNA, 102198 bp, Homo sapiens
  source 1..102198: mol_type = genomic DNA
ttggagatcaagttaaatgtccaatttatttttataacttgaaaccagaacaaacttggttttgaacaagcgtacaaatgaaatggcagacacatgctgaactcaacattgtgacattaaggaaaaaaagaggcccaaaatcttgtacagagaataaaggaacaataaatattttactaagccatattgaaatgacctcctgtcatctcaacattttatccataataaaaaaaagtgcctgtttcttaaacagagcacaaataccaagcaataataaatagttccaaacttgtagtaaaagacaaaacctccaagtaaacaacaaaagctcatacaataagtaatagaaaaggtaataaaaatattttgccttgccagtacaaatgcaaacaacttaaatcaatgggactttgctttgcagggctgagttacaaggagcaccaaaatcacgggtttgcctgtgttccacgagaccttcggctgacggttacttaggaccgggatgaaaggctgatttccttacttttcacattttgcttagagtaattcagtctccttctctccccatgaaagaccctctaatgccaagtggcaggttccaattgggggcaactttgaacaaagttgtggcagtgcggaaaccggcctgaggtcggctgggtcacccatgctagaggcctctctctcgggatcatctgcttccgtgttggttttttaaacacaaaacagaagcaaaattctctcttctctgcagtcacagagacacacaatgcttgtgctttgggatggcttagtcctggcaatctggtaagctggtgagcactggctagctgttatgactacaggaagaccaccctggaggcactctaggacctcagtggggcatccaaaggcaacagcagcccctggatctgcaggtaggaaactgcagtaggaaactgaaatctcagctttctctcccattccctccccccttttttttaactttgcaaaggtaagtggcaaggaggaaagagtgcatcgaacagaaaagcttctgcatttggtaaggaattgcccaaaaggatgcttggttatactttcataacctgaaataatggtttcttacatttcctgaaataaaaaatggcttcctgatattggtattttatttaaaaatgcattattccctcatccaaaagaccaccactttatcttaaagctacttggctttacaaaaaataaaaataaaatagaggattaggggaggaacagacaggaagaaaagaaattaaataaaaaatgaaagaaaaaaaaaggaccaatggaggatgaaggatggagaggaaacgcaggggaaggagagagaacgagatatggaaaggcaccaaattcatcccaggccctcgcattcggaaactgacggaatgtaggtttcagagagcaaagcagcaaagcagggaagaaagacaagaggccaacactctccatggcacgaaaggtcctggctgtgatggagtctccttcctgaaatccaatttgtaccggtctcaacagcaggtcacttcacctggacccagctgaatcaccagctccttttatgatatttgtgtttgtttcacaatttctcaaggactaaagcagctcagtttgcattgctttctgctggtaagggcgggagaggtggtggtggtgaccgccacaggagtgatggtagagaaggaagatgttctctcgctctctctcctctacatctgacatcttagagatggcctcttagagaaagggaggacgatgtggaatgttactgacatctttacaaaaactgatttttttccactcaacacaaataatttcccatctggtctgctgtggccacaccaaggagccttgatgcaaggttcggggcgttcagagagaagcccaacacgaacggttctctgtgtaggccaattccgacaaaaaatatatacaactaaatgatttgtgaaccaaagcatttaactacttccttttgtttctttttctcaaaggttgtcaaacaaccctttttctcctgtacaataggacttaacatacaaatgtgttttttttgcaatattttatcctgccaaattaaaaaaatatattatggcagcctgtttgtttttgttttttttttctttttatttccaaattcactaacaaaaaggtacattaaatccctttaaaaggacaagcttacagttaaaaaattacgagctccagtaaaaatacagcaagtgcctacatcatatgaaccaaccaatatatccattccagagggaggcgggaagagaaaaataagtacaggtcagaaatgtgattttttttttttctgcaaagcaataacaatattaagcactttttttctacatactttttctacatggtgtagcaatcccctttgaatccccaaatacaagtttctatacattttttttgaaataaaaattcaacacccaaggcagaaaaaaatttactaaaactccgactttacagttactgtaacaagaacaaatttatagacccaccatttaaattttactgcaacattttcaaggaaaagaaaagggtattttttttcttgttttgtaaaatgcccaggcattctcgattattacaaatactggtccacttttacagtaatcaagaaattttaatatatataatatatactaaaaccccgtcaccaaaagaaaacaatatacacgcggccactgtggcatttttgtataacctattaagcaaactttgaaaaaaaaagatcgctccaacacacatacacacaattttttttttacccttgtatgtacccaatactgtaaacgtatttttaagacagagtgcactaaatttaactttagaaaaaattagccgttgttcctgaattgtttttgttttgcttttcattcaacgatatcaacttgtaacttgtgtcacttgagttttaattcagcagtaaatcacctccactccatatctaagcagcgttgtcccaaaaacaaaaggggctgaggataattcagctaatggatgtccaaggttgtgctgggtttatttcttcatttgattgggtcttatggcatttcatatcctctatcttcaaccagaattttttttttttttacttaaagtaaatgtggctttgttagtttctaaagaatgtacttttcttgttttacttttttaaaaagtcttttcatttcaaaaaaaaagttttgcatttgtctcaagagactcaaataggaagatcagttttcaaggcactcacatcaaattgaatggcagtagaaaaactgtcctataaattattattttattttgttctttatagtgccagtattgtgaatgccacgcttagcaatactgacactcaatctcagctgtcccttacagtttaacccacctctgggccaaagagaagaatatgctgcaatttcttgtttagaagccatttaatttaaatgcaaacaaaagctttaaagtgcgggtcaacagaattcaaatgtctaatcttaacagttcaatatttagtaccttccaacctaatgagataggaaaaaaaaaataaaaacctgggaagtagcgctgggcaccttctgatggaactcatcccctgctttttcagtaaaagagaatagaaatttgcaagatccccaccccacccatccctacaatatcatcagtgtgcattaaatgagagaacactaacttcaattaattagggcattcgtctgcttgggaaatgatggatgaccccttgtagcaacataggatttgagatttatgtggtgggggtgatttaaaaaaagagagaagccgtcaagccagaaaacgcctaaaagaacaccgctagtttcttcctttctgtgtcactgcaggccaccccatctccccaaaaaggtaccctcagcccattttatgtagcctaatctacagcgaatagcagccatggcaccccagggcacaccaacaggatagtatctgctggtcatgcacaacctcagaatgctgtcgggccatttcccagaggagccctccaaaaaccctatctctggcggcgctgagtctgtggggtgcctcccccagcaccaccactcaaggtttcccttatgtaatatgaaagccgaaatcaacacagaaaaggccgcttgactcgggacgacatgagtgctacatctccattccagttctgaaacaaagtgctacgacttgaaagattgttatccgctgtacatccacaccccccaccccaaaaacaaaaaccaaaaaaaaaattaaaaaataattaaaaaaaaaactgcatgccactttttatttcaggacaaaaaaaaggaaggaatgaaaaagtaaacaactttaaaagtcatttgagtgttggcttcttcacaagaaattacacatgcttagcttaaatttcaaaaaagcagcaccacccctccccccaaattataatttaaaagatatgcttcccctctaacattgcttgcgagtcattgctcaggctactaccgggttaaaaaaaaaacaaagaagggatggatacccaacaaaatctcttaaaggaattcaaacagaaaaaataataataaaaagtacctgcacatgccaaaaaaattacaaaacccaataaatacagaaattattgcacagttaaaaggctccacaatttgtactgccttaatcaaccctcgggtttccataggacttcgcagacacaggttaggttggagtgccgcctcccctgggccccggggacacgcggggtgcggggtggcggtgacacggaggcaagtcaggtcagcattctctcggttggcaacggttccactgtacaggtgcggggcgccggggcccgcgcgcttagctcctctcggcctgctcgattttgacgtcgttagtcagcaagtgctcgccgtgccactttttcatgtgtttctccagggtgctgtagacgctgaagggcatctggcagatgtcgcagcggtacacctccttgccgatctgcccgtgcgtcttcatgtggcgcgtgagcttgctgctctgcgcgcacgcgtagttgcacagctcgcacttgtaaggccgctcgccggtgtggctccgccggtgcaccgtcaagttgctgcagttcttgaacaccttgccgcagtactcgcacgtgtcgctgcggcggccctccttggagctgggccgcccggggcccgggccgcccaggtgcggggtgctgcctccgctggccgtgccgctgcggcccgagaggccgccgtccagcaggtccccgggcggcgtggagaagcgcaggctgccgttctcggacgagtgctcggacgacgtggcgaagggcgactgtcgtgcgtccgtgaagcccaggaaggggtccttcatgaagtgccgcgacgccgcgtagcccaccagccactgcgagtacacgttctcggacgggatgagcgcggcgggcggcagctccaggtccttctccaccttgatgcgcttggcggcgctgttgagcccggggctgggcagcggcgcgggcttgcgcgggaagagcccggggaagggctcggtgcctggcgcgaagccgcccccgcgcccgttgaccgcgccgcccgcgcccgcgtccccgcagccgcccgcgtcgtcgtcgtcgcccgcgtccccgccgcccgccgcacgcttcaggaaggcgccgcgcttctgcttgtcggccaggagctcgccgtactgcggcagtgcgcctaggcccacgttctccatgaccttgcccagcaccagcgccttctcgtcagccagcgccttggccgcgccgccccccgcgcccgggaccccgggcaccccaccaccgccgttctcgcggttgcggctcagctccgagtccatgctgaagctcgactcgggccggctctcgttctccagtagcagctcctcctcctcctcctcctcctcctcgtcctcctcctccggctcgtggcccagcgacgggtcgctctcgtggtggcggaagtcaccgtcggccgccttgaggccctcgcccgccagctcgctggtgccgggctcgggggagctggcggccgagagcccgtcgtcggagcggccggccagcgagccggccttgtgcatgtgcgtcttcatgtggcgcttgagcttgctggcctgcgagcacgcgtggtcgcacagctggcacttgtagggcttctcgcccgtgtgactgcgccggtgcacgatgagattgctctggaacttgaaggtcttgccgcagaactcgcacgacttgctcttggctggcggctgcgggggcggcgtgccgccagggggcatgggcggcagcggcggcgtgctcaggaacggggacttggggctgggctggaaggggttcaggagccggtgcatagggttgccgcggcccggggacacgggcggcggcgtggagctgttgcccgccagctcgcggagccgccgcgagaagtccatggcgggcgagtcgatggccatggggttcaggcgcatgactcggtcgaaggcactggggtgctgggcgacgagccccatctcctcggcactgaggcggtgcgggtccaggtggtggcgcggcgggggactgaagagaggcggcgtgcccggcaggcggccctcgccgaagcccgggtggtcccgcaggatggggcccgtcatgcgcagcaggttgaaggggttgctgtcgcccaggaaattcatgagcggggactgcgccacggcctccggcccgagcggcggcgggatggtgagccgcggcgtgagcgagctgctggccggcccgggctccaggtagatgcggaagccgtgcgtgttctgcgcgtgctgcagcaggaaccacgcgctgttgaagggctgcttgcatgttgtgcaaatgtagctggaaggctcatctttacctggggaaacacacggacagaaaggcagagacagcgtgagaagcggcagcggggcgcgggcaccgcagggccactggcctgggggacgcggcccgggctgatccgggatcccagtgccctgcctgacaggggctgcagggccgcttgcaagcaggcccggccttgtctcctcctggctggggggccgaagacgcaggtctgtgggcgggccgccctggccacccgggcgccagcgacttacttcaattgtgtaagacccgccttgctcccccaaagaaaagggattctgatctccattacctccgaggccacgggagatcgtgtttgtgagaatacggtccagtagtaggaattctgtcaaggctggactgtgtaacagccctggcaaatcccagccctcgaggatgctccacacccgaaaccatctaggccagggcttctcagtcaaggcactactgacatttacatcctaattctttgggcggtgggggctgtcctgcgcattgcaggatgtttagcaacatcctctgcctgcacccactagatagatgccaggagcatccacctcccccggttgcgaggaccaaaaatgtctccaggccttgccgaatcttcccagggaggggggcaagatcaccgacccctttgagaacaaccaattctgataatatttgattccagggagttgtacagaaacacaaatcaaactgtactatcctgcaaacttttttttttttaagagaaatagctgcaatacctctgcaacatttgggatttttagctataggaaattctcgtgtttcctacaccaccgtctgtgcagaaagcactgtacacctgaatatggattcctaggaacagaaaaaatttaacatgctgtgaagaccggctactactgtgacagctgcccccaccccgtgtcctcacacacacgcccaaacaccgcttggaattccacctccagaccccagggaaggcgggggcacactggcctacatgagtctttcaaagtcctctgccagaatactaagcaatgaaagaacatcctcacatctgacagggcagtcaggatgaacagtggcaaatgctgatgtgttagcaactggctctggtgacacgggcagcaaattgtagcgaacactcgtggtatggagccaaaacgtcatcgtctgtgtccatcactgagacaatcacaaaatggaggctgaacatttcctccggaacccatcctgcaagtgccctcctgcacctgggggtgaagctcgccgcttttccagtatgtacctctcctaatgctctgcataaaagagacggtgcagacaggacccgtcttgcagcattgcactcactagctggggatgcaagaggaacaagaatcccagctcagatccagcagaagacatggcatgcgagatcttgaaagatcccttttgttttctcaaactttcatctacctggaagattttaacacagatgctaaagtacaggggccacaagctctggtgaagtcaaacgtgcaaatgaatgacccttcccaatatcggtaagttgccatgggaagtggagaaaacagtcccctgtctcactctctccaccaatcgattacaggccttctgaaatcctaggcagacagcatttttgttttccacccactaattatgtttctggaaggctgcactcttagcagtgtttataggcacataaactttcatttggaaaccatcttttaaaaatcaagtgactcggggaccaaataccctgaattccatccaaggtcttgagtgtggcctgtgcctctgcctgaaactggacttgccagtttctgaggggccgggacctccccaagacatcgcatgcctgcagcgtcacagaaggcttcgtgctgtccgaggggcagggtggagactccccccgcgacctcagaaccagttggcccaggacaccaacactagaaaccgagccaggctgttacaagtttggcattacatagggattctttccctctcctctcctattctgtgtgtttggtgatgagaagacggtggtagggaggacagaaatgaaaaaggaattctgaagttcggcctcatccctcttaaaaacagctcaaggagcacctctgaggctatcttctttctccagggtgtctgggtcatttccctctcttagtcatccaggtaactcagttctcccatgaaagagcccctgaggggaaacctccccacctaagatagggcagggacgccttcccaaggccctgggtggccgcgattctccctgtaaggccaccccaacaccacagccctcctgctctgtgcactctcagcgaacagaggaagtgcccagcttccctggttctgtcctacacttattagtgattgtacttggggaacagcacgccttagctcagacagcctcataggagagctggccagaagccatatttagacgactcctcacaccctttttgggaacaaggcagaataaataagtaataaaaaaagaagctagataaacatccttttctgacacaggagctaataacacaaatgaagtgccccttcctgcagggttatagatcttcaaattaaagatcgttcctgtaccctgcaccacccttcagccactctaattaatcaattcacagctttccgtcgctttagtttctcatgttttcaagtcaggccacctcccttcccccaatctctttttcatcatctctgtttccctgggaagtgctccaaagcacttcctgtttcttgatctgggtggccacagattttctagaaagttctgtggctggtgaggaaagaacatggctatcagaggaaaatgcagagcgcttacgcaggccagcagtgaaggcggctctacagctgaaatggccaagtcacaggtttttcaactcaaaagggcagttactggaagtcaggtagctacaagtgctaaagagctcaagtgtttccacttcttgtttgtttgttttaaatgcttctggctgggcacggtggctcacgcctgtaatcccagcactttgggaggccgaagcgggcggatcacttgaggtcaggagttcaagaccagcctggccaacatgatgaaaccccatctctgctaaaaatacaaaaattagccgggtgtggtggcatatgcctataatcccagctactcaggaggctgaggcaggagaatcgcttgaacccgggagacggaagtggcagtgagctgagatcgaaccactgcactccagcctgggcgacagaatgagaatccatcttaaaaaaaaaaaaaaaaaaaaaaaaaagcttctaaaactaacttggagcaacatagggagggcattacctgtccataattcaccatcaggtgagaagagcgatgtttattcatcaggctggatttcagggccacccgtcctgcctggaaagctcttactggacccgtgtccgggaaccgctttggttccaatacttccctctgcacaatggcaagatttcacttcaggcgatggcctccagtgcaggatctgaagccttccgatatcctaaaaatcacccagccctcagaggcccgccctagacaactttctttccagtccccactcccttctttttttaataaaacattcatttccttattatcactccatggttatctcttgcccggaagtagccctgagcatgaggcttgctcactttcagaaatggaacaatgtcagaaagtctttgaagagccactcagaacatttttctatttgaaaactcgctaaatattttaaacacatggcacgcagtctcagacggctcatttttaagtgcagcaaaagacccctggtgagcaggctgcttctgactgggggctggcccactccccttcccgggaccagatgtttcctggctgtcacccccctccaggaactgagggccacctgcccacaggtgagctggaggctgcactgtggagaggggtgacaactttatgctagcggcccagacaggctgctgagattcccactgataggtcaaggcctagactatttagaagcgatttacccagcaacatcaaacctggcctacagacctagaaacgtcagctacactttgctcactaagtcacgcttggcaactcagacccagggcctcgtcttcccttgcttctttccatccttcttcctttctcagacattttttgtatccactgacagaaacccacactggatcttctttgctccactggctctagacagagccccaggacatctttctcaaatgcaataccctgggtcatgagaaccctggacaacagcagtgcgtccatacccctctgccttggtgttcccagaaggaggaattcagtcaattcatttaacctctctgaggcttgacttcctcatcagtagaatgggaataatatacctggctccagagaggcctggggagaccaaatgagctcctgtatgtgggcacagcctataaatcgcacatggctatgcaggcgttacgatggggtttgcacgttttgtttttttattatccatccttgtacctggtcatggatgtttcagtgatgactttcagtataactccagcaataatgaaaccctggaggacatttaatgcagcctgcctcatgcattagaggttctagggaagcagaaacttgcaaacattgaggaaacatcgttttttattatgatgcttgggaaccgacgtgcagctggactcctgcaatgaaatgtgactctccctctgccattaggcttttttatgagcatttaaataattgttcctccttattaagctggctactctaataataccaataaaggtatcagagatgttcaataaaaaacacacctttaattgaaattattatccaatgaaaaggccataattgataggggtcctcctaaggccaagtgataccaaagggaagggcattcctgcctgggtgagatttagtggcccactgctgttcgagaaggagcagcaaggagacaccctctcgactcaagcagggcccggggtgatatcctgaggttggggggctaaagtaagaactggattctggctttacaggcccctctacaggttgcaaaacattttacactaggcgtggcatttcccatgcattcactcacaccatctttgctcactgtggcctcaaggggggccaggggaaaactgcatcccagctggcacgtgagcaaactgacgctcagagaagcaaagcggcacggccagaaaggggcaggccacgctcctcctcaggcttcccaacccctgagcagggctccagccccgcctcggcacacagcaccacctgaggcatttatcgtcagggcctgtttcacaatgcaaatggccacgaaggaggttctcccaccacactgtgagtgtcctcccagtggaaggcactgatgatgtttggttggaacccggtcaggtccaccacaggccttgaccctggagaggagaaggggagacgtttcacagagcgagcaagcgagcctgcggggtatgacacgtcactggggacctcgtgaggtagacaccgaagtggccaaatccagggatgggaaaccagatcccagggccccctgtggcagctcccttccccactctggacttcagggtacccagtacccaaggagatggctggtttcaccggccaaccactcagtccgcctccagaatccgtctgctaaagatgccgtctccacagttccaaaatgatcgtaattatcagtgttatccctcagatgtgtagattccttattcatttaaaaactatcctctttcatgacgtcagaaaggagatgtccattgggcaccgcagggatctatttaagtttcgtgtctatatcattctgggcacagccatctgcagaattgataaccatccctgcctgttccaaatgtattccgtgaaacctcagctctctccaagacaaaggcggaactggggaaataacactcacagtggtaacaagaaagctttatgaaatccttaccacctgccaggcatgagctaagcacaccaaggacctcacatgctgctccaacaacccctgcagtacccaccgtcatgatgaccattttacagatgaagaaactgaggacgggaagagataggggatccgcctggggctgcacagctgcccacggtaaagcctgtgctcttgttatgctgttctgataaacgctgggtcagaagagcagcagacacactccgggcagggatggggctagctacctgggcctcagtattttacctttcatttcagcccacgtactaacaaaaatgtcaagatgtgttgcttttggctagaattgcagtaactccatgaaatcatgctgattatctcatggcaaaaataatagatgccatttagaagagaaaaacctttcaaagcaagtggcccactgaggggtgtaagtgctgatggtaatagcagtggtactatgaccaataagacatggtctcctctggtggtaatgtgctgagccagcctctggctaagaaagccactgcccccacaccaaggcctgcggtagacattgccagttcatccccgcactctccctccaggccttggactcctctttaaccccaggctccaggcagtcattgccaaataaagcatgcctgcacctctttgccattcctggatctcagtagatgtaaatccagtaaatgtgggatcaaaatagattgggctgaatgagcgtggtagcactgtgtgttctgctgagaactttgtctacatctgactttcattaattcactgaacaaacaggatctgggcccccttcatctgctaggtactatgctggtagctaagggtgcagctcacactccaggggggagacagggaacccccagtaaccactccattatttaatgcaaattatgagtgacgctaggaggagttcagggtgctgggagagagaagaattcaagggtttgactcaccttgggggttcagaacccacatgatgccagacccacccacatcacctcgtttagaccccacctaactctacacgcagtgaccattgaccgaagaaataagggaagcccagagaacttggataagttgctcaagaagaaattagtgaccttagcttatttatttaaaattcatcttccagactccaagctccttgaggacagggactgcgctggtcttgtggactgcttggacaccagcctgcaacatggtgactcacgcaaagttgcacttcaggactgccagcggccgagacatccgacagaccaggagtcttctcagcctcctgccagcacgagccatgttccttccagacccacttcaaagcccagacacttcggccaagttgctggacaccacagggcttcagggtcctcatccacacagggaaaacaatacctgccttcctgggtcgttcgctgtaggatgagggctcgtcgtggtaaaataccccaaatagggacccacatacagtaggcactgggtacacgggaggtgacagagactggaacttgggactttctctgcgttttctcatggtcagcgttcctgaagtcccaccaagacaaggactagacctgggaggacaccgcaactccacagtccacatgccgccctccacaccgggccccctccagagagcagggctccactcagcactctcaacaaaaggcctctcttcctcagcagagaacacacccagcactgcccccaccccgaagccggctgcatcccaaccaccaaagcatgccagaatcccaggggactacacacagaaccaagacagtatgccaccacctctgctaccacccaccccagaaccagggacagatcttcccaaatcacagagctggtggggcctccctgatacccaggacgatgtatcaggcaccccagcctttgggatccggtcccacttgctgcctgccttttgcacacacccatgagctgcccactcgccctctcggtgcctccctttgggcagcgcattttcacacctccatgcccttgctggtgccattcctgcttcttggaatacctgccgtttattctctccccataaaatatcttttcagatccagcccaagtctaatcccctcagcattccacagcattgtatttagatctgcttcatactgatcaccatactgaactgtcatcttttgtctttgaccttggtgtgttcagcatggctacagcctgcacgtgccaatgttggccttttgctgtcaggtggatgctcacagccactttggaaagtgggttttaacccaggttctctagagaaaagaaactaagtctcatcacagctgagtgaggggccccaggtcacagggctggtaagtggcagagtcaagatgcacacccgggtccgtctgaccccagagcgtgtgctggggtccagactcacaactggctgcccctcacacagggatggcagaccctgtggtgaccatccctgggaaggagcctgagccagccctgtctaatcattccgcctgcacctgggattgccagcaagccagcccgggaggccaagctgaaggccttcgagggcaggaaatggcccagaagaaagaggctgcacacagcgagaaaacctcgctcaccccatagtgttgggtgaccgtccacttaccctcatgggacccctgcagcagaggtgagctgtgcggcttcatctgcctggacttaattcaggctttgagaaaaaccttaggaagctgggcctacacccctcaaacaaagagccccagcattccccttgacagccagattttcacaaaaacgccagtgagtcttggtttcctccctcagggtcataggtgggggtcagggagtgggagtgggttaaactgtagacacagagaattgtcagacaaagcagaaacctcaagtgacttttgagtacctggggaggaggcaggcagcaaaactacatgatgaggacgggcgcggtggctcacgcctggaatcccagcactttagtaggccaaggtgggcggatcacctgaggtcaggagttggagaccagcctggccaacatggtgaaaccccatctctactaaaaatacaaaaattagctgggcatggtggcacgcacctataatcccagctactcaggaggctgaggcaggagaattgcttgaacccaggaggcggaggttgcggtgagctgagatcacaccactgcactccagcctgggtgacaaagtgagactctgccttaaaaaaaaagaaaaaaaaaaaaaaaactatatgaccagtaatgttcaagccagacacagagaaccggaggtgcccaggccaaggagggaaaggtccgcaaggtagggagctgtgtgagcacactcaaggtgcagggcgctgggccacgcgacgcagaaagcagctctgtttgctatagaatgaggcaggtcgggggaaatgggaaatgcaaccggagaggcaaatatatacccaagagcattccacaaaaggggtctccatccagtgcaggcctggctcattccacagggctgtccttactcccgcacactcgccctcctgacccagggtaagtgttaggtgtgcagaagacaccctgctcccgaggtgctttcctggggaagccctggaagagtatcaggatgacccaagacctcaccgcatctggcaacccagaaatggtatcgttacagcaagaaatgagagcacggcttcaccgtcaacttctcaacaacatttattcacttgttccttcctcccttccttcacagatgcacgatgtgtctactctgtgccaggccctatgccaagaggagggacacacaaagaaatgaaggtctgtcctcatggagcataaagtctagagcaagaggccaatgactccaggaacatctaggcagggttcaggccactcagtcactagtgaagggtgtgccaagcagtgtggaacccagaggagggagaggctgacatcctcgggggaccaggaaagattctccaaggaagagaccctggtgttcattcagaatggaaaataagagtgcatcatgcacagtggctcacgcctgtaatcccagcactttgggaggccaaggcatgcacatcacctgaggtcaggagttcaagaccagcctggccaacatggtgaaacctcgtctctactaaaaatacaaaaattagccagcatggtggcaggtgcctgtagtcccagctacttgggaggctgagggaggagaattgcttgaaccttggaggcggaggttgcagtgagccgaggtcgcaccactgcactccagcctgggtgatggaacaagactccgtctcaaaaaaaagtgcatcatgcagagaagggagggaaagcgcatgcctggcagaggtactgcatgcctaaaggcggaggtgggactccagactcaaagaaaggaagaactgaaggcaaaattgaaaagggagaggttcagaaaacacgcaagaaacttagctggatatagagcaaattccattgctgtaaatcccatcatagtgaaaactttcctatttcgtccatgaaaaatttcaagcccacactcaaggcctactcaagtcaagaactgttcagtattaaggaaaatctcaatataacaaaaggatgcatgtgaacccttcagaggaccaccttcccaagctgctttccataaggtataaaggaatgaaacttaaaatccagtctatgaagatcactagcaaggaaggtggcttctaggttaccctctccggcaggagttaaacgattccagcaagcctcacatctgaataccctaggcctgtgaatccaccttcagaaacaagacagtccaggctgtcggtggaacagggaagtattaaaactgaactatggctgcatgcacccgagatttcccaaaacagtctgtgtttcaaccgttcaattctttggttagcccaggtgtgcagtttcaggctcaggaaacagccacccaaccccaaaataaagcaacattgccagccgcaggggtatcatggcacagggtgaaaacagtggtgtttgtcagtaagatggaagagccggggcaggacgcacagagcaattttccatgtggcaagtcatctgcagcatttgtgaaaagctacagcacattcctagaggttgtctttagaggtcccgccttcggataaggcacagaaatccactggaaataataaagaatgcgttgtcagagtcccttgaaatctgctttctgtgaacttccctgaaaagggcctacgctgttccagtgggttttggtgggccgatagctgagctcactttgatggtgacgttcccccacgccgcccaacatgagagttttctgaaaggattctagaactctggggacaggaattttgcagagaatgtgaaagagaagcacagagcaaaccatccttatcatttaatggacaaataaagagggagttaggagataaacaggcaaaaaaaaaaaaaaggccaggagtcggctgcaggtgtgtgagcggggatcagtgtgtagctgtttctcactcacacgtgggatctcagtctccccagaagcaccccatgcaggccttcctcctcctcctcctggagacaggaagtctcccctctccataattcaagacttccttcaccaggcaagcctccatctttcctttctttaaatccacaaaaaatctcgacattccaccccaagaagtatggcagagcagtaaatctcattttaatggagtgtacgtttagctccaaggagataattgacgttatggagagcctcgataccgagttatataggttagctaatgcagaggggactcattactgacacactacaaacaagtagtaatatatgtatattgttctgagtggcgttagagcaaaagtgttccggtctgcggggattgataaagcacaagaaaacagcagatatgcacttgtaaatttgtctcatttgtctctgaagttaaaggttattcccttgttctgaatttgtaataaaaacatgctagcccagggtttgtggagaatgtttgaatatttaaattgtgtataatgataggcaattatagggtaaaaaactggaccttatgaatggggggaacactgtttggatcaccaagtgttttcttttatctttaatgcattttgcaagtaatttccccccagtggggttcagagaccattacccagtcccacaaccactaaccagtaactaaccaagcttgggtttgcccgggtggataggctcttttccttcttttttcttttcctttcttttgttagttttgtttccttcgatatgcagaatacatctctccaaccaatggctggcctggggctggggctggggctggggctggggctggggctggggctggggctagggctgaggctgaaaccgtggcctctgtccccagcaggtcagttcgtctttctggggaaggacaaggctggccatagggagaggtctgaggggcagggtgtgaatttcctctgccccccacagtgggctcccttctccccaaccctctcccgggaggagggccaggggctggtggggagccccagctgtaccaccggcttggggcggggggtggcgctgcggctcccgcggctggagcccaggtgcccgcctggccgagtctgctgtcggcccaggttaaccaactgcagtgctagagtaactccagccagcttgtcaccgagcacaaaagtcatcagccagtgaatgttcttttctgcaccacaattaagacgaatcaatacgacgtgccacaaatggtattttactctcaataagaactcgagctgagtttattcagaatattttagcgcttccccgggggattttgggccgacgcagatggcaaataaagtactcagcctaaggctacagcacattatggtaattctaatgtcagatgtactttaatatacagctctatttaatcaccccattatttcacatttccatatgaaaaacctgcggcacttctgcggcgctttgcctctgccaccgtgccaagcttcctccagccgctgctggctgccgggacgtggtcatctcgccaggcacagcctgacaccaccgaagtttccgggtgcccggatgcacagccgagctgcctggtgccgctagaacatcagaggactctaagatgcaccgaacgccaccatgggcggttatggaagagaaaagctgcacgcacactacatgcacacacacatgcaagttcacaataaaatgcagggggatgtgtgtccacgtgggcacacacgcacacccacacacacagtgtgcaggagagaaactaatgtcgacaaggagttacacccacgctcctaacacggccctctccagacaccaacaccccagcatggcggctactgggtcagcagctggatccaatcacaacgctggctccagcctgcggccccagcagctgtgcccattggttctcccaggactgccccccaccccatgagggcaggataaaggcatcatccacaccaaggggcagaaggaggccaggctgatgacaaagccagaggggagtgcacgaggtagagcgggggatgagaagggctgggaaactgctgcccacactgtgtgggagcacctggagcaagaaggcccccaagatgacccttatcggggactatgggcactagggaattgaagcctagaggtccaggcccaggggaggtggagttctgtgaattccaagtggcaggagcacctcaaggctggctgggctggcccgcagaagcaggggtgtgggccgagcccaggaaatcactctcaaggcactccaagaagcccagcacagcacctgctgacaatccaattctagatttcccaaagacaggttttgctgatggatgcaatgacacctggcacccgaccctactgggtgtcccaataatgagccaacacttaaagccacataacatgattcacagaaacagttacagcatatgtctttaaaacaaggcacttgggccaggcgcggtggctcacgcctgtaatcccagcactttgggaggccaaagcgggcagatcacgaggtcaggagatcaagaccatcttggctaatacagtgaaaccccgtctctactaaaaatacaaaaaaactagccaggcgtggtggcatgcgcctgtagtcccagctacctgggggttgaggcaggagaatcgcttgaacccgggaagtggaggttgcagtgagccgagatggcaccattgcactccagcctgggcgacagagcgagacttcgtctcaaatagaaataaataaatactaatttttttaaaaaggcacttgtctgtgcctttgttttgttttgtttttttagtgaagtcccattcctaacaatggggaaaaaaatctctaagggaaggagggaagaggaaggaaggaaaggagggaggaagggcagtaaaactgagaaagttccaacacacactgccaaaaccactggcaaatttctcaaaagcatccattcaccaataaggctatcagtaagctaattctagaaagaagaattgttctaaagctcggcatggcaaatatttcagagaaaaactgctcgactgtttgaaggtacagatgtctgacctacctggccattccaactcctacaggtgcgactgtgacagacagctcaccacctccactcccaccgcccgcttcggccacacggggggggtcaccctcaaattagggtcatcctgttacttctttttaaaatatgctttgggggtaaaatctaacaatgggaattcagtcccaattttcaaggaaggcctttgattccactcttttattattggttattcttgaacctcaaaatagatactaatattcccccaggccttttccaggttgttgtcagttagaaaaaaacagcctaggacagtggttctcaactgagggttgttttgcccctccaggaaacctgcggcaatatttggagatatttgtgattgtcaagactgaaggggcttgggctttggggtgctactggcatctagtggggagaggccagggatgccactgcacatctacgatgcacaggacatctccccaacaaaggatgagccagtccacatagcaactgtcccaaaagtgggcagccctgggccacacccgtcaacttaaacactggcttccttgtggggaccgcacctaaatctaaaaaaaaaaaaatagactgaaagagaaagtggggagtcaggaagagagtgggaaagggagaaagaggtggagagaattgaaaagacagagagaagaggaggggcccacaccatctacttctctggcaataaagaaactgtggaatcccagtcaatttcatcattgtagaaatcatttgaattccagagttgcctggagctgagaatctggggctcctagggagctccgagcctcgtgaagggggaaggcagcctgaaatggcagagggggcagggggactgcatttgtcagcacccccctgcccgcagccctccaccaaaaaaaaaaaaatgctccgagtgacttccctccagagctgggcttggccactaaggcagggatgtcaggggctgccctagatttggtggctcagctgtgagccctgcaacagcggctgcaggagatgaaaaacaaatatatacttcctgaagtcaaagagataaaaatacaatttctgctgcgtatgccactctttcacgcagcatcaacacttatgtggggtgacggggggaggaggatgaccacgcaagcttaagtgatttttttaaaaaacacgatccagagagattacataaaaagtacaattaagggacgctcagaatcccgaggccttcaagaacgtgctagctccggaatatttttagaacaatcactggagtgattcttcttagttgtagaaacactccaaatcagaaagtcaatttttcctctatttgcagcagtgctggctccactggacggaatgcgtgtgttttgcttggcggctgttcataatactgtcttggcagcgtttccttggagcgcacacggtgaacctggctctcgcatacagtagcactttcattttaagcgccccagccacgcttccctaataacagcctgggaactgcaaaacccctgtaagcccagccctttaaatggggaacagagcagggctttcggggccccgctcgccacaatagggactgtaaactggggctggtgctttcaatcaagaaacgtggctctcgttagaaggcagaaaataaaacaatgccggcacgttctggagaccacagcgcgctacctttcacctcgtcctcgccacacacacccaggcccagccccgctgcctcctctaccctcctgctgtcctgccaggtaccaggtgtaccagaccggctgaagtttggatgggaagggacatggcaacttgggaaccacactggggctggggctgtgggccagaaagatctgattctcctgcttcctagccttggctgaacatgaatgagtgagctcaactctgagctccaagttccttatccataaatgcgagtgacacctgtattgaggatgtggaaagattccagagcgtgcatggaagagtcctgcctctggtcagtgctcaatagagaatgctatttaatgatcaaaatgtaaatgagtgaatgaatgaatgaatgaatgaatgagtgaatgaatggataaaagagtgaatgaatgaatgagtaaattagtgaataagtgaataagtgaatgaatgaatgagtgaataagtgagtgcaagacagcaggatggggctaagaggggctaagatgagatgggaccgctcatgaacaaatccccaaacccctctctgtcactgatcagccaccgtggtcagccactgccaccaagtagtcgtcattcaaaaggggccttccaggtacaatttcagcccctccctggcatcaagaaacgtagtgatttcggcctcttacaactggctcatcaccactgtctgttcgcacactcctctttctttctccctatgttgtttacaaaggtttcattatgttttcaactaatcagaaaggccccgctaatacacaattaacatgtgattataaaaaaaattaaaatagcttccagaagaaggaaatgtaattaagtagagaatgcttttcaataagtgcttgctttaacccattgtcagaacacagtctacgttcgtccacaatgcctagaacagatgccaagggcagaatgttaaaaggaagtttaaaaaaaaaaggggacattattttctgggggaataatagccatcaacttggtacaacatgccggagaactcggattccggctgcagaggagagaccctcctcccaatcctcttacctcttttttctggagaaagaaaaaaaagtttcccttctaaaaaaatgaaataaatgattaaagccaaatctaagataataagaatacatgcaactaaatagagaaaccaacagccaaacacacacactaacgaaccccactgccaacagaagttctggtccagaccatgaagagggtttgatagcacctctttttcatcaagtctgtgatcattttgtttcaaatcatttctggccaaatttcagaagggatctgtctttttaaaaccccaaatctaaaatgcgtttgtagactcctgtttgaaaagcaggctgaccaatctgaaggattttatttctcccccttctctgcagccatcccaaagcagtgctccagccaatgagatccggccattttattggccccaatgcttgtcaatatgaatgggggtactgggggtttcaatggtttctgccagacaatatgggcccaaagcaaatggcaaattcagtgattttgcaaggaatgggaatgtcgtgagaaacgtgcatgaccccacacatgaattctcccaaacatgatggagaagacgaaatatcaggaagctcagggcaggtgacagggcgaccacctggacacctgtcctccctcctcacagccccagcacagagcaagtgctgctggccccggactgtcccccagcagcagaagtcacagtcagcaaaccgccaaggccttccccggactgcactggcttacagaacacacccagttctggtaagatgggcccgccaaggagccagtgctcctggacaacatccctagggggtggcagggccaggaagatgcctgtaggcatggccagagctctgtccttctcggcttctgccctgtggggcacccagaaccccatccagtgttgcccatgcaccttgaacaaaggactgaacactatggggttctattcccaaccagctatgactcggcagttattagctgggcaaccctggggaaggtgcttaacttctctgaatctgtccttcggtgtgaaaggccttgtctgcaaaatggcccccagaggaagctaatattttccctgtcactcaggggagaaaggtgagattcaaccaggttgcgtggctggtcctacaggaagtgaaggagctgggacccaggcttggatgacttggctcaaaagcagtctcaaccgtggagcagacggccttcgataatagcaacccccgaggatgcagacaggcctgaaccacgggcacccgaccagtaggaccttggtcagtccttaccacgatcccatcttacctcagctcccaagtgcagaagccaaggctcaggaacaaagcgcgtctacccaaggccatccaggcaacaaggcaggtccagccagcctgcccttgctccttccaccaataagtcaccttagcacagagccatctcccccaggtgcacagatgggaaaacgaaggctgcccagcatgcagaaagggcttcctgaggtcgcacagcccaaggatgaggctggcgcaggaactcgagccttcagactcctcttctgcccagatgatcaggggactgaaaagtacctaaagcaagccaagatgcgttctcaggaaaatatgtggagcgaactacctggcttcctgacctgtactttcaagccccactgtcaaatccaccacagacaccaacacagtggtccactctgacccagggctcctctggaagaaaaggaagagaagcttcccagggctctccagtattccccacacctcctctgtggggctcccccagcacctccattttgcagatgagaccagaatgctgcaggcgaatggtgcacccagcattctatccttgcccaccccaccacacaccacagtcccccaagccaggatactgcactgggctttgcacccccaaaacaatggctggcccttgctgagcacttgctgagtgcctcagtgtatcttcgtgaacccccacaaggctcgtatgccttggattccacatggaggatccaagctcagagaggtaaagcaacccacccgaggatacacagcttacatccatcccagggcctgcagcatgggaagtgctcaaaataaagcataagtaagtttcctcgagctagcaccccacccccaaggataacaggcccctacagagtgggagcctcgtcccagtcattcctgtcacccttcaccacccaacaccatctgacacatagtaggtgctcagccaacacctgctagactgagctgacacagccctcctgcctgctgcccagaagagcccttaaaattctgcagtctgcacccgccccttgtgtctgcgcggcacagtgagaactgacatttcttcctagataaatatctggaaagaagtcgggaaacaattaaaactagaagctaataaatgatgaagaagcccatgagccaagtcctggcccgcttcccagtcttcattcatgcatcaaaaaaaccccagcggtccgaggcttcgagagggcagctgggtggtggggctgtccggcataatataaatgggaattagatagaatcgaaggtgcttgttgcattcccaaaggcaaacaccatctcccaatgctgccccccagcccacgtctccccagccaagccctcttctcagggaacacatgacagatgatcttgtaaccaggcaaccaggggaggaaaggttccaaagttcctccacacgagtgaggacagcagtgttctgatcatagtggtgactggggcgcagcaccgtgataccttctgtggacctgaaaaaaacaggggctgggggtgcaccggccactcctccaacatgaggacctcaatgtcctggcatcctccccttcccctcctgagccaggccagccagcccatctttcagggagatagctccgtgtccccaactatcctggtcaaagctgttcccagtgggttgaaaacctaaggtcctaggccacagcagctttcactttgcagcggctcatgtgccctgaccattccctgtctgcagctgtcttgacagatgccccccaagattcccaggagctgaagcctcagcagttccaccggtcagctgcacactggatagatgtttgtccaccatcagagaggatacctgtgtccacaagagaggggaccttgcaaacggaacaggagctctgtgtgcagggagtgtgcaaacccacccgctcaaaaaatccaaatgcttgccaaggctgtgtgatacaactcgaacaccgagcaccttcacatgagcacctcataaaccaggtgctttctcaaccaaggctgcacaggatcctcaccagttgagattatcacatggtgatgttgaggctcagggctggaaggaggaaagggaacatttaccaagaaccttccatgttctggttccttccatgttcagaacctggcccgaaggtttcacatgcataattccagggagtttattctcagacctggaagcatactcattttgttacaggtgaaggaactgaggcccaacaccagaccagaagctaaatgcatgcctttccacctccccagcctgcacccttatcaggctacacaacatccctttgctaacatggtctgaatttgggcactgtctagggatacagttggtggcagtgggtcagaagcaatgagcagatgagtaagaaaaggaccccaggacagaaggggacacctacagggacccagtgtgtgccagacactgctctagggcctaaagacacccctggcccctctcttgccagtcagctgaagtcagtatgcaaagcagggtctcccactctggattcagggcagagctgtcattttatttctttctttccaatatccatagtacccttaataaagaaaatgagtgaagttggaaaattgaagattggaaagagaatttttttttcacaaggcaagcctctcattcattcctttgggtgtcagagggtggtgaggggtgctccagggaggaaatgaagcccttgctgtggggaggaggattcgcctcctatctaataaggttcttctgacaacgccaagatacacaccccgcacgcactcttcctcgctgcgtgaatagaatatgattatttctaacgtctctatctgaaaggaaatgaccacagccagaaacgaagcagacagacggctggagcggagactcagagacggaggccatcaactggacagctgcgtgcgagggagacatcctcaccaagtgtccccctttctgggtcatgcacccccagccccagaagaggacagcagactctgctgtgcaggcccctgacttccaatttgaagccgcaagccaggtatggaaatcagagcaataaagagacgatgcctcccaaatgcacaggacgcgggctgtgtcgggaagctatccatcacagctggctgacacgcgtgggcttagtgtgtatccccctgatccatcgaagggctggatggttttctgggaagtgggaggaggagctaatgaaaccacaaggttggcagaggctgccgatgcagggtgcccagctagaaacttttctttccactgagaaaaagtggctacaacttttgagatcagtgtcattgcactgtctgattttcaaggaaacttttcttcttgtggaaacctttacaggtacaaacaaggatatggaaggaaatataatccatcaaaataacttctcttaaaatgtcaatgtttcctttcggtccctttcctgtggatgcagatagacaagaacacacagacatcgaacggctgagctcttgctgtatacagttcaaacagctgagctcctgctgtatacagttttgatttgtgcttgacattttcccacatcgctagaagtgccctgacatcattattttcaattgctgggtgatgttccaccctatggctggggcatgtttatttcaccactctcttttccatgattatagggacgctgcaggtgtatacgtatgagcctatgcgtgtccctggttagtcttcaggccgtggtcctggaagtagaattcctggattgaatggtatgaaaggtctcgcgacacattctcagccatacccccagccttccaaacagagtgcaccttccgcaccttccgcaccttccgaaatgcactgctttgcactcaccagaacagccccatctgggctaatcctaagacacaagaatacctgttccaccccacccccggtcagcacagcaaaaaactttccacttaatcaatggttttagaaaactcttcggcgaatggggctagcaggcttccgactctctgcattcctcccaggcagactaggtcagccatccccaggtgcaccccagccccgtgacacaccagagcgcctagctcagactccccggacaccacttgctcacggcgagggacgctttgcgcggggccgttgtccaaaacaatcattttttaaaaaaacaaacagaaaggaagcatcactgatacttttgcgatacttgtccgcttcctgaaaatgtgagataatgaataaaaatgttcattaccgaattattcgcttttcctccctgatccacgtcctggtaattaccgtgaccagcctaataaaaactgctacaaaccgaaggtcaactggcagttagaagtgttcattttcatttcaatgtattcatctctggctcctaatggcctcattttctcccatgctccttaataaataccactgaattacaggttaaatagctaaattaaattattgcaattacagcgtgcagagccctgaatctgggtttacctttcccagttcaattagaggcgaagtttcaacagccgaggaattctgattgctgtcaatattctcaatggctgagaatctgcacagacgcccagatatttggtgagagggttctttcccccttcttgtttctgagggactgattggagcgctctcgactgaaacaaaatcacacaatcaaaagtggtttttggaaagcgaccacaaggcataattgattctttttgactgaaaagggagaagacttagcagggttctggctaaatgctgtgtgtgtgtgtgtgtgtgtgtgtgtgtgtgtgtgtgtgtgtgcgcgcgcgcgcgcacgtgcacgtgtgtgcgtgtgtgcatgcatatgtgtgtgtgtacacaaaagaaaaatccctgtcttctaaaggggaaaagtacatttcaataaatacagatcttcttgtttttcatgccactggcccacaattattttatgggtccacattaaagaacttcctcattatttaaatatattcgaacgcttgttggtattgcctcgccacaggattaattatccaacatcccttataagacagagtgtcttaataatacagcgtgcctgggaaggaaaaaaaaaacctcaccagttctgtttccccaaatcccaagatatgagagtctatttcttgtgaaagagctccccctgacttctccatccctcggcttcaaaaggcaccaaattccaccacagacagggactctcgtcttttttttttttaaacagtcttattgacacacatcacgggtgcgcagtgaaaccccatgaggcccactgtgagtatttgggaatccaggatgctgcaggggtccgcagccgagagaagagcctgctgtcctggtgcaggagcacaggcgctggtcagtcttggggagctcagattccacccagaatgggcaggggaaggggactgggctgaagccccattcggagctgtgtcattcccactcacaaagcccagggccgtgccaggccaagtgccaagaagccaatatctatggctggagccaggggacatgagcagtgccccagatcacaggcacaggcacagttggccctgtagggcaaggcatctgctgacatctggaagccctccaaccacgacaggcctcctctgggggcctgggcatctgtccctcagagaggtgagaaaatctctgcctgggcccagggatgccactttgcccatgaggcagcgaggcggggcatctctcttcataccacatggcccacccatctggacaccctgcaaatgccagctccagggctgggtcacagacccccatggccacatgtccctggcatggcgcaggaggctggcacagccactactggagctaacccaggatggaatgagagccggcaagtcctggacaagaagcttccagagggcagagactgccctgcgtgtggctcacctcggggcctggagccctcccccgaggcctggcacagagcagcccctggtcaatatttgctgactcaaactgcatgggaagcagccccccagtggtccacaggctggccaggggaagtccagcctccgtatcctttatgctctcagaccagactttgctggcttggggaagtggcacagccagacgcagcatgggaggagaagccagggcaccaaggcaggtcggacagtggacacacagcaccccccaccaggcctccagcattttcctaagagcaggatcaaagctgcagaggatcccagttctccgagggaagtgggcagtagcccgtgcaaatcatttctacagaggaaaacgcaaccctcgccagggatttctcaccctggaagcaaaaccaaggctcattgtaaagaatgcctgaaaagcaaattgaccctcaccagctgaagagtggtcggtagttaaaaagttgtcacacacaattaacagtccaaatactgttttaagggagggcaggacacaaatggtgacgggacaatgctcccctctcatctagagcctgatgaaggcctgcggcaacatgaatcgctgtcatgatcatcaccatcccacagggggcttccttcctgcttagagatgagaaactcaaggctcagagaggtggagtaacttgtccaaggtcacacagccagaagcccccacctcccatgacaaggctgctccctagggaaacagacctgcccccagtccctgtcctggccctgtgttcaccctgttctgcccccagcagccacccaggccgtctctctgcaccctgtcccaggtccctggtgctgcaccgcccctggcacatcccagaagtgtctccttgctcacacccagcactggcatcccctctgccttgtgtggctgcccctccactgtgcccacctgggaatgtctttgcctccttcacttctgggctcacactcccttgcagagctcctggcctccctttgaccatccctcggtgcctcacactgctcccgggctctatgccagggtgcccccaaggagctgcactcttcctctctatttctggtgaccagaacaatgccaggctccaaagggggtccttgagcccacaacaggcaggaaggagtcggggcatcagccagaaacactcgcctcttttttttcggtagagacagttcactctgttgcccaggctggagtacagtggctcgattaccactcactgcagcctcaacctcttgggctcaagcaattctccccacctcagcctcccgattagctgggattataggcatacaccaccacactcggctgatttttttattttttatttctgtgtagaaacaggatctcactatatcgcccaggctggtctcaaactcctggactcaagccatcctaccacctcagcctcccaaagtgctgagattacaggtgtgagcatggccagccactggcctctttataagcgccaggatcacttgtttctggtgaaagctctgcatgctgtaggagcctctaagagttcttttctcctgctttttcttttaataggcctatcccaggaggaggacacttgagcctcccagcttgtcagctcactgcccttccatcagagaaggtgctgggtagcaatttcatgatcagccaaaatgtgccttgaagtagaagaggacagcccagccctgggccagaaatgacaaacaagacagcttcctcctgaagccatgcgcaaggcaacgcaaggagtgccctgaggactcatggggatgggagggagagagagggaggcagggcccacagagccctggggagagagcagaggccacctgtcgtcggccactagagctcaagtctaacagtcctcctggctacagggcagtccaacctccccagcctcagcctcattcagcctagctcaggcagggaatagcgaggccgaggccacctggagccggtagaacaagcctggggtctcatgcagcgctgcccctgctgagtgacccagaagtgtcccttctcctctctgggttctggtctctggtcaggaagggagtcaaaccaggcaaatctaattcaaacccccgccaagaatccagggcctcacagcccaagtgctctggggtcggacagccggtgaaaagctgtttccactaagaaatacacagggtcccctcatcccggctctcagctgttcaatgtccgcaccccactgtggcacgaagctgggcccttccacaccctatctcaactcccacttcctagaagacaaactgaggctgtggctttccccaaccacagatctggaaggcaagggctgctccactgccccatgtgttcccgttctcgttccccatggccgcagggagcagaacaggcctagtcagccacatggcctggcaccaaacagaaggtctccacagggctcagctctgctcctgtaaatcccatcatcaaagagggaaataacccgtgaagccccaggacagagagagacttctgagatgaaaagatctcacttgacccctgagaccttctagtggcaggatgctgacatgcatgcctggggccaacagaacactgacactgaatccagaactttaatttcttaaaggcgagttcaaagaggttaacgaaaggaaaggtgcaccacgttccatcagtgtcagtgaggatgaagaaaggagaagtgggttcggaatgggtccactggctgagcagcatttcctaagcatctactatgtgctaggcaccatgggggtcctgggaaggtccctactcacaaggagttcattcattcactcattcattcagtgagtcattctttactctgtaattgcacaaatgggtctgaaaactgcatctcctgggccaagctctgtgctggacaagagaggacgtggttatgaagggagcccccctacccccaacactgaaggcatcattacaggccagcacagtgggaccttcagctcagatagggatagagggctgggggccgggggagcgcacagaaggaagcagccacctccctctcgtggcctagtcaatcttatcgcaacgccccaagcgcccctgaaccccccgctctgagccaaggagtgccacaagaaggtcagcagtgcccaggatgccatcagcccccaggtcccccaggcccttgcagatggaaggacttcctcctcatggtcttccagccactgcccccaccctagccttccaggctctacccagtgcctgaagcatgggcattctccctgctcagtcagagctcggcctcagaggggaaaaggctgccttgtgggtgatgactggaggtgggcccacaaaaggggttcactaatgagccacctgtgaacccatctctgggcaggttgctgcagacaggatccatgcacaagctgcctggtgggcctctggggaagtctgtggactcgtctttccagggggtctggaatgaaggcctctctctccctggggttagtgcagagaggctaaggcacctgtaacaacctagcaactgcccccgatcccgcaccccactggcctgtcctgagcacccgagctcttccatctgcagtggccaaaggcattttcaccacccaacagccttggggtaggggggagggaggcaggcaggagaactcagaactttgctcccccagccctatcattcactccacagtgctcagggaggtgggtgggggactcgccaacacccactccaccccacattgctccaccagcttcctgccaatgcccggcagctattcatcccaggggcagtccctggacacctcccaggggccaggccagtgctgggcatctgggagcctaacaagagtgtctagaaccttctcccttaccaataatgtcccttttcccccacatccagacagagcgagagctcgagcccaagtggtaaaaagaatgttctagacaaaatcgaacagcagcatcttccttccgtccttgggtctctgaaggctgtcacgaagggctgcctgcatttctcattcaaaaatgttcaaaacctaaagaaactcataaatgtacacacaataaggccacatgggcaaagcaaaacacagacatgtaacttggggcctaaattcagcccacttcatgtgacaacaccattacagtctgtgccccctgtccttggatggaggggtacctgggacaggacaggcggaccaggtcccagatcacctgtgggcaggtgttcaggggatgcccctccagttacattactttgaaagggagcataatatgatccttccttaatggaagcagctctttcacaacagtaggaagagggaattaaaaaaaaaacaggcccttgaacgaaccgagggccctcctgggctgtcaagagagaattctacagctggtagtgatgacggctccatcctacccggccatttcttcatggaggtgtggccacagggtctcagaccctgaaaatgagcatccggggacagtccctaactgagacggcccaggccagcagggccagtggaggattcgcattcactctggtgctccacaagtttgacggtttgggaaaattcgcggactctcccaaagcctgcatctcccacttctacaatgactggttaaatgcgcccaaggaccaggcgctcgctacaccagcatgccaggaaaggggaggagcgacgtgaggacctcctgtgtcaccctgtcctgggcgctctgtgaactttgtgatgcctgagatgagctcccttttccagaggaggaaaaaggagcccaaaatttgacaggacatttgaagcatccgcccccctaccccccagctttgtggaatgaggtcaggaatatgtaaataaacaaacagagtacgtggtaaggagcagaattcccagaaagttctgttcccacattttacctccaaaattaaaagaaaataacagcacacataccagttcccgggagcagtatggttcttgaccacggtggaccaagtccagacagccataaagccactcccaccaaggtcttccagcaaagatctctcattgcagaatcaagttgttgaaggaaggttagctccaaagaggcagcccttcgtagccaggggttgggaggggagtcttgtgggaagggagcctgaagtacccccgataccctcaacagaggaccgaggctttggggaaggaacacctgagccagcaaggttcatccaatggaggccagggccagaggcctcctggaccagattctctctccaggagcagaggcagagggtgatccaaggacacagaacaagaagatctcagcctccaacagggtcaagatgggaagatgtcacagtcatccatcagggtaatactatctcttatccctgggggccacaaactacgggccatggatgtctgcctgtttctgtaaataaagttttattgaaacaacagccacacctgttcattaatagtccacgggtactcttgcactacagtggcacagttgaatacagtagttccctgttacccgtggtttcactttctggggtttcagctacccgaggttaaccatggtccaaaaatattaaatggaaaattccagaaataaacaattcatcagttttaaattttgagccactccaagtagtgtgatgagatcttgcaccaccctgctctgtcctgcccaagacctgaatcttccctctgtccagcatatccatgctgtaagacaccacctgccccttagtcactagtagcctccttgggcatcggagcaactgtggtagtatcgcagtgcttgtgtcgaagccactcttattttacctaataatggccccaaagtgcaagggcaatgatgctggcatattgttccaactgttctatttcattattaattattgttgttaatctcttactgtgctgaatttataaattaaactttatcataggtatgtgtgtataggaaaaagaacacagtacaacagggttcactactacccgaggtttctggcatccactgggtgtcttggaacatatccccccaaggattaggaggagactactatagttgcaagagagaccacttggcccacgaaccctaaagtacttcactatctggtatttatcatagataaaggcccggtcttatctaaaaaaccatgggatgaagccctccaagcttgcagttgatccaaaactctctatgctgaactattactttctttcataagtgaatcagaaatcacaatgtttccatttttgccaaggctgccaggaagctcagaggtaaattctaggtttttatgcaatgcagattactaggactaccttttctgtcccttgattgtatgattctcattctttcaccatcattttaatgcttctattactggtttacttaaagcaagagacttcaaattcctcttattatgacataaatgacaaagcgaaaaaatacatgaggacccaatagctgctccagctcagggggccccctgcaccttgatgagcctttgcagacctaactctcagaaatcacctggccaagggcacctcatcccttcctttccaatctaaagtccctctagctgagaccttgggaccagaaaatcccccatgaagctgagggagctttgggcactcacctcagtcacttccagtgcccttcctgtttctggtgggcaagagggctccaaaagcatcccctattcactcagcccctcattgacctcctgtgcaccctgggtgctgggagccggagctagaggcatcaggcacaatctgtgccctggaggccttcacattccacacaaagaggatgtgacatgacttatcagccggcccagaggcaggtgcaagtgctgcctgggggagcttttcccggagagtaaacaggagctccctcggctgcctggggatgcccagggcttgctgggcagagtctggccaggccaaagggcagaggcacccaggagcccagtggagcaaggagcccagtggagcagagctcagctgccaacaacagcagccctgagggacagggctctggcagatcctgtccccagatccacctggaactgagctcccaccagctgggtggccctgggcaagtaacaggcccctgagtctccatctccccacaccagcggagcagcattattgggaggaatggagagagcagatgcaccacgcccagcacagagcgggtgctttgtaaatgaagtctaccccaggaggcctggctgggtggtagcggacacagggcagcatagggagatgagtccagtaagtcccaggggccatgcatgttgcaatgaggagtctactttcccacaggggtgtctgaaagcccggatgttttaaagcaagaggcgaaggatcctgtcccttgtcctttggagtggcacaatttgaacaaagatgggcctgctcaggcctggcatcccttcccccactggaaaagcctggtgtggtcacctgggccacagccacagggcctcggacttccctgagccccagatcccaggaatggacaaggaccgttcctccacagaggccagcatcttggagctgcaatccctgctaatcaccacattatttatttggagtttattaagcagttgctgccactggctgttggcagcctctaatatttacacctagctttcccgaggtctcctgaagcgctaaagtaataaaagggccattccttctagctgcagacagggaagctaacccaagcaagaccgagcacggggctgcacttaacaagaggaaagggggccttcaggttccctttggcttcagactcaattctagctaataacactgcctccctcctgtccgggcaggctcggggcagggccccttcccagaatccactgggcccgttgtttgaggcatttctggcccaagacagcagccgagtctgcgcaaaggagtgctcgctggaagaaccgctctagttccattcacccacccagcagacgtgaggcccctcagggctggacacgacactgataccaggatacagaggtcatgaagctcgtccctgccctcagctccaacagccacatacactgcagccaggccaaggccaacgtggacatggaaacctcgagcccccaagaagtgggagagagaggctccatgcgagagccaggacacctcccgggaagcagagcacagtgacagcagaagaggctgagatgggctcacagtggggaagagctttactaaaatgtgtctaggatagagaagggctacagtctgagacctggttacaaccccctctctgccactctagagccatgaggtcttacaagaggccctggactcctatgagccccagtttcctcatttgcaagacgggagctgccatcctgccacagagtcacaatgaggactctgaagggaaagggcgataggccatgggctggggagggggttccatctctcactcggctcataatcctactggaccccaaaactccgcttcttgtttatgaaaacactcggcctccactgacatccgcaggggactcctgcgcgaccagagagcagggcagagccctggggtgtaatccatggagaccaccgaggccatgtgaaggaacaagcctggtcgtgggctggaatgaggtcagtgccagggccagcccagcccagagctgtgagtaacaacagctgccagggacactgggacaaccaggggagagaagcatgcgcccagcacgacctcagcaaggtgccacagggatgcaggatccagcccctggggagcctggcccccggcaggggagaacctcagcctcaggctgagccagggccatggctgcaggaagacaggagagctaggaggctgagggtgggggaagaagcccgagggtgggtgagaggtgagtgccctggagtggaccggccaggccagttgtcctctctgcctctaaatctatgacctcagtctcaaagccttgccttctgtgcaccttgactgcaaaaccactgcaaaaatgcagtgctcaggatggcctggcacccactagccctcaacagggcagccactatctccacagctgcaacacttaggccaatgcctccagctaagtcccctgaatggtcccataaccaggaagacctctgagccccccgagactctcatcaagggctgaggaaatggtgtgaggtggtgcaccctcttaccatttcctctgaggaaagtcatgccaggacagaaattaagtttcaattcctgggcagcacgattgattagcagaggctgccctacctctcagcttgaagcatccaggccagagcccaggggaaggaggtgctgtgattgacaagtgatgtctgctatggtataggagggagcaatggaggcacacatgctacggacatgcccaactctaatgcgtctctggacaactgcatcctattccttgcagaagaaacaaacaaaagagatagaataagcactgcagaaaatagaaaggttgggagagcaggtccaaaacaatggccaaaaccggagaaggggaggaagaagagttgcctgcagctgccctacatccctgggctttctcagcccacagtaaacaggaggcacagattttccagcccgtcttgactgcggaagtgtgtttactgaaaaggttttctccagggagaaatcaccgagaagagctctctctcctcagccggccacctccctgctccagccctttcgttctggatctgcaacaggctcccacaggagcccaagcagctcatgcccgaggaccaagaaactgacttccccagctttgggtccacgccaaggcttttcctgctcaggtgtggatagtcactctagggaagagagagattgaaggtagggcttcccactggggaataaggatgtccccaaagccagatccaggaaagcactgcagccccagagttggtctagcaggggtgactttgacactgacgtgcggaggagcctgaggtgggaacccagtcttcaccatcacctcctcctgacttagctgcacttggggccgcagagccctgcatcaccatggagaagacaccttcccctctaccaacgatgacaatgatcctaataagatcaatagacaccttcccctctaccaacgatgacaatgatcctaataagatcaatagacaccttcccctctaccaatgacgacaatgatcataataataagatcaataacagctcccctagctgaggcctgcagatgcgggccccgtcctgagccatccacacatgcgtacccaggtaataccatgatctccttttagcaagtgaggaaactgaggctggaagatggaagtgggggccaaagtcatccagttaagaaggcaaagccaggtctgccccaggcctgtctggcaccccgtaggactctctgcctcagaaagcaccatgggagcagcagaggctccagtccccagcccaagcccatgggcaaccaggggagtaaaggggtccccatgagagcctgcagctggacagcctctgggcccagggcagagtcatgtacttgggtgttgtctgggcccctcactccatcctggcctgtgccttttgctgttctgtcctcctcctcatggcagccggccacagagcctggtctcagggtatagcgtagaattgccaatgccactcatgcatccatgggcacacacatgcacactcacacatgcactcgtgtgcacacagacatatgtgcacacatgcatgtacacatgcacatgcattcacatgtacacaatgcactcatgcacaaacacacgtgcacacacacccccctccacctggttcctcgagtccatcgtccttacttctcagggctgcacctgacctctttcacgtgaatgtgtgactctgacctgctggtgcatttcccacccagaggttcacaccaaactccgccctgccctctggagtaccccccaccactggttcctcggttctaaacttgtgtttattttacagaaaatttaatgagtaagcaaagtctgcttttccagcctgtctttctcatcatctatgtgggcttttgcttcttacttataagaagaagaaacttcaacttgatacaagtaaatgaacttgaacccctgcccatccccactcccccctccacacatcccagcagaagagttggttccaaactcagaaaccacactttggatcagattccaagcccaaagcttctcccatcctgcccaccgacttccactcattctcatcatccctacactttgtcttcttttccaggaggtgccatcaacccaagcaactgctcctcctacccagggattcacctgagcactgggggggctagagcaacttgctgaataaagaagcaaaagcaaaatggatctccccaaaatttccaaaaatcaaacggtgcacccaaagccagagaggtggccttccaggttggtcagacagctgcagcatgtgcagctcaagccccatgttgtccaaatgtgcaaacctgcagcctcccctgggcctgggcgggcagccaacactgcaggaaactgaggctccgaatgcacctgccctggatctctggccacattgggtgtctgcttagtcagcttcatttcacttgatttcacttcattcacaagcgctcacggacagcctcatgggggccagacctccgcctgggcctatggggacaaacagggtccaggctagctcacagcctggtctcccaggacagccagggagacaggaaaggagacccaccccgtgataggtgtctccatgggtaagtacaggggcccatcggggagggcacaggtgacacggacctcagccccgacctcagcagagacttcccagagaacaacccctccacgccccacccccaggagctgaagctggaggcaagtgtccacttgcctgtgacccaggccctgacagggcccatgtgagaggcagaaagactgcactgcagagggctgatcccagggccatgatgctctccaacctcccccacctgcttggctcccttgcccaaagcaggatgtgctgtctttagacaagaagtctctgggtctgtccccaaacccagtgatactttgctttgatttcctgctttggttccagtcttggtcattggtggcttctgggaggataaaataacatcactgagggaacaaaaccaagcctgtctccaccttcacctgagcaggatgcccaccaggggagaggggaccctagaccctgtgccagtgcagagtgggggacctactgccatctgcttaaaactcacatgagcagacagacagggaggcttttcagctgggcaggaatcatttgcaagaatcagatgctgagaccatgcccaggctctcgatgagcccctggaatgaagaagggagccccggaggctcggccgacctgggtgtgccagcacaaaagaggatgaaggccccgagctgctccctctcaagtgcagcagacacagccccgactaatcagacagcagaggctgccacccagaatgcccggcacgttattcagcaatgaggtataattgaatggattaacatgaatgcgacgtttcccctccaaaaattcgaggaacaccaaaatgactctcatctggactggtatgactcatgtttttaatagaagaacttaattttcacttctgaggaatctgggctcagggaaatattgtctaagaaacactcattttactccacgggcaatggtaagtcctactaccccaaaagtacaaatgcagaaccccagccggtgcctgtctcccacactcccggacgccacaggctgcagagtccatgagcttgggcagagcacaaaggtctaaggggaaggcatagagtccagcgtcagccacacgtgtcctagctcagcgcagggacttggggcacatcctgtcccctctctggggcactgcttggagagcatctggcaacaaggcacaggggcccctggcaagggccccccgaggggctgccccgtgcgcccaggcacaagggtactgctggggccagcatcttgcttctgatgctggaacactcaaggtgacacatcccagccctccggtgctcctccgagaggcttggccccaggacactgactcctccctctccctagacccagtcctcagaccccacagagggcaggcagaacctgggctcaagtgtcagaacaacaggtcaccatttgtcagctgcctaattagtggagaggatattactgacccccttggtgaaacagcacagaagttccccttcccttctggcacagtgagtgtccccccatccacggccctgcctgttcctagcttcaattcccacaaagaccctgcctcccagggacactccagcctactgccctccactccagattccaatgagtggcaacttctacataaaatctgaatccaggtgtggccaggtgtggtggctcatgtctgtaatcccagtgttttgggaggccgaagagagaggatcatttgaggccaggagtttgagaacaacagcctgggaaacatagcaagaccctgtctctacaaaaaattttaaaaaattagctgggcatggtggtgcatgcccataatcccagctacttaggaggctgagacaggaggatcacttgagcccagaaggttgaggctgctgtgagctatgatcacgccactgcactccagcctgggtgacagagcaagaccctatctcaaagaaaaaaaaaaaaacatgcagcaaaccaccatggcacacgtttacctatgtaacaaacctgcacattctacacatgtatcccggaacctaaaatacatttaaatattaaaaaaataaataaataaataaataaacaggatgagcatctggatgcagccttcttgggagcatggggacccggcaggacggtgctgttctgcctctttaccttcccagcagcatcttattcccatggccccagcaggtggatgtgcttctagctgatgggtggctcctgaagcaggggaggggtcacaggggccaggaagtcagtgctggcttgaggctacagcacccaggtacagccatctcccggctgaagaactccacaggtgagttcatcaagcatgcaggggtgggggatgcgcccacaccaccattcctcctgacggcactgtcacctggacagctacagcggaatgtcccttctgagtgctgctgacctctcaccaagggctccacgggctgcctccatgcccagaaggaaccccatctcccccagccccccaccctgcaatgaagaacagatatccacgttctccctccccagctcttccccacccctgctccggccaagggagatgcactaatttataagttgcagataatgtcacccaccattcatccaaatgtgtcactaacatcccattagactgtaattattttttaattaaaactaagaaaactggcatgcctgagccgactttatgcatctgttatgggttaaaatagcttttaaaaaatgtttcggagaccgcagtctattgtggccgcggcccctgccaaagaaaacgcaagcttgcttattttctccatggggcgcaacagtgcctatgtgtgccggcagagaatcggctggccgtgaaaagaattctaaataaaacacaaacatggaatttggcaacgccacagaagcaagcttaagactaattccagcatgcggacggctctcacatagtaaggctggctccagcataaatgaaaccaggcactgtaaaataccaaggcacgttggagtttccacttaaagggacagaacactgattccaggtataaaagcttattaagccggctcgcactgcctccataaatccataggttattagctgtttgctttcagccaatcccttcttaaagacatgtatattaagagagagagaaagagggagaaaaacaaatgaaaaccatcactttgcacttgacttttagtgcagtgattctggaaacactgtgttcattatctcaattagaggagaaagagacctcaaatacacacaaacccaaaacgaaggagaaaagcagggaagtaggggcgagacgcgaggatgaatgcggcccccaggaacagagggcagtgccgggaacagaggaaaaagccccgtggatcccggaaagcctccgcccagggaagcggcaatgacagtgattgcaataataataatcatagttataacaacgataaaaagatagcagtaatgcctgccgctattcagcacctttcacaggccagctgctgcttaaggccgcacaatgtaacagagaaagactctaaggtagaataaagcagtaaagtgtctgaaatcggactgcctccatttcctcatccgtaaaatggggatgtgaaaagtgccttcctcgcagaattggggtgagggatgttgaagatgaagcccacaatgaacgcttcttagcacagcgccccattatcactgctagccgcccactctcagtcgtgagatggtgctattctcatgccacaggtggggaaccagatgcacacacaggctgggctacctgcccaaggccaaagctcagagacatccgagtcgggatttgaacccagccgtccacttccacagcccttattctctctgcagccactcctggtgggtcacacaccagactggccacatttcccagcactgtggactgtgggctccctctgagattgggggcgggggctcagtctcccccaggaggtactaagaaggtgaattcagctctagagagagactcgccctcaaaggcctcagcaggcctcaggatggacacacaccacaaatccaggaagaatcagaaagttcagggaagaaaaataatcacaagtgccctcaccataaacacagagcttgggaggctgggaggggcctgttctgtgctgatagttctccctggactgcacacagacacatacacatatacactcaacatgcacatatgcacatacatgctcacacacaaaaacactcatacacacacacacgcatacatacacatatgtgcacagataccatatacactcagacatatacatatgtactcacatgcacaaatatccacatgtgtacacacatctgcacacacgtgtgtgcatacacacaaatacgcgtgtatgtacaaatacatatgcacatatgctctcacatctacacatatacacatgcatgcacatatatacacttagtcatgtacacacatgcacacccccacattcacacactgacatgcaaatacacatacacatatgtgcacacacaaatacgtatgtatatgcacacatatatacaaatatgtatatataccctcacatgtatacacatgcatgctcacatatacactcagacatgtacacatatgcacatccacacatacacatatgctgacatatgcaaatactcacatacaaacacactcacaaatacatacacttacatatacacgtgtacacgcatgcacatatatgcacatatacactctcacgagtacaaatatacacacacatacagacacacacacacacacacacacacacacacacggccttttattacgggtctgtgccaggcccaaggaccctggcagaggcaatgggaaaaaccagggagaaaattacatgaggcaatgtttggctccaaatgaaaaagccgtggaatgttttccctcaagtcttggttatttcttgcaggtccgctcagaccctgtcaggtccaccttatccagggggaacccccaccccctggcctctgagctgagccagctgctgttctctcaatgctactggcttccagactgggggtagccaggacaccccaggctccagcacctacagaagccacggtaggctggtggaacacctctcctcaaatgcatgctcagacaaatggtgctcagaactgggctccttaacctctgaccccgccgcctgccaccaccccgtccccacaggcttcaggtgtgctctgacttggtgacatcatcacatgccagtgggctccgaactccactccctgaaaacatgcaccatgtcttaaaagatgcaaactaaaaatatttctggcttctcagagccagtttacaaaaataattatattttcttttaaaatctggattataggcaagtgtgtgtccagttatttttagctcctattcaactctgttaattctcataataatcattgcaggttttttttttttttttttttttgagacagagtctcactctgttgcccaggctagagtgcagtggcgcgatctcagctcacttcaagctccgcctcccaggttcacgccattctcctgcctcagcctcccaagtagctgggactacaggcacccgccaccatgcctggctaatttttttttttttttttttttgtatttttactagagacagggtttcaccatgttagccaggatggtctcgatcccctgacctcgtgatccgcccgcctcggcctcccaaagtgctgggattacaggcatgagccactgcgcccggccacagatttttttaagccatctccccgccctatcgttaatagttgtgttctgactcagcatgggggcagagctgggggccacatgtgaccacactgccttccataaacacagaagtctgagtgctagccgaagggccaggcatttcagaatcaccacattcctgagaaaaaaaggaacatgtgtccatcttgtcaaaagccagctccagcttcaatgcaggagacatttggggaatcccctgtaagtgcctgaacctgtcccagacctcagttcaccgagaccagctgggtttcctgccctggaagggcctagaatccagcaagaggcatgcagagaagattggatggagccacctgaaataagctgtccacagctagatcccaggacctgtaaatgtgagcttatttaggggcaaggtcactgcaggtgtgactaagtgaaggctgttgatgagatcattctggatggtctaggtgggtcctgaatccaaagacaattgtcttttttattttaattgttcagaagagaagtcaaacccagaggagaaagctgtgtgcccacagaggcagggaatcagggagcacggccctgccgacccctccatcttggacctgtggcctcccaaactgtgagaaaatacatttcttttcttttttttatttcttctttttttttttttgagacagggtctcactgtgttgcccaaggctggagtgcagtggcacgatctcggctcatggcagcctcaacctccctgggctcaagggctcctcctgcctccacctccccagtagctgggattacaggtgtatgccaccattcttggctaatttttttagagaatgggtttcgccatgttgcccaggctggtcttgaactgctgggctcaagagatccacccacctcagcctcccaaagtgctgggattacaggcgtgagccaccgcacccgaccacagaatcaatttcttattgtcttaggctacccagtctgtgcccatttgctacggcagccctgggacaccaatacaggacaatagagagaaagcacaaccactaataagaatcatcgcaattaccatcccgatatacaaaggacccaaggccactcccttgagattccctgtccccagtccctccccgcccagccaaggaagcaaaaccagtgtgatgattcccatcaggcagggagaccccacaaggctcagagagggccaaagcgtgcacaggacaccgagtgagctctatctcgctcctagggattctgattccaaatacggggctccttctgctaagtcacactcaaatcaacaccctgaagacacaacagaaagaacaatgaaaattgtccatttgtagaattttcttccccaagctatcaaggtagctaaatgtttagctttgttataaaaaataaagataaaaaataaaaattaaaaaaaaaaaagctgtcctgggagacagaactgagaactgccatgggcaaccatttccaagacaaaggggattcaagaccctcaactaaaatatactgaaggtggtagcccccagcagtccagtggtgactatagggccacacctaggctggctgaggctggattcaaaccgccctcaggtttattacccacctaacttggaccagttgttgccacatccctgagaggcaggttccttggctatcaactccaacagtccaaaaaacactaaaattacccaacagtcagataaggatgcggagaaatgagaacctctgtgcactgttggtgagaatgtaaaacagcgtagccactatagaaaacggtttggcaattcctcaaaaaattaaatataggattaccctttgacgcagaaactccacttccgcagaaactccaaaagaactgaaagcaaggattcaaacagattattgtccacccacgttcttagctgtgccattcacaatagccaaaagcagcccaactgtccatcaatggatgggtggataagcaaaatgtggtctatccatatgatagaatattattcagcctcaagaaggaaggagattgtaacacgtgctacaacatggatggacctcgaagacactatactaagtgaaatgagctaggtacaaaaggacaagcactgtatgattccacttacctaaggaacctagagtagtcacattcagagagacagaacggagaatggggggctggggagaggggaaatgggaagttagtgtttaatggtgccagagctctgtttgggatgatggaaaagctctggagatggacggtggtgatggctgcataacaattgcaatgtacttattgccaccgaactgtgcacttaaaaattgttaaaatggtaaatctaatgtttatcttaccacaattaaaaaaactcacaatcgaagcattgtgagaatcactggagatacacagaaagcccacagcacacagtggacccttgatcaatggtattttttattttatttattttttttatttttagacagcatctcgctctgttgcccaggctggagtgcaatgctgtgatctcggctcactgcaacctccacctcccgggttcaagcgattctcctgcctcagcctcccaagtagctgggactataggcgcccgccaccacgcccagctacatttttttatatttttaatagagatggggtttcaacatgttggccaggatggtcttgatctcttgaccttgtgatccgcctgcctgcctcagcctcccaaagtgctgggattacaggcgtgagccaccgcgactggcctgatcaaaggtattttttaagattaaaatgttaataactgagttggctaataaaacccaaggaaattcatgcaaaagaacttgagtcagaactggttaaatacaacaccaagagcagactcacgcacccagtgggccttgccccactagctattcctcacttcttaacaaaggcaatcatttaaaatgtccagttttatgaaaagattccagcggcccccgtttctgcaggtactgactccatttttgcattcacctccctggagaagtcctgagcgccacgatcccttccttgagaatcatacaatactggcgttctaattacccggggctcaggctggcccagtggcagctctgtgattcacaagctcactcctctcccttggctgttcctactcacacctgccaggtacaaggccaggcgggaggggcaggccaggaccagacgcaaggacaggagcaggatgcccacgtgggccccaggctcgaggaggcttggattcaaatcccacctgtgccgtccaccagacgcgcaaggaaagcaatttcgcatctgcgaaaaccaggagcggtcctgtcacctctcacctgtgaactacaagagaagctgcctggaaagcccaaattcagagctgggagagaaggccccacctgggcaccccatcgcagtgagttcctctagggcaaggaccctgtcacgcccatttctggaccctagggtctagcccagggtctggcacatgtatgaccagcgtatgaaggaagacctgggggatcctcccgggaaccatatctgagtttgatctggtttccctggcataatgctgggccccacagagggacccctgcccaccgagggttccgtcccactgctttttgggtaaaagtggccagccttgattatgtttgaataaactgtatctcatggtttagactatttgggtttaattgtaaaatatacacagaacacagcccctccaccccgaccctgccctcaggttcgaaaagtcaagtacattttgttcccctctccccgcaccataaaaacaacaaagaacacctcaagcttttttaagggctattatttctttcgctccccagtgggggaaaaaaaatggattccactgtcctgtgtacaaaaacaaggaggatgctcatacaagaatgtggctagcagcgttttctgtgtttcctctttctctcacaggtgtagacactgccttttctgagtcttcatcatcccccagcatctcctgggcacctgctgggactcatccccgccccagccactggagagacagagatgagcctggtcgaggaaatcgacttggttaaggctggcgtgggaccacatgccaagtccctgactcccagtcagaaccccaaaacccaatttgaggtgatccgatgagaaaatctcgctcatgctctagccctcttcttcaaggtcaaaactgccttctggtggactgaggatcggtgactttgtttccctctatgtccagccagggctggaggaagcttgttgtcagcaggccccttcccagaagacaccacatccacacctgtcactgcccacagtgactggaccctcagcctcaagttccccggtggtaaaacccctgtagatctcccaaccctccaggctcctgtaagcccagccctttaatttctttatttccctttctttctttctttctttctttccttctttccttcctttctttcctttctttctttctctttctctctttctgtctgctacaagtaaactttatttgatgtaatgtaatacaacattttcaagtttcacaatgagcgtttgacataaataatcatttaaattaggaatataagtatgcacggtcacttgagcaaatttgcagttcaggggttggtacgagctttgtctgaaagcttttttctcctttaggaaaaagtagcccttcccttcacctggtaagaagcactatcaatgggagttagaagaagtccataatccaccttggaattccagctgatctgtgagaggacagctttctgtattctagaaaaataatattctctttcagttcattcatttttccccatggaagatattggcactctcttcatctactgtctttctgtctccttagctgctgcttattacatagaaccattttttaaaaatataatatctgcaaagagacctcttctgttcccttacctcccctaatgtctattattttgtggagagggtagggtggtgggagccaggggccagaattgcttagacacacatttgatctcaggtacagagaacacaaattctctggaaggaaccccatgggggtcgggagcattttccaagagtggtccaggtgaccttcaattcacacaattctgtttaatacggcgctgctccatgaggatgagcatatgtatgccccatttccagaaacagcaccacctttcatggaaaacccattactctctcgcttcttccacataacatgcggttatggaccagccatgggcccaatgcaccactggataaaatgagagtcaaaaacacgccaataatcacgtggattccaatgcagtcaggcaccacttgtgcttcattcaggtaaaaatcctcacagaaggtaccccccacctctcagcaatgcgaccacaaggacaagctgtcctcaggtgggacacctctccatcctgagatctgctcttgagctgcaccatggcaataagtgagggagcacccgagcagcagccaattgattcatttttttcaaacagagaaaggcgccatggggacatgcatttcacatccactgagtgagaaggccctccatgggcacccccaccacggtgagttcctctagggcaaggaccccgtcatgcccatttccggatccctcagtccagcccagggtctggcacaaggatgaccagtgcatgaaggaagaccttcaggaccctcccaggtaccatatcagagtttgatttggttttctaccagcagctccttctctgttgtccactacagcccagtgggaagccagacgggagagctccaagtacagctgggaggctggccagacctgagtctgaatctctgttttgagactctctgtccaagttctgctatttgtgtgctgtgtgacccctggtgggttgtgtggcctctctgagccccaatatcctcataagcaaaagggtgggggagtgcctcttcttgggagcgttacaacgatgagatgtcatgcctaggactgagccggccctttagcaaacagtggcaagccccaggaacactgatgatgttggcccttcctctgccttcattcacactaagaaactctcccaggcaagtggctttccaagagctaagtcgtcactggggtgccgattacccaaggccagagtctcacaaggctttccggcatctcagctttctccctccttcccttcccaccggccttttccctctgattcccccaggtgctggtcatgggctgtggccacgcccagatggtagctgttcatgggacctgccagtagagggatggtaagcaagtacttcagtgtccccattttacaggtggggacactgaagattggagagaggaagtaagtggctagcctgggatcacatactcactcccattcactgcaagggaaggaccgaggatggccccatctcgagagcttcccacaatgcctgcagtctaacacgggtccacaatgacatttaacttcaaacacacatccatgccacagagccccacagggacagggcagccagctgtcaaagcacaaccccagagtctcaaacccaggatgtgtctggtgggctcccactgcagatagcagagctgaagtccaaggcacccaacgtggggctcctcaacatcagagctctacctgctaccaatctcattgcagggttcacaccaagcctcatggtcaggcagaaatcaatctttaagtggcttccactgggcgacgaacttccttttctggttttcaataaaaactcaagagaggtagtatggcctagtgggcagacccaggtatgagtcagctctgccacccatgtgtcatggcttcatccccactctctgccttggtttccccatttatataatgaagaggttggaggagatgatctcttgggatccctggtcttagattgttatagactgacttgacctcaggtcacccgagaagaacccatttctgggccagtccgctccacacagagggcaatgcaagcctcctctgccactttccgagtccctttaaaggagaacggggctgccttgctctgaggtctctgatgtccttggccagtgctgcttcttcacatccactaactgcttgaaagcgctgcatccagcactgcattaaaaattaattacacatgctatcttattgccagtgcataatgtaatgagcaccagctgtgctaaacagccaaactcctttttaagacagctattaaaaaaaaagggaaaaaaagaaagaaagaaagaaactgcacttccaaatgcctctcctgtcagagcagaaaaacagcaacatcttgtatggatttgaacagaattctttgatttagctctgccttcagaacgtctgaagggccaactcagagagtgaaatggaatctggcgaggctgcagcgatctccactcagggatttgctggggcctcttttatctaaggacagtcatgctggtaggtgccccaactggggggcttcccccaactggggggcttgcagctctccatggcttctcctggcacttcctccggtcacagaaagaggcgtctgggttctcaaggcagtcgggcatggacagcctctgcagcagcgtgacctcaagaagcaggcaggtgctagggtggaatcaacagcgcttgcacgccaggaagagcaacagcactgtgaaggctgggttgcagatgctgggaccaccggcccttgggcgatgtagacattgcaaggcatacagatgactctctaaatttttaataactcccctgaaagcccttttcctacatggagccagcccccatcaacactaggacctgtctggttagcccagaaggatcctaacaacaaacgttactttgcaaagggaatcccatgagcatgttttccaaccttcccacgacggagctctgctgtccacacacgctcactcacacggttctttttttgtcttcacccccatactcacccctccctccagtctcagtggccgatctaacaccctcctggagtgtctctggcaccccctgcaccagaatcaaggcgacgcatcagcaggggcctggtgaggctaccatctctgtccgtatcaccgtttggcttcccatggatcctccggtgttaatcgaacccagtccagaatgaaactacagcttgcttcttgtttggtatgaaatgtgcaaagcacagaccatatcattaacacaaaacttccagaaataaggccactttccaggcagactgcattaattgcatcaggcttccacagctagcgtggtctaatccacggcgccccattggacggctctggttataaaaccaacacaaaatgaacactgggatataattgaaggaggagaaaaggatagattctatggttaaaccctactatttacttacaggtattcttttatctttattgtccctttaacccatgccaagaaaccccagactagttaaataacacagcaagcacaatttcagtagaaaagtaaattgaatttaactttacaagattgccctgtgatttcagcatatactaatgactgcaactgactccctctattaaagccaaacacttccacttccctgagctgggatcctgtgtgttcttgtgtgagaccttgaacttcaccaagtacacatattaatcactgtggctgatgaccatttgcagcttttaaatatgcaatgaagtgtctcagttcctattccacctcccaaagctggtacatgatctgagccagccaaaaggctaaatacttttaagaatggaaagcgaagatccagcttgaagtgagacctgacagagtctcaatgtcgtgaatcccattccgctcgtgcatggactctaacttcgacagggctcactcagcacatggtgttgttctcagcacctggcccgtatgatctcacacgatccccagaacgacccttcagagcctgtcctatccttagctccattttatagatggggaaactgagggatggagaggggaaatgactacatggggcagaacagccttcacccccaagcagtctcatacacttgaccaccgctttccaatcatggaagcctcagaacagggaaggattctggcatgcggggcacaaagcccaggagtgtccaaaccattctctgaatgtcccacgccctgccctggaaacctagctagccccatgctcactccacccacagcagctccacactgacctgtctcagaaaataacacgagcctcgttttcaaatgttgcatacatacacatatacatacatacgtgtatttttacagaaggggaaactgaggcaatgacttctttagggcccctggccagctgaagcacagaccaggaacacagtctgaggctcttgaccccacagccactgtgccaaatcctctatgtgaaatttctcagggaagaaatttcagttcccaggaacgcctagactcaaagccccaccttccttcagcagagtcaaaaagagtcaggacccccgagtcccttctccccactgcgaccattggaaagaggtctagggttggggtcccgggaggcagggccccctgggatgctgccagcccagggtgtgcacaaacacacatacctgtgtggttttctccccccgtaaaatcacatccttctataaataactgcagatgcggtaacaggcacgcaattaacctgtgtgaaacacgtttacactggggttctccatgttaacttgaagagatgggttcaatgcatcctgatccgaaaagggacaaaaccaggtaaggacagcaggcccattccatctttacaaaggcctgcttcttcctaacgggttactgggaacttaatgactccattccaactactaattaaacaggcactaaaaacacttaagcaaacagcccagtgccagggacacaaatcacaaagggacaaaaaacaccagaataggatagtttcaggtattcaaattgatcgggaaacatggtggtgcaagctggtgagggccaatgaactgggaccgaatgaaaaaagagaactgtaccagacatggtggcagagggcaggaggtaagagcaggccccttagaagggtctcctggagcagtcctaggggctcagcctcctgcagtcccagccccaggaacaggacactgcccttcctcacgtccctcccagagcactgcaatcaagcactggttgctcacaggctctgagtcctggcagctctcaaggcctaaaatctaaaaaggcctttaatgccagaagaagagccaaagccaaagatgtggcaggtgctggatggagagcctgggatcaaatcccacctccaccactccctccctccctgctcctccttccccttctgcaggtccccactccctgtcctccccaccaccagactgcaagctgcacgagggcagggacctgcctgccgactcttcctgtgtgtgcacagtgctacaagctaggtgccttccaaatggcttcaagctaaagaatgaataaatggatggatggatggatggatgaacggatgggtggatggatggatgcatggatggatgcatggatggatggatggctacatggatgaatggatggatggatggatggatggatggatggatggatgcatggatggatggatggatggatggatggatggatggatggatggatagatggatggatggatggatacagggatgaatggatggatggatggatggatggatggatggatggacggacggatagacgtgagctgtgagaactcaacatctctgaacatcattttctcatctgcaaagtgaggagaataaagtattagggttgctgtgagggttaaattcaagaaggcacacatgcccagcacaatgcagcacatagcaggccctccatacacagtcctcataaggatcctagtggcatgtatgaggacttgctgatggcagagccccccagagccaaggcagtggaaagctcattcgacctcccgtggatgtcggcagaggcagcgtggctccacaggaagaggggtggcctttcaggaggcaaccaaggacaaatcccagttctgccaccctggctagccactctccctccccaagcccttgcttctccatctgcaaaatggggatggtaacagctcctggtcagcaccatacaaagatgctaagcaggcctggccacatgagggagcggctcagtcctctagctgagtctcatctacttcagcaacttctaagtagggccaacagagggttaagcaaagccctgggtgagcctctggtgagatcagatttctgtgccacggaacttgaccgcgtccagtaataaacactcaggctgatcttcgatagcatggcccccccagtggttgccgaggctgcagcgctaatgacaggaagccacgagagcaaggcaaccacccagacagagcaggcaccccctgctcagcaagcagggccttccacagactcacagaacagatctactgaaccaggacaggaggcctgagcacctggggaccagcacagcccagaaaagggagccggcgtctttgcaagtggttccgactccttcccaggagattttgggttttgctttgtgcctttaaggcacaagtccagtaagaaaccagaactcccttttggaagccagatcctatgatgtcaccacctgtcacagcagggagggtacactaaagctccaggccaccctactagggagctctggagcccaggaagctctggaccctggagcaggggctgcctgtggccttttacagagctgtggccatggcttttgcagagctgtggctccatcagggaccgcctgtggggacagcttcaattaaaaacacaacctgcccaataaaaatagttttcctttcacaattcaagtcgagagaaagcctgcaacatgcctggtgacaaagcagggaccaatcaaatctgccccagctctgcaccccccttctcctttcctgcccctgccacagaaaccaggccacggctgctcaccacatgtgtctgtgtcagcatcctggtttgcgtggccacagtgctttcacgccaggccctgccgagatgccggggggacagacttgtgagagggccctttgcccttgaattcccaaggaccccaaggattcccagagaccctaggcagaataagatcttgggttccacttggggagaagcagggcaggtagaggccagtttgtgtcaccacaccggcccatctgcccatctgtagaatgggcagccacaccgcccgcccgggagagcaggatgagtcggcacaaacagctgtgtctgggtctggcccagagccggacgcacagcaggtactcagcccccgcccccacccctcacacacctcacagtgtttcactccctctcgtggccacagctttttaagaggctccttttgagccactttttttctttttcaaagctaatgggcaacacattctcccaaagagaaactcagcattttggacggctccagcaatgtacacagtcaaccaaggaatcttcccctagcctggtcttggcggggcaggggattgtctggggtgggggagggggtggcagtggcaagggccgaagaaaacctcagatgttaagtgttatccaattaagctgtcgctaaacaacccaaagaagcgggattgggaggctggggaatgcattctgggagcaagactctcagaacgggtgggggcaccgtgggggactcctgaccgaggggcaccgggccctggctcatagttcagcgaacattctttaccacttcccctggcaccccaaaaagccttctgggtgggagctgcccttcctccctgggtccccaccttgctccagcgctgcccatggcacaccccgccatcccgggggcccgccccccaccgcggcgtcgtctgttacctgacaactgacactggcatccaaagggagcctccgtctgaccctcaccctgagtcccgtcacccgagaccgggcgcgcgctgcagcacggcagggggaggcagggcgggagagcgcccagggcacgcagaggtgaagtgatcacggatgagtgagggtgggaggaggcagctatgggggccaccgctggcagctgggcaggcctgcacggccctggagaaaaaacaatagaaaagactggtcagtcgggccctggactgtgtgaggggcacggggtgggacggggctcggggcgtggggctctgctcaggccacccttcgggggtgggaggcccccggggtgccaggccctgcagggaaggcaatcgggacacaggcgagggaatgggctcggggaggtgggcagggggcactggggagggcccggtttccacagctgccaggctgggctgtcggggaggcaggaccccgcctctgggggcctggtgcagggggctgggtgaacgggggctgtgaggacccactctcaggaaggaccccccacgtgggggcctctggagcaatcaaataggttccatttggggatttgtttccaaaacttcgggctacccctccctggaagagctgggaagctcacagcctcccctgtttgctgtatcaggatgggctgttcctacaggcccgggacaccttgggtccgcctccagccttgggtccgcctccaggtgtctgggctctgttagcctcctgtctggcagaccaccagctgggggctctctccagccccaagcactgagcgtgctgcacccaaaacgcaatgcccttcagaaggctttcacacccccctaccacaccccaagaaaaccctggcgctgctcaccccctcctaacgtctcggcctggcttgggaggcctcccgccatgtgacagcaaggacacagggccagggccggccccgcctctgcccagccccacagctcgctcagctccacagcaaggcctgcatttgatttagccgtttatcttaaatggctaagagaccaccagggcaaaacatttgtgtgaagcccttgccaaaaccacaagtgaagaagcccaaattccctgggtaaataattgagcagggaagcatcagagagacaaaaaggaaacgtcaacaagaggatgggcagctgggcccagccggctttgccagggaggcccagcacaggtctgcacgggtgggagtctgcccactccagggcccccacgtggattcccccatcgcaaggagagccacaggaccctgcaagccaccaggagccaggagcctgtcagtcttcattggactgaacttcctaacacactgacgggaactggggcttagaatacccattgcacagaccaggaaactgatggcgtgactgcagaaaactgcagacatcagcagccccatccaaaccccagctgtctggccccagaaccagggctctttctctgtagccctggtttctctaaaacatgggttatccaggatcaaggcatcagggcatttaagaagaccccctgcttagggattgcaagctgtcagtgtcctgtcaagaggtcaaagctaacaccaacactgctcggaaccccctgaaccaacaaagacctcatactaggtgaggcctcgggcccagggtatttctgagctggggatagccctggaaggatgtggctgaggaaccagtaaacagtttcagcctcagatgctgaggggaaggccatgctagatttagtgccatccctcaaggaaggtcaggacctgcctcctcctggaagcctgccctagcctgaaccttccagcactggacactgcatttgatcctgtccactggtggtctcaaatccctatgtaggccttccctgcagaccaccgagggctctgggtcatccatcatcatgacagccacctcgctcagaaaagatccacattccactgggggaaaactgaggcttagggagatctgagactggaacccagttgtgtccccgaagcccgcaatgctctgcttccctctagggctgcagctgggtaagtgaccaggggtcctgggatctctagagcaacggccacatagtgggcggaagtctgagatccctgggctcaatccagccattggaagctgcaaaggccaaacccaggctctggttcctgggttctgggtgaggccacgacacagccagcaccatttatcactactgagaaaccagcagaagcagctcgaggcctggtaagggttgtcccaggtgctaagaagctgactctgtctccgtggtgggaggaaccgttgcagagcaggtagaaaacaggcatctggccacacccttctcctggaaacgtccaaggtggggctcagaccagggtctgtaaaggcgatgtcacacaccacacgttgttccctgcataggggtcagggggtaggccgccctggacaggtttccccagagtctcattagcaattgtgaccttgctgaagtccacctgctccagggaccggctcaactgaggcaggggaggggggcagccgggagaggggcttcaaatcccaagctctacagggcctctctggggctcccagagcaccttctacactgggagaggtttccacacggggcagctcaaacccagagcccttcccaagggtggaactcaagaaatctgaagctactgcaaaagcccaaagtgatgaaaggagccacctacggcatgactccatggatacgaaatgttcataagaggcaaatccacggacacagaaagtagcagttgccaggggctggggggagccagtaggggtgtgaggggtggctaatgggcacagagtttcttcggggggtgatgaaaatgctcgggacttagacaggagtgacggctgcacgacattgtgaatagatccaaaaccactgattgtacactttaaaatggtcaattgtacatcatgtgactcttacctcaacttgaaaaaacagcctcagtacctgtcccaggctacctcccagcccccatccttcctcagaggaggggtatttgcctttaaaagtgaagctgggaaatccagaaagcacttaaggagcgcttgagatgtgggacagggtatgcacccacacacgcacagaggaagccaccagagctcccaggccgcacagccttgaggaccgagaggactggattcaaattcctcctcggctgtctcctggcctcgtgactgaaggtgagtcactttctcagagcctcagctccctcaactttaaaggaagggtcaggtcagccctgagccagagccggagatccaggaaactcaccaaacggtcactatcattctcttgctttccattctgaaactttccccactccctatggtcctttccaaggcatcatcgctgcccagcgaagaaagcaagaggatgttctctgagcatagcaaagcgccctgcaaagacctgcaagacactcccaaaaaaacgctggctttggaggtctatgcacaaaaaaaaaaaaaaaaaaaaaaaaagtctaaaaataaggcccctaaaatgcctcttcttaggctccaaaacagggcaatgctagataagctcattcttgatgccttcatgggtttaagcattccacaggggtctgtcacccgtctctcttctagagggactttgcagaggctcctgctccgttcctcacacatgcgcactcacccagcgaacacgcccaccgccgaggagcgtggagacacaaaaacgcctggaaaagccccatccgggtttcagggggaattcgagccttccccacccctgaagcctctggggcgtcccctcccaaatgggaggattacagattccatgttcagagctggagagaggtggtctggaatacactgtgcaggagacgagtatttttctccctactggtgcctttcaattgatacatttttttaagctgagaactcctactgatagtgcagaaatgagtcatagatcaaggaaggagacagccagggaggcagcgcgtgtgagtgagggacactggcaagggaacctgacagtccccgcgccccctccccccatgccaagacattaattctcacaagtcggagaaaattactatgcatgaatgcaaaaagcatgatcaggagtaattaacatggcttcatatgcaaattttattaatgcagaagtacaaagtcattatgcaaatgaaacttacgtcaactctcttgacaaatattcatctctgaggctcaagtttctccctttttatttatttatttatttatttttctctcccccctctcttttatcttgggcttcttttttttttcttttttctttttttggtgggggaaggacagcggggggaaggaggtggcgctggtggacgctacagcggtggcagcagcaagccacaaggactgtttgacaagtttgcaaagttgttttccaaccagagaaatttattcttgcattgttgatttttttttcttttttttggttgttggcaggtacaagacagctcataggagaagggggaaaaaattaaaaaaattaaaaaaaagctctgggcagcaggcagccaatcaaaacgccagagcctgtaatgagggcgattgatggctgtttggcttttactgcagggtaatgaactagaatccagtctgaggagggggaaaaatatgaatattcatgagactgtgctcctgcctttgatgattaaagaaatttttaatattcaaataagcgcttgccaagtgattaacaaagaacaagcacgcagaaatatggaaatgggagccgggaaagatttgagaggcgaacgtactgtgcaggaaaggcagcgccaaatttcataaacaagataggcagataacccaattcgcacgcgggcaaataaaaatatttttttctgatcacttaaatattttgccagctactttgtcttaaggatgatagaaaaaaaatgctaagtattaagagcgtgagggggaaaagaaataacgtgaagtcaaatgcctggctcacatttaaaaatcattatcctgatcctagctcatctcctcccaccccaacgggaaattaggattctttttccggtttgctacagagggaagatggaggagaagccagcacagacttgaaactccagtgtgtgagattcaggcctgcctgttctgggtaggcacaggcatgaactgtggtcatctggcacttctaggctggtccagagggaaccctgatgtctagagggcaggggatgtgacgctggagagctcaggcctcctggaggctcaggccctggtctaaacacaaggagaagatggtctttaggagagcagggggcacctcttgagaagctgaaagggctctgatcttcagcacagggcctggcccggggatcttcagggccgtgaggaaaagcgccctccacccatcccaacggctccaagagctgtctgctaagactgcacgctcatattttaacagctccaccatgggttcacattgaagcacataataacagtattagctggtaaaatgatcctgcagttaaaatacatctaattagcagcccatgacatccattttggcaatttcctatttgaaagaagtggagtgcaaccttaaatgagacaggaactgggtgttcacctgacaagactggccttctctcatcatttgtctttctctcaatccctttttttggggggctgtggggggtgtagagggggagtggctgagacagcaggaatagagaagaacaattctagggagacttcttcgtttgctcaatttcagagctacacaggtctttggggttgagggtgactcaaaaaataaattccttcactccacaggtattatttcatttctttttttttctttttttttttttttagcttttaattaccaaggtctaggaaccagcaatgactggaacttgttttccatttcattgtaaaatatataccaacaatcatcatcataaagcagaaagggaaagcaaagcatttaagtgaacacgcaggttaccatgaaaagctgcaagtctagggtgggtccccaaggcaggaccagagagggagtgggtgtgccacgtggctcagctcactgccccagagcatctgggggacctagaaatgccaggcagggcgatggagctccccaggccccacctcccactcctggattctcattctccatcagacaccactgttttgtctgggcacccgatggccattacgggtctctagtcccttgttgccacgggttttggcttgggggtgaacatgtaggtgtccttggaaagaagagcaacgaaaagggaaagtcaggtctcacaagggtttgcacagctgtgtttaaagagttccttcggggtcattacacgggagacataaaaacagttcgaatctacgtttggcctctatgtgggcggctagctgaaagacagcagtccttgcaggtggctgaggagggtaagaattcacatgcaggtgaaagagcctgtccagcatccttcatcaaccatctaggccctaatggatccagagagggtcactgaggagtgccaggctgcaggaagtgaggtgggttcaccaggggcctccaggaacatgggcaactgctcatctttgggttgagaccacttctaccatcacttccacaaacggccatccagagattccccacaggccacccacgaccctgtgtggccaccagggtatccacctgcacccaccgtgagaaggcttggccgtgagggagactagaagcacacctcagggagcaccctgagccaggctgccctactctaagctcctcctcttggagcacttccgaaatctcatcccagaaaatggagaggcagagccaaggaatgatcgcgtcccccaccgacactaccaaaacctttctcctccttccaccagagattggaaagggaacatcctccccagcagctgcctcttgcaatttagaggcaggcacgcttgggcacaccccttccccaggtccaaaagcacctgtttcattgactgccaactccaatttcctcaagatgcaggcagctgaaatactccagggctgctgatcccctttctgcaccctgacccaaggactggtgaagttacatcacaaattccaacaccaaggcccctgtgagggagcagaggacacttcaatgttgatggggaggaagggcatccctcagccatcttctgtgaaccacggaggtggagggggctggccgttccagcccctaagtgggcatttgcagggggtaggggggcgcagtgagggacacgcagcttggactcttcttttgcttgtctctcggggaaaatcctgcagtgttccgaactactgaaatgcaaataaaccacaaacacttgtcctccagccgggacgctgatcattcctttgctcctaggcatcacggcttcaggacacagatacaaaaatgaatataactcctctgggtgacctcaggcaggcagggtccaccaaattggggcccaccatcctggaatgggcaggcctgaggacaacagaaggtgaagccatgtgtcgcactggttagaaaaatgtgtgcatgcacttctattatctataagagaggttctatatacatatacatatgcatgtgcacatacacacacaaacactcatctatcagcaacgtggacatgttaagatgtcttgcgcgcatccaaccagagtccacagagggcaaggacaaattgcaactgagagattctccaaatctcaccagcaaaatcagccagtcaatacctaatggaggaattgccccttttcctctcaatttaggttttctgatcagaggtgtggtagctgcttcaaccttcagcagtctctgttttctaagacaatttaattcaagatccttcagtaattttctctccagttgcgtccagagccacaaacagtatactacatgtcatctgcatgaagaataactcaacgaagagtgaaggcaggctgcaaaccgaagtaaagtgttagataaatcatctggataccaagcataaagaatgtgggacttcgggttgggaccctgtagccctttcccagatggaacttaggggccagactccaatgacaagcttggccaggcatccctcagatatgttcctatttcttcattaatttagagctgggggtgggagtggaaatacacagttaagatagaactcacatgtcacacaaggcaaaaaccaggaaactcatcttcagattgggtgcctacagtgagttttaaactaaggacacctttttctatcccctcagcatccactgtgcctgacctttgaggaatgacccggaaaacactgaatcctgacacgtgttaagaatctggccctccctaaaacatgtttacaaactggggagttcaggaagttgtggttccaaggtcccatgaactccaatgctggcttttgctcaacggccatgtacagacagtgcaatggaataaacagaaggaggaaggctgagctgcgagaatcccggagaattaagaatgaaaataaacagcacagccaataaaaagaacataaagaaaacggagtgcccagcaaggaggttattgggatgactcaagcccgaagcagccagaaaagggaacagaaatttcaggtgcagatggagtcatggatatgaggaatgtaagcatcatcaacctttttaagatcagaccataaaactctacctgagccataagggaacagacaaccacagggccagcagggtttcttgtttcagatggaacagaaataaatttggttagtagaaggttaaaaagaaagaaaaaaggaaagaaagaaaggaagagagagaaaagaaatcaaattgtaaaaaggaggaccctgctatagtttaaatgcacattttgttttgggttgcatttgatagaattataggcaattgatttctactattgtaataaaaaaaatacagctctcccctggattttgtttatgactaaatctcttttctccctttcattttttttccttttcctaatggacttatagaagaccgaggttcagtgctttgcattacataagaacaaaatcttttctatggcctctttatgttcctaagccaagtctgaaatgtcactgactaaaaaattgaacaggcctgtaattactttcaacaaagtagttcctttaactgagttttctgtatgtagatggcatttaatatacatatcgtaagccttcttttcagcacaggtaacatttgatggcaaaaatcacaaattttcttctaagggagctgtctgacagccaccttcttacttattttttgacgtgaaatccgttttcatctcctaacacactagcggtgacgtgcagtgcgtgcacaacaaaatgtgtaaaaattaacacttcgcgggactaatttaataaagattgttagcacattaacgctaggaatattgctccttacgattcatctagccacgcgcgagacgccgctgtaacagaggtttacattcggctgaggtttataccgctatttaatgtaattaaagaaaccggcagcgcagtcctcaatggaaatatcatttctattgcagactattcccattagaaattgggggaaatcatagcacgctgactttgattttgttgtaatttttttttttcctcagctgtctttgaaacagagctgatgtgctggacctcagacagaattgactgcagaaaccctgcaaagatcccgcgataagacaagcctcttctccctacaggagtgcccagtatttatatgccacttacttggttttgaaactgtttttttattattttttttaaatctacagcctctgtttggctgtaattacccaggaagttctctgcccagcaccccatcatgaaatataccccaaaacaacattgtagataagagcccagaggcggggaggcctccggggccactcttacacataaacaatcatagtgtagccaggatcccaacgagctccaattccagatcggggcgagaatctagctgtaatctcagaggaagaaagcagcaagcatcgctcaggaggcctcagagactaaacagacacaaaacccaaaagaaaaagaaaaaaaaaaatcttcgcaccacatcaccaaaatggcagaaaaattaagtcttggggctgagacgaagggaacctgactcagctcctccgcctctgacagctgcctcctgcccttggagcggccaagtgcaaacaaaaatgagacctttcttctctaaacctgcttgctacgtgtccctgtgctgtaggggggacgatgtcgcttttttcccccttccctaagtgcattttaatacccttattctacatcctaatttctttgaaaaaaacatcagtgtcactaaaaaaaacgtcactctgttttgcaaaatccagcagcttccttggcagcgagaaaggctggctggcattatcccctcatttgacaaaactactatttctgggcatgtggtcaaaagcaggtaggaagcaaatgctgagaaataaggaagtaaaaacagccaacagatttttcactaccgaagacgccaagcgtaaacatgatttatttagctgtgtttaacgtgtctgtcctccactcgactacaagcccacttgggtttaaggaaagggtgggtagaaggggacaggaaaaggggagtggggaggacatcagggagagggagcaggggcaggcggcgctgaaggaagactttctgagcggttcggttcagagttttaggagaacaagaatcctctaccccaaaatacatgcatgtgtcaaaagaaggcagcactaatctgctggttaattaacgagctgccactaacaaaagatggaagacccagttcatacagacaatatttacatgggcgttgcatgatcttgtccccctgcttccctaccttttctcgcaaaccatgtgggctgggtacagcgacaggcggagaggcccgtcaggttgggagggttacgagtccagccgtggagaggggaatatcacggccttccttgcccagccttgcatgcccacgtggaatttacttagatctgtattcaattaagaagcaccagacagctcctggctccaagcctgcaccatcgcagactccaggtatctgccgttccccactccagccccagtgccagtgaacaggggctgggtcaaggcccccatggggaaaggagaggaccacactctcccacccctaccccacaactccagcccaaagtcttggcccagccagggtgaacaaaccaaatacataaagaaagcttctgtatttcctaactaacaagactaatccagaggttttggaccctgccagaggttattttatgaaaaatctaattcaagtaatccagcttttgctggaaaaaagaaatcaagacacttccaaagaaaagcaacaaccaaaaagtaaaatggagccccaataggacacttaggccctctggcttccctagtgaaggtaccatttcatagcagacagctgtgtgctccatggggataagtgccaatttttgttagctctgagaggcggtgagaatttcctcactggtccgctttgagttccttcctcaccggcacctagcaagcctgtgcatttaaagactgcttgctgtatgcattcctccctaatccaagtctacatgtcccctgtccagctcctctccttctggggcctgagaccaaatatcaggaaaaaataccttttctagggtattcaggtcaagagcagcagtgacactattcagtatcaagattctgaatcatgtgacagtcccaacaataacaaggagctggggtgggggaacactcctctaaaatgaatggggaagtgggggagtttcctattggtatcaggttactaaattgaaaaaccaagtgcccccctccccacataaacctcctcccaaagcccctaattcttcttccttgcagtaaaaaattacaccctctagaagaggctatttgattcctttcccttttgcaaattagtcaccctgcccccacggactgaacaataacagttctccatttttatgatgtctttgaaatcagcaattgcttcactcctacctatgggtttgttttcatatctggacagggacagggaagtaaacaattggctagccccattttatagatgaagcaactaacagatgaactggtttgccctgggctgtttaggaagtcaatgcattcgagactatccgacaccacatgccaacctctagattctgcggctttaacaacgacacggcccctgacgctccagcaacaacaaatattattgaacctctaagcaggactcaggtgccactctggaagcacccttgtaggaaatcctatacaaaaatctaggcttctcaaagcaataaaattgaagatgcttaacacagcacctccgaaggaggcttctccaggatccctttggctaccaattgcactggtatttcaacatgatccagctgacagaaccccccatttccaggcaaatctcccacacattgctcctaaaaaaaaaaaaaaaaaaaaaaaaaaaaaaaaaagcaaggaaagtgccctacagacacatggcagggctcggaagcacacactgcagggcagcctaccctgccactcaggcgcagaaagtgtgccctgcaaagacgccagagcaccctgggggctaccagttctcctcgaggaagatcctgaacaagagccttccaccacactgtccaagccttagcccaaacatacagggagaaatcacgcgtaattctgatcactgttgagccgtcaaaataaagaaaaggaaaatgaaaagtcagcctctccctcagtgtaccagccaatacttcagccaaccacaggttacctgtctttcaagcaaaacatgaacaattacccccccctcacacacacacacacccctagtctccaaaaatcctaaaatgtacatccctttaaatgaactgcagagacctaggatggggcccgtcaaacacacacacacataattagcgtttcatctttctttctgtaaaggaatccggtaacataaatattaatcaaacacgagaatctgccagttcgttttggaccattatgagtgctggactgtgatctttacccgtatttacagatattcaaaggcggattctatcttgttagacccactgttataaatggacgtctgagaaatcagcgagcaagttcagacagatatgaaaaccttcctgtccaggactggcagtagctttgagctcccaagtgttgaatttgttaccttttccggagggcttgcaaaaaataaattgacaaatgccttcagattcctctaccagaaaagctggctgctcaaagttcgggttagctaaatctgagattttaaaatcaactcttactcaaaacgccatgacggtgccgtttacacaatactcgccttgagagcccagcaagtgtaacatactatttcatattataagtatataggtatacgcatatttttaatactaccttgactcttgttatagcaaatcaattctgcctggtttagatttatttctgaaaaatggaaaatagagatgtgggtccaatcctagcctggaaaagctgtcacagtgaaggtaaacttttaatcggctacaggcgaacagtatacagttttatttccagagtaacagctttgggaaaatgtttgaacattttcttaagagctttgtggtggacaggctgggcgtccaaccactgcttttctgggcctttaagggcctgttgaagtgctttaaacaattggaggccaatttttaacacacaaaactagagactcctagcaaggtgacgatttgcatacaaattcttgttggaagaggttatcctaagagaagtcaggctgaaaggaggactgacattaaatccctgtaattccaggagcttcggtgtcccactccagtggagggttccattcccacacaattgggaaaacacttttgtccttgagaaaagcgggcttactcttctcccactcggaaagaaactaaggtccccacgaaatccccactttgagatggggctgttgcccctggatgatcacatttttgtacaagggaactcccggaggctccttccgtcccggcctcacctggatcccgggaaccgcccgctctgtcccgccaaggtgggctgaggaagacggcgccactcatcagggcaatggcggcgggcggaagagggatccccgtgcgcccccagcacccgggacgaatgccaccccggcgaagcgacccgaccggcgcgcacggtttcggggaggggaccacttccacattccccatgcccgagaaggtcacccacccgggagagcgcccaagggccagagaggaggcgactggtggaggaggggcggccccgtgcgcacaaaggggcccggggccggcaggctccccgcccttgaccttgggtctccgcctccatccatctccgccggctgccagggaagggggctggcccggggccagaggcgtgctcgctgggctgctgctgggctggggaccgacgggggcgggggggaaaggagccgggaaaaaagactccagggctgcagagtgctccgaggaagcctgcattccaccaccttcaggagccggtcccgaggcggctccgattcactgcatgccccccgccccccaaagcaaaagttgcacggatgcacgagggaaaccccttcccaaagctagcccttcgactcgcccaccccccgccttcctcggacccaggccgagtgggggaggggagtgtcaggggaggaagaaaggagcgcgccttcccagcgaggccagacgcgggctgggtcagctgcgcctccgcccgcccctcgccgcccggctcaggcagctgctccattaagcccccgaattatgcatggaccttgagccctctcggccctcccgccccaccaaggcacaatcaacgtgcgcagcgggcgcgggtcaaagagagagggaaggaggtggacgatgggcgcaaggccgtgggcgaatcagaggccggcggccaggcgggggccaggcgcgcccgcaggcctgggaacagtgccgaggagcctcccgacccggccagggccagccgggaaaggggcaccgctcgcaggggaggcccccgcgcagttttgaagttgccaaagtgtccgcgccgtgccgggtgcggggtccgggagatgcagccgcccccgcggagctctgcgcccctggcctcggggaaggccattgtgttctcctgtgtggcaatgaagggggctatggaccccaaccattgagcccttggagggaggggcctgaagacccctcgggcagggcgggggaggctgtcttgcgggcggcggagaggatgggtatgatttgctcgggataggcaccgtcgcggggaggggaggaggccaagcttgaggaggggctgctggagatggaaggaagtgagaggagacttgcaagttgcaaacgtcggggaaaccggaaaattgcagtagcggggaggcaggtggcgcccagaggttcgaaagcagaattgggaggacttcgatgtccacctcgcagacagtgacccaggccccagagggctccgcagcctggagcctcgcgtcccgcctccccgcaacacgctgttttcagcgttccagaccacagcgctgcagtctacgctgccctgacgctggagtgtggaccttgttttgctcctcggggcccgtctgtttctggaaatgacttctttctctctttccccttctccccaaagcaaaggccaggtcaggaaaattatatacttcgttttcccaacaaataaagtcgcctagtttgcagggaaagttttacaagccaatgatgcagagagaagaccacactgtttagctttcttaattggctggctttgaacttgaggtgggaggagaaaagaacccgctccagccccaggaaaacttagttttgctgggtttaccaactccaacagtttttagccagctgctgaaggtggcagggagtcactgaaggtttgtcccattttctcccgaacagagaagaattcagacagttgttgtctctctgagcccaggacagccagtctctgccctcaaaccccaagggaggagcctggaatccctggttggctggctacactctccaggaggtgtgctctaccctgaaaaaggctttgaaataaagccaccttctccactcctttccaggatgcctttggcacctgcagtcatcaggaggtagacgcgtgttttctggacactcttgtggattggacggatggcttcatctgtgccatatcactagaggcacagcctaggcactggggctaccagctcctagggctctgtgcctctggattcatcttcagcagacgctgacccacgcacctgtttgcctgcacctttgaggttgtgtccacacccgcaacctgaaggccatggaagctgcccaggcactcagcccccagggcaggggatggggggaaaacagccctgatcaaacattgccttggcttagagacagagcaggcggtcctgggctggggggctcaccctgcccttggctgctgccttttctccacaccaggagtgggggagtctgacttttcacctccaacaaaaaggctattttgttactatttttccgcccagaggaggctgtggtcccagtttcccagctgtctgagcagcgaggggcagatgctttcccagacctgtggctgatcaagggctccctcctccctccctccctgctctcctctcccaaccctcagcacagactcctcctttctgagacaccccagggccctccagaccaaaaccagcggaccagcaagaaggcgtcaagaaaactcaaaaacaaaataaaatgaagcctcgggtgccttgccttctccagcaaggcctcttcttccctgggtccaactcgaggcttgcaagtcctgatcacaccctcccctgaggaggctcccactccctgtgtgcccagaggtcactggccgcccccagcaggctctgggccagggtgggtccagatcttgcagggcccgaggtttatacaattcagggtacactcatcacaaagaaaagaatgccaaaccacacagggacattagggacagggcctggtcacacaaggggctctgagcttcaactgtttacctcacggtgagtggaccaaattctcccataaggatcttcacagcctggggcagaaagacctaagctttcaatctaacagttttcattttcaccaccagtttcttcagagaaaactgactcctaagcctcattaatgtgaaaaatgaggaaagttgggggaactactgggtgggaaaggaattgaggtgggaaatgcacgaccttctgcctggctcttgcagctgttagaaaccactggtggctccatctcacatttcagcccagcaggctcagccccagagacggggaagatctgtctgctcaaggtcacacagcatgccagccacagtaggatgccatcctaggtctcgagccagagtccactgtgcctgcctctccccactctggactcaacagggccacttgcctgtaactcatgacgaggtgggggccagctcctcccaaaatgcagtcaacatgaaaccacagatgtgtgcaggacaggtgggtgcctactgtcttggttctttcaccccactctggaacccaagtcccatcaccaagattcgacctcagagtggaaatcactcattgcccagccaggagcagaaagggcctgcaccagccacagttcaagaacacaggatcccacgaggcctgggctcctgggacatgacacagtgaagacccagggcctccctgggaagtcaggagcctgtcctctttttttattttaattttaattttaagttctggggtacatgtgcagggtgtgcaggtttgttacatgggtaaacgtgtgccatggtggtttgctgcacctaccaacccatcgcctaggtattaagcccagcatgcattagctatttttcctaatgctctccctcccaggagcctggtctctaggcgcaactgagctggtgactcaccggacaactgtgcaaggtacctctctatgactcagttgcctcatctgcaaaatgaaaggaatacctgatttaccaccctcgtggggcagagaggtggatggaatgtaggcacagttatgaccacagtgaagaacataactgccggagttgacaccctgggaccctactcaccgctgtgtgaccttgggtaaataacttaacatctctgggcttcagtttcctcttctataaagtggggctgatattagcatatcataaggtcatagggaggattacaccagttagtatctgcagagtctttagaatagtgtctggcacacagtaagatctagtaagtatgagttaaatttaacatcaggctgggtgcggtggctcgtgcctgtaatcccaacagtttgggaggccgaggcgggtggatcacctgaatacaggagtttgagaccagcctggccaacatggcaaaaccccatctcactaaaactacaaaaattagccaggcaggcgcctgtaatcccaactactcaggaggctgagacaggagaatcttttttttttttttttttttgagatggaatctccttctgtcgcccaggctggagtacagtggcatgatctcggctcactgcaagctccacctcctgggttcacaccattctcctgcctcagcctcctgagtagctgggactacaggcacccgccaccatgcccagctaattttttgtatttttagtcgagacggagtttcaccgtgttagccaggatggtctcgatcacctgacctcatgatccccccgcctcggcctcccaaagtcctgagattacaggcgtgagcccccgtgcccagcaggagaatctcttgaacctaggaggcagaggttttggtgagctgagatcgcgcccttgcactccagcctgggcgacagcgagactctgtctcaaaaataaataaataaattttacatgaaattaggaaaaactccatctctttgtttcctcagtgaaaagatgaccccaaaggcacagggtgacagccagtcagccttatttctatagattatcagcagagcccactcctaacagattctagacctggtggttaattcattagccaagcatgcaaatgagcaacaaccactcaaaaaagctgtcaaatgcctgattaaaaaaactttagtcaatactaactatttactgtcaaatagacaaactaagaataataatattaactcaggctgaatgttggttaagttcaccccttgggagcccagctgcctttctctctttttcttaccttatctctctctcctgtttcctgaattactgctggaagtatggaactacgtacataaaacaataaataaggcctcaaaccttaagagaaaaaaaaaacacccatttatgtgaccagtattgtctgtcttttttttaatccaataaaactttcaactacaatcggtgctgatgtcaccatgttagcggcacacactcttgactctggtttgcacagttcacatggcaggtgggtccaccgcctccctggaaggccagtgggacaggaagggctcaccccctttctcagctgaggaaactgggactccaccaggggagatggcctcaagctacaggggtgggcaccctgggatggcaaaaagtcacctgtcctgactcgagataattggggtctggactcagctctgccagtaactagttatgtaagttcagacaagtcactgagcaggtgagaagggaagagttggcagcaaggtccttccaggaggctaggaagccagacccttcctctggatcccaccggcaggatctccattatcaacaacagctaaaacccacaggaacctgttctatgtataccttgtctgaatcaaaccttataacaagcccaaaacacaaggaacattatctccagttataggtaccgagacctggggaggcaaacagttggctgacagtcacatagcaagaccctggcaaaaccacaattccacaaaataaaacaaataatttgtatttatgggggaaaagtctatgcaacagtgaatataaaataaaagaaataatcatatgtatgggaaaaaatctaaaattctggcccaggtgcacctgaatttacagtgtacttcattctttgtcaccacccatctctccaatgccctcattaggaagtacaggacagtatatacaaaagccacagactgaaggccatggtccctgggggtctgaggacttctggctgtatccacagggtcatatctgggatgggcttcaaagaccattttggatggggtcagaggtggtgcccgccatcaaggccccaccagccagacagacagagttagaatacccatccccaaaatcctccacaccccttgctatccaaggaaactaggcctgactgagtctgactctgctttgctgtgtgaccttcagcaactcccttaacctctctgagccccagttcaaagtagggttagaaatatatatttcaaggttgaagaattaagtgagataacccaagaaaagcatctagcacaatgaggaataccaggtagcgcccctcttccccaccacccaccagcccagcccaaactctgccctgttcagccatcccaacacccaaaccccagcctgagcccagggccatgtccctcagacagaacactgcactattcctcggtgcagacagaactaataattagctgtcatgatttaataataaaaaaagataatccatgccacaacacacatggatttaacgcatcttaatttgaagggaaaataacaactctaaatagatcaagtgcaagttttttaaggcaacctgcgagtggggtttatctccagtttccagcacaagcaagttatttagtttctctcactagccaagctaatattttttttcacgtttattttatttatttttaaaagtctggagagaacattcccaaagcagcacgtaaatccctgggctcgtcagaagtccttttctctcacacattttgcttagcaatgggtcactggggccccaaaccaaacccttatctgtgccccacctgctaagagaatctcccaggtagatcccgcgtcctccctaggttgtggatgaagacatatcaagtgggcagggacatcgcagccagggctgcctgccacctccaagcccagagggatctgccacctcctgtcacctgctgcctgtctccgcacttctccagaaaactgacattcaggacttggagggttacggaggcaggcctatgagtgacagctgatagttaattcctccctctgtagcttcatttggttatggaagggctgaaaacaggcaaaaccaaattcctggtgatcaagcgcctccccttcagtgactatcaagtgagaattatatggaggaacctgtaggaaatcaccgtgagagagatcccaggtaagtgatcatggttttgaccaagaaaaacacgtactcggcatgctgccaagcagggtccacactttcctgtgtttggctttctagaagcatccacttcttgatcatctgcctcaggcccaaccggtgccaggtgggtgcttcctcatttcatcctcagcataacccaaaaaggaggtgcagacgaggaaacggaggccaagaaaagtgaagtgactcacacaggtggccagcagtgagtgatggggctgggattccacccgggagatgccaaagcctgtgctccctcacctgaaaccccccgccggctcctcagagtgcaccgccagcaaagagatcctcaagggacagtcacctaacaaaaggcagaatggacgggagagagtctactccatgctgacactgcctgtgatggtggatttagtcccacaacccagtggcggtttgtcccaaccctgacaggagcccattgccaagaagaccggtgcaagctgctctaacgcctgaaaatgcggcggaggagggaaagccgagcgccaggaaaagctcctatttgcagcacacctacccccaccgtgtgccaggcactcatcataaatgtcacaatgacagatgaggaaaccgcggctcagaaggtcaagtggctgccggaggctggcagggagcagggtggggctctgactcgggctgtgttctttcccacacagcaacagacagccttcaaaccccaaacaccctgaaagcccctttctcctcacccctcctcaaaacacccctcccagataacggcttggcagcgccacgtgctctttgcaaaacctggaacacctctcagctcccccaaaggatgggtcctgtgctcccctgaactcccacagaggcagggagaatgccacaggcaggaaccttaagaaacataaagaatgtaaacctataggcagcgatgtatcagaggcaccatagctgccctgagtcagaccaccagctaaagaccctgcctctgaccagcttcgccccatccccagagaggcctgaaacaaatttccaaggacctcctccgtccacagcgaatgctcagcagggagtggagccctggatccagaatgcacacgtcaagagcagggctgctgccagctcacactctgcccattatccccatgttggacgcccgctccctcctctgggggctgtttacctggggatccaggtggggacacccagggcggaggatgggccccaggtgctcagttgctgaatgaatgaatgaatgccctccagaaaacaaagcttcagaaacttcctccctctaccttcctacttctctatcatttaccaaaaataaaaaataacagtaattactctccagaatgactatcccgaggaaacagctgatatggggtccccgacctagtgtgatgactgacagaatccccctgcagttctcaccctgggatctcccttaagggtgggaggaacccccttcgggtctgcctctggagtccccacttctagaagcacctggtagcaaggaagagcggggacctgcctgggtatcaggaaggttgctggccctggaaaaggcaggaccctcacagccaccaggaccctcgaggtcacctcaccctggactcctctgagcctggacagccaaagccagaggcagagtccaagaattaacagccacccgctcaccagctactggccggggccagcgaggccctggggacaatagcaggtcatggagggattggaggactccttggagccccggccaggaggcagaagcctggagggacagccggcccgggggccaggagcgtgggcagcagctggacgggtttccggaagcctgggcggagaagtgcccgtgattcctagtccccctcttaaaatataaagactcaattatctctgagcagcttgctttacacatgaattgacacatttattttacaataaataactgaaagttatctgtgtttcctttactgttaatctacacagagaaataataaacagggcttgtctacaaaaatgcaactactgcagtcctcggaattcaattaagctaaaataattaatgctcccaccatattaaattactttatacatttgagccactgaagttttcttctttaatctttcctttttattaaataaaaaaagaaaagttgctgcccaagtaggcagggaaataggaggaatgggaactagaaggcaggcgcatgtgtgctgttaaaatgggatggtcgtcttcagctgacacagcatgtagactgttttgtgcctttgattaaaataacattttaaatgctttgaacaaacatatctctttagacttctaagggattattttacatatttcttctagaatgaagaaatccattcgtcctgttgctgaacagaaaggccaagaatatctttcgtcacacataaaataaagatactgtaggctgctgcagtatcacaacctggaaaaaaaaaaaaaaaaaaaaaaaaaaaaaacaggggggccagggggtggaaggatgaggacaaagctgccttggagattagctttgccttttatgaaatcacatttagtcactttcttaaacaaacctgccacagtgatctgcagcctctcattgggaaatgccttcaatgtgaaatgaggatttggatgtttttggcaaaagcagcaaatctttccatggaaacataaataggcggcccgagtctccctagcaaggccacccctgaaagatcgatgtgcactgaggccaggcgtcgatactacaggtaaaactgtccctggaatgtggaccaacaaagacaaaagggacccagcacctctctcgcctgatggctcagcccggtgaagagacgctgctcaggtgcacatagcactctgagaagccagtgtttacatgccggtggcctggacatgtctcaaagccccttgcatcttggaaagtgtatgagacacttcatgctagggcacccatcagaaggcaaggcccagaggccaatctggttcactgatgtctccccagtgcctggcatgaggctgcaggactctgcataccaccacagtctccccacaaaagagagggctcactaagccccttgtgcaggtgagcaaagtgaggctcagcatcacaaagctttggagacgtgggggagacaggcttgcagcattaccctgactgcgtcctgggtgatgggtcttgatcagtgcccatgcccatccatctcaccctcctagaagcatcgaaagcctgagtccctccagagcccatgctaccttccatgatggaagcatggtaacgatcaatgcactcgtttccccagccagccacctacttgcacaccgcagagccagacgaaacctctgagagagaagtgccacgggcaaaagactgattaagagcccctgctcatctaatcctcacaccaggcctgctgctattatcactttctgttgacagatggggaaactgaggctcggacccatgaagtggctaatccaaagtcaaccatcaggatttgaacactcgtctgcataaactctgatgcccatcttgctccagcacaggctgctgctttttagggaacccaggctggccaggccctcctttctcccccaggcctcctgggctcagaagtataaaccagaaacaaacactctggtttgcacagagagcagcggctccctggaagaggctccagcatgccatggtgctggccaagagggagggacttcatgctaactcactgtggtgagcagacccacgcctggggacagaggggccctagacctgttctcaaggtggtaaaaccagctgtcccagtggtcaaatgagtgagcatgtcaaagggcatatccaacctcccccaacgggcacagtgctccaacaagttcccacacccctgcctgggaccggcccctggggtcgggcaatgtcagaagcaacctctgagatcagggggcctaactcctcatttcacacatgggaaactgagtccagagagaaaggagaggggagagaatgagcactcccattcctaagtgcctaccaggtcatgccgcatgcaacagctcattcgtcctcacagcaaccctaatgaggtgggtttccttagctccatttcacagatgggcaaactaacatgtccaagttgtgaagacaaactctaacccaaaactgtctggcttcaaaatcagggactaagccaagatcagtagcaaagagagggccaaccagacttccaaattttcattctgtgcttctgaccacctctggattagcccccgagacagagtcccctcaccaaaagcaagcagccatcagccatttgggcctccccgagccccaggcctgtctcctcctgaaggtcacctggatggtggaccctcagaaagggggagccccggctggtggcccagaggccatcctggaagcccctgggccttcccctgcaccagcacactcaggcagagggcatgggacccaggaggtggcttccacagcaaccaggcaagcgcagcatcccatacctgcaatgttctcctgcttgggacagatgcctttcgtgggtgagagcaggtggtcatcttcgtcgggggtgacttggatcccgatctccaccggctcggacactttcctgagctcggagcgtgaggagggtggcgggctgtccttgtccagggccttgtcatagcaggcacccaagctgccgccacactgcttccttttgtgctctataaaaaccaggatgtcccccaaggggaagttcatttgacactggccacaggtgagcaggtcagggtcggggccacccaccatcagccccaggccacttggctcctctatctccagaccctcgtcttcttcgaggatggcggcctccacatggtcagcctctgctggagacagaaagaagaaagggaaggggcagagaagatagagatgggcttaggcggtcacagcacccaacttccggtccaccccttccccgccaagaagcagccccctctgctgctggctgccagagctcaccaggtcctccccggggttgggggctggtgagcatcccccacaggacagatgggcacactgaggctctaggagcaacgtcgtgccccctgggcattgccacgtaagtagtgccgatcttactgcattctagtttattttctgccagtttctccccaacgtagtataagaacacacacggacacacgtgcatacacacacaccctggctgctgacagcatgaggtcgtgatgtgtctctcaaagtttccagtatctgagaatcacctggagggtttgaaaaatcccaaggcgcaggcagcacccctgaccagttacactgggaacaaacatcggaatagtctttcagactccccaggtgattccaatgggcagccagggccgagaaccagtgagctggagccctttccccctgctgggctggagccccacccctcccatcccttacaccttcattcatgccctccccattcatgcgaatcccactcacattcctctacctgggacctggccacacaccaaactagaaaacagaaacccagatgggcgtctaagggcccgtccttaggagagaaggaagcccacatgctcagaaagcaacaagtgagtgtcaggttccaaaaaaatatcttaggagaaagcactgcagcagaagggaggctggaaccggcttgcagagtcgggaagcaggctctcctgccaagcacccgaggcccggtcagacttccatttctctgtagatttcccccacactcatcaactccccactgtccttttctgtttgttgattttattttcactcccagaaaaatgaaagaaagaaaattctccagactccaaaagcatttcttggaagatatcaaaccacactttcaatggactgtatgtttttatatttctttagcagccgatagatttctcttgggttttttttgtgggggagagagtagggagcctaggacccaaatatttggaagctaataaatgcctcaaaaagcagcaacctcctcaagggaaaattggaagactcggcagccaaaagtgtcataaataaagagaagtggacagtgtggaggtttcatattcccctcggggtctgagcaaattcgggctggaatttttcgagagcaaatgtcagtagtcgtagagaagacacgagtggcggggtcttcagggaagccagagggcagccaaaggtctgaaacccgaggaggcaggtaaattttaagttgtatggtatttagggaaggataatgaaaaccacagaggaacggcgagaaggaatgggagggaggaaaatacattccgtggcagtgaagttattgaagtgccagagccaaagaacagataatttaaggaaaaaattctgtggcatctcccatcctacacataaatcactgttctctattttctgaacacgagcctatgcagggcctaggagagtccatgtgtgaaactgaatacagaatatacgacgatgtaagacgtacaacgcgcacgtatgaactatgtgtgaataggtagcgacgtaggtatcgctgagaagagaaactacaatttgagatcccacctgtggttacagaaaagcagacagagccctcgatgaattaaatgcagaatgcatcagaaatgtggcagtacagaaacgccccgcagacgaggaaatcctaaatctgttgtctgcatctctctaagaaaaagaacctacaaggtaaagaaacagtcctcacaaagccggtcccagaaaccattaattacactttagaaagaaataggagtttacttaaaaatgggtttgaagacaatgccacgtaattaatttaccaatttattttatgaaaagatgctttgctatggttaaaatgtaatcacaaccttcccaccgaacagaggttctagggaagactggattcctgtgaacggtttgtcagaatgtaaaaggtaattatttggtgcctctttttccctttaatgatctaacattgagcaatactgtttatattgaaaagctcgcacctttaattaccaattacatatacataatttcagagccaaaggagagcactgtaaaaacagttctttagaaatataaggatgtattgtgcgccatttttacagaaggtgctctaataaatgggaggaggatgtcaaaatattgttttgttaaaaaatagagagagaggcacaaaagaaatgagctgaaaagcaaaaaaggacataatgaaattgagaattcaaaggaaacaggggcgaggtgcggtacctggtactattttaaataccaccctgtccaggcctggcaaactcctgcatcagtggaagatttgataaaaacgtacaacgacaaatccacatggccagctggaccgtcctttctgagggcgaagaggtcttcttggtttttttaatttaatcttcggtttacttttttgtttgcttttttattaactttttcagcctcgtccgccctcctgagtaggagttctagcaagcctaaatatctcctctctgctaggaggttttcaactacataatttcaaactcattttctaattcaaaagaaacacagatgaatttaaaaattagcagaggtcacacgtgcctgttcgcaagcacccctcctcctcagcttcgtcttttgccaagactatgtaccagcactttttcctttctctcctcttttttttatttttttatttttggtaacatctggtattctttcctttttttggcagtctctgccttttcactttcctcatgcagcagccctgcgagcccccgtaattgagtttgaaggtgtccaaagccgtttgctgtgctgcagctctgatttctgcgtcaagtcctaacagccaaccaacctgggagccaggccctgttggcgtccccgagacagccccgggattatccaggcctccagggctcagttctgagctgggatctccacgtcccagaccagagatccaactcactgcctctaagggagtctgggaggaaaagaaacaaacaaaaaatatctccttcccctcccactttcagcgttgaaagttaaacccctgagatgacagggtgttcacccgattccaaagaacggggtttcctctccccaccacccaggctgtggcgctgtgccttggcctgctgtgtgcgacacttcccaggaaggtagcaaggtcaccctcaacatcaggcagcagagtcacccccagccccaaatttctgggtcagagtaagtggaccaagtgggcctgaaagctcacgttcaaggcctttgtagacacccccaaagactgtggtttcacttccgctggcaggcagataccaagctaggcgtgtagggtgcctgcatatgtgtgcatgtgtccctccttagaactgtatcgataatggaagaaataaaaggagaaagccaagccctgggaagggcaaagtgacacccctctttctctgccctatggacacctgagtctcccggctctgcacagcctcagagagccaggcctctgttctaacaggcagagtggtccaacctgccacccagagacgaaaaagcaccaggaaaaagaccaatgaaaacagtctttcaaattcccagaccctacaggccagcccctcatgcagccttgtccagcaaactcgggccttaaaaaaataaagccaagatgaggttttcctctgagatgatctctgctttcatgaaaagctccccaagtgtcgggcagccctgcagaatattgctgctctcaatatattatgagccgaataaagtagagcaattgctgaaatgtttgactcattaagaggaaaaatgaatggatgcagcagacaacttgttcgaaaggcagatatcagagggctgaggcggattctgaaatgctaaatcctaaagtgcagggacaaatctgtatttacacacacacacacacaaacacacgagttagattttcttttacaacaaaaccacattttatttacaaggccaggcctcctcccagctggtaaatgcatttagaagcaatcacaaataataatggacatcgttgttaagtgaaaggggaagcacttgatcccaagacaaacttccccatgcctcggctttgctgggaaggaatttgagtcagaagaaagaaatggaaagacatcgttaacacaggcccagccaagcagccaacaagcccccagcagctgcaagctttcagcagggccttacctggccagtgactcccccacacacagggtgccaaggaccccgccctccctggcccatctctaacaactgcccatgcacctgcccttaggggaactccagccgagaggtctgctgcctgctgtccccagagcacaggcatgtgcgtggctgcctgcacacacacatgtgcattgctacatacacagtacgtgggctgctgctcctccttaccctgcattaattcaaatccaactctcttatctttaatggctaagctacagtccaggagaaacatacacagaattattgtttcagtgatgacgggggtgggaaagggaaggatgtggggggatgggtcccaggctcttaaaatcgtgtgccaccaacgtcacaaccgccatcatgatgtgtacgcatgtttacaagaaatgttcagcatccatccgcccgagctctgcatccgactggagactttacacctgcttcctacgaagagggagctcttgccagcgagcccatgcttacccataatctacgaagagatcttttcatctcctctccgtgaacacttggggaggggctgggactccaggcgacacggaaacgccaccacacgcacactcgacggagcacaacactttctgagctgccatccatttttaatttattggatccaagagaaaataacaaccgtagggaggggggaggagaagggtggagggggagagagcaggaatcaattcttggtggagaaaataatctatgactagatgacgcttaaaggcacgacaagagattttatgaagttcccctaacggagggaataatgaagtgcctggcagagaaggaaatggagataagagggaggctggtgtcaggaggatgtccacagggggtctcgaagggttattaggacacaagttgggggtggggaccctgggaaggcacagccaggcggagtctgaagcaggaagcaagacccagatcacacctctctgtcctgaccctcgaccctctcagcagacagtcagaggagtccagcctgctccaggtcagctctgcaccctcctgacaccctccaaaggctgcctccctggagggacagatacataccacagccaccaccccatgaggtcctgtctgcccctcctcagctgaggcacacacctcgatcgccgtttctgacatgtgagagggagagcaagggaaggcggccggtgcaaaacatgcttcccagtgtgggcttcccaggaaaatgaccagggtcccgctgactccgccagcagcggaaactttgggcctggcctgcaggccaggaggtggaaactccagatccgtgaagaggttttagatgcaggaagaggctcactcccataccttctggtctacagactccaggcgggaaagtcgaatgtttggggagggtctccctgtgtacagattgtttgcaggactccagcctaattttaggatgcttaagcagctccctgaaaaatatcctcagttgctctatggagtccaaccgccttctctcccccactgcacacacctctccagaaccccaaaaactgagcccaggagtctgggtctccccagcacaagagcagaaaaaagaataatgcacacacctctccagaaccccaaaaactgagcccaggagcctgggtctccccagcacaagagcagaaaaaagaacaagtgaataaggaaaacatactcaggtatattcacaggtctcagccattactaaaaggttacaaataaaagtcttgacaaataaaataggcgctttaaagaaaaagaaaaggaaaagatttaccacaatagcaatccttctcaacacatttagcaggttctataaaactgcaaatgccttcaatcttcagagccacaacgggctcctaacgatgtgataaaaaagcactctttgtgggcaaatgaagagatttgtttttatttaacattatgcttttttcaaaggtgcggaagaaaagaagggcttccacacaggacactggacctcaaggctttagctggaggagtttggattatctgaggccaacagcaaatagcaagggcaggagtgctttcgacatctcttttccaaggtaggaatttaaacatgacaccgcccccccccttttttttaattcttagcagtgcatccatttctgaggcacatgttaatcacaataatattggcactcaacttttcttgagtcatttctgcgtgttgttttagtagaaaactcattagaacatttcacaaatgtatttatttgtatttcaataaaataagtggaagggggccataaaaaagaagttatgtaaaagagaggattttttttttctttttttactttgaagtgacttaattttgtgtggtctgggatttcattacagtaaaatagctcaggctggctattcaacacccaagcaaattatcagctgccacaagaaaaagaaaaaagaatgaatttcttgattttcagcaactgcacaaaagactagcatatgtcaaaatgctggaccaacatcccgtgaatgtggcaccattcatcaagcctccatctagtgtcacttttgccagcaaaaaacaaggctgctctgctcaccctcctcactggcttgtgcagaagacgcaagaaatgtgtccttctctttccacgcgtctccaaatagcctgctctcggcactttttacccacgccctgggaaacatacttgctcaagggaggcagtcagcacacggcgtttcttggggagggatggagcaagagggggaccgagcctgagcacatctccctgacatttggctccctgggaccggaaggaagctgagtgggatcagggagtagggacaggacagagcacacaggacctcaggccaaatggcctgagtcaaaagagtgccgcacaggacctcaggccaaatggcctgagtcaaaagagtgccgcaaagtgacaaagcatactcacggcagctggatgacacagacattcattcctagtgtcttctgtacccttccccattaataaatacaaaagtgtatctacagctaacaccgtcttcagagaaagatgctcagccggtatcaataactcaaccatgtggtgcagggtacagtccccaaagaccatttactttctccttgtcctccccagatgtgaagccaacattaacctcgaggccaaagtctttggagagtttcagctaaaggtgaggcctaaccaggcagccagaaggtccatccttaagccatgggagatgaaggagagtctccaacggacaagaacctgaccccctcccattccctcccccatatattttttcctgcattgtcttatctatgatctgtgtttagttacagcttgtgaaactcccctgagttctaaggcaaaggattggagattgctaaactgatttttaacggttttctgcagctcagagaccaccgtccggcccaagacttcgaggtcaccgtgcctcttcatctctgagtggtccagtgagctcgctgccactacatgcttacaactggctcgattcaaacattaaatgaagtagagaaatcatcagataaattgctggccctgtgtactggagagtgaaggctctttctccagctgacgacagcgctaggcttttgtctgacctaatttatttctctttcaggttagaataaagcactctttcctgtcgcagggtaacctcttctgctcatatattgaactctagcataagactcagggtgcagtctgcagatttcttcaacttgggaaagaagacattataaatctagaaatcctatgatcaaaagcacatatattccccatcactagattacatgtttaggggagaaatcctctcattaaaagccatccataaaggacaactgtttggggtgaaagatgtgatcaagactggctctagcaatcacatactctttccaaacaaagttttacatgttatttgagtcggcattttaaatctttggggaacggtgctatttcccttagttcagtgggaacattacctaataaatggaattgagaatccaagtgtcataaaatttgagctaaaaggatttccattcatcaagctgttttaggtacacgactcccaaaagcagcaactctcgactgttccctgggtctgtgacatgcaagacagaaatgagcagtacgccttccccagacctccccagcccgatcaccagcgccttaataacgcagcagaattttcagaacgtcaagaccacggacgaatcagggaaaacacacccattcaaaactcacaattttaattgttaaaaaagaaagaaagaaaatcaaagaaaaagaaaatgcccccatctgccaagtgagggcttgtaaatcaatggcgatagcttgaaaatagatttctcaaacttatattctcattttgtcctgcacgaatctctgctggaaaatcaatattacaacttcacacttaaggtattttgcagcaacgtaaactgccgccgctgctgatggaagcccgttcctagcccattgtagcggaggcgccaagccatgacacgggcaccgagctccccctagctgccaagtggcgctaggcgcggctcggcgtttcagcttgccatcaaccaaaagccaattcaactgaaagtttattttggaaagtattttatcacaacaagcaacagagaatgcaaagcaatcgagataggagatgaaaaggggataagtgaaggctggtgcaagccgtgttctaagctataagacagtgccaagaactccattctgagaaggcgctagaaactggtatctgtaaacgactgttttctgtgcttccgtctcacctgagacacaattctaattattctcaaatgcacccaaagttgggcttcccttgggttgagtaggacccacttagccctccacactggtcactgacacaacacacccaaccagctaacccagcctcgatgtctctaaggccggcttcacaaaagcaactgcattcaccccagcacttcagaaatgcctagttttctgttatgaaatatttcaaaggccagacaaaaaatcgccaaggccaagcacaggcagatagcaacctccccatcaaaaaaaaagaaaagaaaagaaaagaaaagaaatatgcatatgtacatcatatcattcaggtagggaaaaaagaccctttaaaaatattaggggctgttaaaatatgctcacggctgttttctctcaggtgtgaattacaaatgaataaaatcagcctggcataacacctttggtgaacacgtttttattctcccattgaatcagagcagctgacttatatcacacttctaatgatatggggttcccttctgtgcagaagggagaggaacttcaccccccccccaccaactaaccaaaaaaaaaaaaagagggctatgtcttatgaaatttatcggaggcccaattctgaaagacatgtggaccactggagatatactctaccctggggagttaagataattgtgagcaccgctgccttcaaaacacacagctacagcaaaacctaattcaaaaggtaaccatggaattaacacagttagcctaacttttgcattgaatcttgcttgggtctctagttgttttacaaaatcgtgaattcatacggaaaattactaatcttcctaggaaacctgttggtgggttgttgagaaaatcaccttgactggggttacgcagtttaccgtggacatcttattttccttggtctcttcagaaagcatcaagctccttcttggatttaagtactcttcccttcaccctggccctgtctggcacagcgggctctggccctttcctctgcgtggtcagccgatcccccttaacctcccctcggcacgattgccactgtgttgttttgtgtttgtttttttattaatagctgtgtctgtcctctgcttttaaaagccatatccatctgggtcaaacattttgaagcaaaccagaagcccaggtttccatcaccagctgtctctcactcttttttacctcactcctcttgtccctggccctgtctgtaaatttaactagctcattatggagcccttctcagacgctccctcccccctctcccctccccaccgccacccacccacaaagaccatgcgtgctatttgtgtgccctcttgtttcccaggccatcagttatttgcagttgcatcatccctgaaggacctgaggttgctgccccacaggcccaggagctgccacccaactgataaagatgtaccatgttttaaggggtatctttggaatttaaaatctaaaatgtgaactccaagtagaggatgcgacagcacccgctttgccagccagggctccaaagcaccctgagtccacggctcctgcatcatttgtggagaggcacttccagaggccagagaggctaaagtgcaccccattcctgcctttcccctgcttgctctcccacctccctcccaggtgacacaggacagacgaaaagccagctgcttttggataataaatagccttgtctgaaaactggttggaccactctcctagcttaaacctgtacacatagcctgggctccgtgtgcccctcaaaggcaggccggctttcctttgccctctggtctccttcccctttttctctccacctctcttctcctttgcctctctctttttccctccctgccactgctccagtgtcagctggctttccccagcgtggctctgagcagggctgagcgagacagggaacaaatgaaggatgggaaagtgctgcaccaggcacccctcacccccatgcccagctgccaccagtcctctggccagggctctcgcctgatgtcccaggaatgccaggagaaggagagccaaagcaaagcgaacctacctgcttcttccccttacacacaactgcaaccactcctggctcgccgctgctgccagcttggcagtgcacccccatccactcccccttccccgacccccccaattccccctcctcaaaaacaacccttgcaattatacagaggctacgtggggcaaattgcctcctggagaaattaagcctctgcaagtatagacgttttaacaaccaccccatctaaagggggaagggtgtagaataagcgattgctgtggcttggtaaaggatcgaaatgtcaactggcaaaaaagaccttgatcaaaccaagctcaaatctagctgcaaaacattttgttttaaacgcagccggcgagtcttctttggtgttacaacggcgaaaaataaaagagaagtcctcttcccttcctccaaagaggcatccctctcccaaggcgaatcccactttaatttctattcccccccccccaaaaaaaatcataataaatccacaaattcttactaatgtatctgctgtaacaaaggagagatggcaacagcaattgctccgagcagatggctcctatgctgggttttcaggggaggggagaaccactttatatatttatttatttatttaaattttttaaaatataacataaatattcggctctcggccgcccggcagccagtcctctgcggtgactgggcgcgcagccctctcgagctccgcgcgggcagcccggccccagcccggcgaggtgcgcggcggattgcaagcatataacctgcccgcggtctcgatggcacccagaggatgttttatttctattgcagttaaaaaaaaaaaaaaaaaaaaaaaaaaaaaaaaaaaggaacggcgacccaggcaccgcgagagaaagaacggcggggaaatgttcgcgcgcagcgaagaagccgccccgcgggctgcggcgggcggggagcgccgcaaagccaccttcccggtgcaagtgtgcggggactcggggcgggttcccctgcaaacaccgtacctggcccgctcgcgctcgcttttcccctctgctaaataaacccaacagggacggtggaagctgctgcttgtcttgccccgctgcctgactttgcccgcccagccacatgcttgaaatcgacacgatttcagccggtggatttccactgcgacctgccttgtttatttagataggaaagatgaaagatactgagatagaaagatggatacgagattgatgggtctcctttttttcttttttttcttttactattttacaagcgcatcactctcttcccactcctaactgacaacctttttttttttcctcgtggcggggatttttcaccaaccccaatccccccaccttttttgaagtgggggaaagaagacaagatcatcccaggagacagacggaggtggggaagtggggggtggggaggggggcttgagcccggcaaacagccgcgcagctggattattttgcaaatagcaggaggaggggagagaaaggcggctgcggaatcctaggactggcgcggccggcaccctgctgggccgggcgcagggaccggggacccggagccggcggccgcccctggccctacggctcccccagccggaacgcaccccgctctcctccgcccgcgccgtcagcgcggacccacgcgctcgccaacttttccccacttcccggctccccctccccctccgctcccccagccccctccccctcctctccaaaccccgccaccagcgccgccgccgccacacacgccgctcggaggggcgagcgtccagccgggctcggcgcgcacacacacacactcctccagcctgcatgccccctccccggcccggagccggctccgcaggcccccgagcccgaggcgcgtccggctgctcggcgccccaactccccgggctgcaaagaaactttcctatggcccccgccccccgccatgctccaggccgacgccgtagactctgccagccagcgggcggccccggcgcctggccaggctcggctgttccgggctcggtgtccccagccccagacgcccggagccccatctccggcccctcgcgcgcactccgcagacacttacgggtgatgagctccctctgggacaagtgctgcgggttgccctgtttgcggcgggacattgccccggcatctattctggcatcgcccggagagctgcactgatggggggagccgggggagggggtccgagccgccgccgcgccgctgccgccgctgccgccgccgccgccgccgccgcacctcctcctctgcccgggttggtgttttttttcccttcctctctttccctctcttcctcctcttcttcttctttattttgctctttcttctatgctgttttttgttttgtttgcaaaaagaaaaaaaagggaagaaaagcaagaaaa

SEQ ID NO: 2343 - DNA, 102198 bp, Homo sapiens; identical to SEQ ID NO: 2342
  source 1..102198: mol_type = genomic DNA

SEQ ID NO: 2344 - DNA, 196035 bp, Homo sapiens
  source 1..196035: mol_type = genomic DNA
cagtatctcacactgtactttatttttcttcacaatattaactagacagacaaggaaagtttaatggcaatgtgactttttccaacaacacaaacaaagtgccattatagctaatggtggccaactggagacttactttaccttaaccatgtaaagtatccttaccgtattttttatgtgtacagtgttgcagaatatcagccacctcttaaaagtatcaatcttaaaaagagccatggaaggtaaaagtatgaaaatcttgataacaaaagctttcaatacaaaaacacttattgtacacttatttttatttaaaacaaaaataaccccagtaactcaaaacaaaagcaaaccttggttgaaaacttaagaaggtataataaacaaaaccaccaaaagaaagcttccccaaaagaaatgcaatccactgtcactcttgcaaattctaccttggagggaaaaacttaatgaaatgagctatctggagggcccacggcagattttccaaaaggtttaggtgcatggatttactcagtatctacactacagtcttatttattaatagtctcagaattttcttgattgagcgagcctttccatcctccaccagtgttcccatcttctgtgctcagcttggtatgcagaacaaccttgttgttgataggatgtttgcttgaagttatttttctggggcagtccagatgaaccggtacagtaccattcatgctccatctgattttctttgcatccagtgagatgcatatttcatgattgtccaaggtcatggttgtccaaagacatggaacagaatgattcactgggtaagactaaaggacttgtattatcactctccaattcagtttcacattgcttaattttataaaatttttttctgtattgtacataataaacatttagaaacagatgtccctaccaaccagaaggttgtcattaaatatcctgttagttaaaactgcacatttattgtttaaatacccattagacatatccagcttgaaatttataccattgcactgccaaacggagctgcactttgagccatgctgatgtctctggaatctaaaggtcgtaccacaaacttcaaaatgtttctcatttgtcacacaaggttcttcgcagaggcatcacatcgaccccaatacaggtccttcatacccttagttctggttattctgaaaacttccaactccctgatccaaacttgggaatgttttacatttaaaaattcttcctccctcccacccctccaacaaatgtcctttgtcccataataatttaaaaaaaaaatccctgaaagatccaaattgaataacaataaagatctgattggaaccttcataagcttgacaatgtagaattgtatttcttaaaaagtgtgtaaccacatttgtctgggctgcaaaagacaccacagaataagatcagaatagaatttcaactgactccctaatttccttagaatggcttgtatttcgagcctttcctgtttttctctgatagagtaggtgtacattactaactataagtgataagaaagtctaaaaacagccactgccttaaaagtacagttggaattaattagagtttaagttcacatttataaactatttgttttaggataagttcaattacaaatagagactatttgcaattctgttcactcaatagatcctggaggtgaaagctagacatgtgttgggattgccctgattatttacatttaatcttgattattataactcctctcgatttataatcacttcctaatttttcccactgggccagagctacatctttagatgataagcatttactaataaaacaaagatcacatataaatggaaggccacatctgaacacagagaggtaagtgagctgtggagagaatgttggcgtcttgtttgaactaaattgaggtgcttccttaattctgtgactttattccaaatcttaagcctgccagagttttctgcccctgccaaatcttcggagacgacccgatggccatagaccctgtcagctgtcattctggcctctcttgcggagtatttgtgcagcgagggactgggagggccgaggaggttctcagatgttcttctccttttggggctttttttagagcccttgtccccaatttggaaagtgcatatactctatttaactctgaccctggccagtgtaaagaggagtacatacagaggactgttttttcattcataaagagcagttaagatgcagatgtgaatccctcttcaatacaaaatagggatggttctctgttgcccaactgcaaaataattagatataatgaaaaaaaagaagaggagaaaaaaatgactagttgaggcttttatatacattcattgcttctaacatgtttttaacaataaggaaaatgcaacatcaactactcttagagcaagtgcagccacaatactgtacagttctggggccaagaggctgggcacatttactgttattaaaaccaggtaacaaaaccccacagcaaaaggcagccagccagcaattagcccccgtgacctcttaatatatatacatttttcaaatactctgtgaatcccgtttgaacaacaacaaaagacaaaacaggctttatattaaaaacgtccacgttcttcattgttacttctaaagcagcttggaggatcttaccacgtggagcatactgcaaactgactccattaaaatgattttggcaggatagcagcacaggattggatattccatattcatcactttgacaatgtaaacctttcataaaataatattttgcttaaaaattagaatcattcaaaggtctgatcattctgttccctgaggcccgccggggaggtctggcttcataccacaggtttcctgctttcttggtggagcgtaagcaccactgcatttcaggaagaccctgaaggacagccatgagaaagcccccgcggaaggagggcaggagggctctgggtgggtctgtgttgaaacaggccacgtaaagcaactctctaaaggtcaaaccaccatagatttgaatctgctggtcatttgccatctggatttttaactgaatgaatctcatgggtttaaccaaacatgcatgtaatcctgaataccatgaattaaatgcggaattgcccagggacgaggaaaccttcaagaaacaaggtcaaagggacaacagatataactgtcacaataaacaattctgttgacgtggaaatgcacatgacttggttgaaacaaagctcctcagtggccagtgacatccaggtttttcttaggtagctgagactcagggcttatctcaccttctcagaatgcttttgaagaatcaagagataaaaatctcaaacagaaaacgatcacctttgctcacaaatagtgtataggccataactaaatacaattaaaaacaaaaaaacgctgagatgcatgtatttttttaaagcagctttcgaaatatcaaccacagcattaaacattgaacagagtacattccaaagttaatacagataaatggtatataatgcaataatgccacagagttattccatcaatgtttcaaggctgattctaaactggaagaaaaaaaaatttcctagtttatttgctgaagatgtcacttcttttgttacttctttatagttccccaccattgattttttttttaatgccccaggatgtacagataacccccatattccacacctggaactttttttttgtcaggttttcaaataaaaccaaactacagtgacaagataatgttttacatgtaattccatagacaggggtcaattaatccatgacacctcacttcaatgcttcttttaggatttgtgaccctctccaaagtcatttaaagccttgctttaaactcacaggtgggccaaggccacacagccaacgtgccatgtgctacagccaaaatgggccgtggccattgcctctcctcacgttcccagccttcaccatgtccttctgataggaagggcccagggcctctgttccttccctctacagtgatacatgtcttaagaagggtcgtggctcccatgctccacgtgaaaacgggcctacctggagggccccagggtgacaggcccagccacacccctctactgctctttcttgacagtggaattctgagctccatcagcttccagacattcggagaccacactgccctgttgatcatccctggaggaggccagtgagggccccggctcagttccaggaccaggcctccaagctgggacacaggcaggttctgcggacttcggtctcctaaaagcaggcacttgtggcggcctgatgctctgggtaactctagccttcctgatgcggaagtcaccgaaatgttcacttcctcaagttccagaggattctgtttcttactcagacagagccagtattgggagttggggggtgcgtatccaaaatatatgaatatacacaatcagggcttaaggtactggatgatattgtataaattgctaaaatgcttttctcggcacaattggtagcttaaaaaaatactttcctatgatttaagggcatttttcccatcgctgtccttcggcgtggaaatctcagtgggtactaggtccatctgaagttcccaactcttttcctcccaccaggtatgcatcatgtgagtcatatgcaaagagtctcttcttcaggccagggaggcatggacttccccccacaggaaccctccctctgttaatatcacagcccccagggcaaagaaatgcaagtgaatgaacaccttctccccagcctccagcagccagaaagccagcttccccaatgatcaggtcctttttccatccgtctgctcttcagatggtgatccggccaacaacatggaaagcgaatctatgtttacaggcacagaacatccaggtggagccacacgaagcggtgcttggcaattagtggtcggatttccaaagacaggagttttgatgggactgtcttaaataaataaatctttttttcttaataatgtaaaaaataaatgatatttccctttggcagtaaatagctgattcgacgttttgcctgaagactgttaattgttgtgtgtgtgtgtgtctgtctgtgtgtgtgatgtttatatgtgtgttattttttcttaaacagcctgcagctttgtttcatggtacatcactgacaatgcatattatttctactgctttagtgaaccttttgcatatttgtttggggcaggcatgttgacttcacttgtggcccagataggcacccagggtgatgcaagctcccaccagggccaaactgagcagagtcttcagagacagccaggagaaatcaaacagaggccgcatgctggggccgtacagttccacaaaggcatcctgcagttgggggagaggagggaagaaaaagaaagagtattagagagagagcagagaatgccaccccacagagaaagaggcatcctgccagggcagcctgggcaccttcagaagggtgagaggggaaaaggcaaatgctctttggaggccatgattcagaaaccactgttttcattaattcaaggcatatttattgagaccctctttacgtgccagccatcttagagatacagcagtgcataaaatagactaaaagttcctacttcacgaagcttccattgagtggaacagtatagacagcaatcaatataaattatcacatggtgtaggagagagtgctaagggccgaggagaaaaacagcagaggcagttagaaaatattagaggttttgcaattttagctagcatgcccatccataaaagtaataaaatctagcaatgatgatgaccgtcacactcctcgattgagtgttgacatcttatcaaatgtctgacatgcattattttagtctttgtaccaaactttttctttctttttttttttttagagacaagagtcttgctctgttgcccaggctgcagtgcagtggtgcaatcatgacccactgcagcctcgaactgttggactcaagagtgatcctcctgcctccgcctcctgagtacctaggattaccatgcttggctaatttttaaattttttgtagagatagggtcttactatactttccaggctggtcttgaactcctgggctcaagtgagtctcctgcctcagcctcccaaagttctgggattaaaggcatgcgctttctcatccagctaattctttgtaccaatcttatgaagttattttatttgtttctgttctgaagatgaaaaagctgagaatcgcagggaataagagactttttaacaagtggcagagccaggctttgaacccagatagaaaccagcacccttctctctgctgatgccctggcgtggctaacggcagctctatgagagcatttggtcagtcaagggctcagtcagtggaggggccaagggcggccttgactggtgcagtgccaacctctaaggtcaaggttctcctggggaaagggagctgtcagggggtttctcttgggggtggctagactggacgaccacaactctgcatttactcaaattgtggatctcacaaggcaggagatcaggggtgtgtcactggatgtgcaggtccctgagagacaaaaagtgtctcccttccattcctatctctccatctcaagtcgggtctgtagtgtgttgtagcaaagtctaccctctggatgggcttggattgagcaaatcaccaattgctcatttcctagattttggggagattatgtttcacatttgggtccaatgagtatttggacaactttctgaatgaatatttgaatatataaatcagtaaatgaattctttttacttctgatttattcaggatgaagaagaaaacaagaatagtttcacattattcccaacaaccctgactcaaagcacacagttttattacaggaaacagtaacataccatgaccctggacatcgctgttgggaggggctccaacagtgcacagaggggttccctttctctggggcaagggctgtagcagtgggaccagggattctctttgtctccctcatgctgggcatggttgtggtgcactataggtgcgtagtaaatgtttgttcacttaagctttctgaatacaatcattggtctttggcttaatgctttacccaaatgcttatgaatctgtttgaaattactccttctatatgtaacagcctctgagaatcctgaggtagtcttgatgaggatttaaagcattgttagggtaactttccacattattaaatatagatttatacaattattttcatgatatataaaatgtgccatactttaaaaaattcatgtttatagtgtttaaaacttttgctattataaacaatatcatgatatatttttgtatataaattcttgtctatttgttcagttgcttttttgaaacaaactcctagaagtgacctcagttaaccagtcatcaatattgcttccagacatcatgaagggcttgccttgagccatcctcacattctcatggattgccctccaaccaatgccaccttttacaaaaggcaggcaagaatttagggcgagggtcacactgagagtgatcctgtcccccaggggacatttggcaatgtttggaagcatttttagtggtcatgatttggggtgagggtgctactggtatctagtgggcagaggccgcggatgctgttcaacatcccacaatgcacagggcagccccccaatgctaacagggccgaggctgagaaactctggtttataagatgctctgtaatcacagaccatagaagaacagatgacccatcctgtgtgtcaacagcattggtcaaatcagcacaatcagctagcccagaccagcgactgctaacccagtgggccttctgcatctttggaggtccttggttaacttttaccaggagagggcgcaagggctttcttcttctttttaaatatctattgttaaacatttctaaatttcagtgttagaaaagcgaggcaatagacgtacataaaatgtgtgtttagtgctcttagcacagagctaaggcacaatcatgattgtctgccaagatgcacacccctctccatataagcagggatcagtggggcaggaaggagtcaggacttctccacaagccagaactctgcctcttccagggagcaacccaagacatcacagacacggctgcaaatgtcaactagtcctcccatccatgcttctctctctgagggatgggtaggctgaaacccccaatagcccagccaaaagacaccccaaatttgtcagggcactggcaataggttgtctgcaatttggcttgacattgagaaggtcagtggccgggctctgaatccctttagtaatcaacagagttttgtgtggcaaaatctgaaccagactaagcccctgatcatttgtcctgtctggacctgaagccatcctgggaaaccggaggatgcagggacatactccagctggcattttctcccagttggtctggcacacagtgctggagagcagaagaaatgctgtcccaaatatccccacctcctcagagctggaataattccctctcaccaccctcacccccacacaaataacagtgcttctcatgaacctaacaggccatttctgatatgcattacgtagaacaatgtcatttctagagtgagatgagctaaactagcagctcttggcccaaagcctcagcatagagatgctgttgccatcccagggggctgagaagggcatgggacttggaggaggagtgtgggtgaaccctggctttgatattttattagtttataaccttcagcagataacccagccccgagcctcatttacttcatccatagccataaaattcattattgtgaagattaacgtaggtcactcaaagccatttgtaaattggatacagaaagtgagctcgtggcagaacaaacaccttgctcttgtctgtcctcttgcagacctgctccgcacctactcaacctgcccttcccccaagaagttctgctgagcctgccgttttgcagaagcaatttcctctcttagctttctgatctgaggatagtccgtaatttctataggaattatgaattaaaatgtatacatcccgtgttctggtcaaagatgggaagtgataatacaatgcctacctatctgtccttctttacacattattagagtgtagggctagagggcaagtcatttaaccccctggaggttggagctggcctctaaactttgcccttctacaattccaaagtgcaaaggagaccctgcggcttcgggactaaaatgacctgaaagcttctttcgtagaaagtcttcctgatttttcaaacatcctgattggggcgatttccgaagtctgtttgaacagtctgtcattatttgtttgagtttgaaagctgttttaaataaacacatgctcattttatgtattaaaagcaacaaagagggaaaaagaaaacctgggtcgtcatgtgattcggacaaaatcccagtctatatatttaggaagctctgtgtcccttgctcatgtcaggactggcaagggcttacccgacttcacggatcacaggttcacacggaaaggctggcaccggctcctcctatgaggaggagatgggcagggcctcagctctggtggctctgtccacagtggcttccccataaatttccaattcagaggccacagaggatctgagttccacccagggctggcccaaggggacaggatggctaaactcccagccgcagccttgctgcaggtttggaaccaggccaggtaggtgtggacgggaacagaccagggtcaagactcctaaactcagcaaaggtgtcctcacccctccgggccatggagcactcccacctgggaggcagccatcctccaacattttccttttccgttcagaaccttcaagaatttttttttttttttttttttgagatggagccactgtcactcaggctggagtgcagtggctcccaggttcaagcaattcttctgcctcagcctcccgtgtaactgggactacaggtaccctctactacgcccggctaatttttgtatttttagtagagaaagggtttcatgttggccaggctggattcaaactcctggcctcaagtgatcctcccaccttggcctcccaaagtgctgggattacaggcatgagccaccacccctggtccacttcgagaaatttcacgtaaacctaaaatgagaattttttttaaaaaaggtcagattgtcaagaatggaagagaaggttaattctaagtgctgaaaagaatggcatgcggttggggatatgggcgggggtcccaaaataacccttatgcccaggtaaaggtaaacatggagaccttttgaatttggtaatgcatatcaaaaggcttttaaaaagcttttgttagtaatttcacttccagttatttattttggaaaaataataaagtgcacagattatgtataatagcataaacctggaaacaaatgtctgaaaatagatgactgacagcgcgtccacatgatggagtgctgttcagcattaaaagtcataccctatagttattggcaagaaattgtgttcctaaggtcatattgagtaaagcaggacaaaacggtcagcaaaacacgattccacttctgtaaaaacctaacatatacatgtgcgcgtttacaaacagaaaaaaataatataaaggaaaacgcaaagatgttaacagtgattatcgttgaaggcagaagtaggcatgaggacatggcatttaagaggctattctgatttttttccttagctgtcttttctaattcaatacaaacatgtatattactatttatgaaatatatttcaatatatactacatagaataatgttacattctaagtgcttacttaatctgaaaaaaatccagactccataatttgacagacaaaaatgctgggagatgatgtctagtagtggggagacatgggctcccaggcagcagccatgacctagaaccatgcaacaggcccccggttaagtgagggcctccttagaccctggcccagaagaactctcatgagctctgcccctcagaccaatgcctgcaataagaggttcaggccccgagctcagtgtgtgttctcagctctctatatactggggaaatttaatatggcttggctggctataagcaaattcgaaattcagctacattccacagtctttgagctgactatgcatgcagacgttatacaatcgaagggaattctaagggagaaaagccaccctgtccccaaagagcttacactctagagagaggtaatgcctctatgtgcacatttgaactaaactaaatcaatgggtgccgccattttgttcctgcagactgcagagtctcatcggcagtaagaagaaagtaaaaagaaaatcagaccatgccaatgggaaatcaaacacagctatcgaatgactttgatattttctatttttcatgagtttataattttgtctccatggggacctctggggatctcttctctcatgacaactttagggttaggaagaaaaaaggaaagggagaatcactgtaacagaaaactctgggctggaaggaacctcaaagtatgttcagattccctgaattggtttaataatgtctaataaagatattagctctttttttaaataggtgaggtgagtgaaactttgacaggtaaagcaaattccttacagtgtgtattcataaggaaattcgtggtggacaggagcgtgaaggctgggtttcacctgcctcctgcatgtcactggttagaatgctggcaagcagctggttcttctctctacccagggaacctcctccctgcctccctcaacttgcttcctcccatcccgaccttcctctctgccccaacttggactccagcccaaaacaagtctcatctgggcttccaagtggtgctgaagaaagttacccaaccttgcaggcaggtgctgctggaaattcatggtctctaaactcagtgagttctgacaccacctagcaattctttattctttgtcagatcttttctgttccttttgatgactgttcccaacagccaccacttgtctcacacatcttcctcaccttttggcagtgaacactgccttttacttctctgagaaaactgggatcattgggcaagaattaccacagctttccaccctggcccatgcacaaatgtccatttctgcctgtccttccctgctcctctccacacttcaccctgattccaccatctcccattgcttcaggaaccttcctccgtcaattgtccctgctctcaattacaatttcaatcgcatccttcctttctgacctcaggtatcctcaaaatgtctgtgctgatgcgtgctccaccctaaccattatcttctctgtctctgccctcctagaaaagctgccaagccacactcattggctcacttcccacccacatttgaacccattcagtctggcttcttcctatactgtgcctctgaaaccacccccacagagaccaccaataccctccatgtggctaaattcactgggtgtgaggttgtatcttagtaggtgctctgatgccccggacaccaagaccactgagggtcttccgtgactctgctccctttgggctacctccttcctcctgaagaatttcctctctgtctccctcaggggcacctcctccctggcctattctgataagttctcgatgctgcccatcaggcttctgtctggacattttcttttctctctttgaccaatctctttcactctcttggtcttatataccacccctatgataatgttcctaacatctttatatccagtctcactttctcccctaactggcaaatacttattccaattgctttctaagacatcccctagggagttcgatcaacctgccccaaactcaagctatcatcactccctccatcaagcctccctctcttcctgtcttcaacctggctatggcatcaagtaaacctacagcctcagagtctcctagatgtttttctcttcctcatgccccatattcattcaacagtaaatcccatggccataggttagactcccttagaaacagaccctaagacaaagatttgagtgcaagtggtttatttgggagatgatgctaggaactctaaggggagcagggaagggagagaaaaaaaggaaaagactcatgcatgagttacctcatcaagcaagttattgctaccggcaaacagagcttactcctgccagggaaatctgagggccggtgtagaccatgcatctcttgttaacccactgagggactagggagctggggtatttatacaccaactcctgctattcattggttgaaggttgctcctatggaatgtcaataccccagcactcctagctggccatgtcacaggtgaagtaccaatcaaggaaatagatacagatgccacatctcttatagctggaggtgaagttagtgagcactgaagtggtaaaggccaggggacaggacagaacagggcagtagatgcactgccaattttaccacctgaacacttctctctccctttaccttctctccccaggatcactgctgtgatttccagtctgatctctctgcctctgtctgagtcttgtgctttgcctgtaaatctcttctgtgtactgcagccagagtgatccattcagaatcaaatctgttgcttccatgcttaagtctaaggttcccaatgctctggctccaacctagttctcctgctcagcttgtcactcttaagtcaactttggttcattcagagattcagctcaatcattttctgcaagcaactttctccaaatccctaggttgagctaaataatcctcggctgttccctgttcacagtattatacgaagatcatctgtttacatgtctgccttccccattcaactattagcacctggaggtgcaggaccatgttttatttatctttggatccctggagcatgtgtctgtcatacgttaggaactcagcaaatgtttgtggagctgaaacaaactgatttgttttactatatggcagatttttcaaacatcctaatagataatatttttttaaaaggggagtattcagagaccaaataaaggactggcttagataaaattcagtgctttttttttctttcagcagcagcctctagtgtcctcctcccagggactgatggttagccggttcccaaggacacagagggatctgactggtcagtgtccctgctatattggttagtaaatattatcacccccactcacaggtgcttgattctccaagaaagggagtagcattttccaaactcatttggcccctaacccctctgtcaaggagactgctgctatgtttggagtattaggaagacaaactttgacaagtgctgcctaagagggtgaaaggacaatagcagggcattggcaagaggggcagcattggtgcctgtggtgcagggcaggggagacgaccagaggtcaaaggctgtttctagacatctatgcaaacgtagagaccactgggtatgtcctgatcctagattccaccaagagggctggagactcattggcaatactatctgtgactactgcggccacacagaatctatgacatgcaaccgtcaggtgagagagaacgccaggagaaagagaaaggacatgaaggaggaagtggggtagacagacacttgtcttgcagaaagagcgctccatgaagccaagcaagattctcctgacaccagagttggctcagagcaagagggggagcaagccgcactggcggctgggagtggtggccggcagagcacacgcaaggaagtgaggacttttttctacctgaataaagcagctggtgaggaagtgactccatttccccccttatcatcggctcggcaggatttcctccacagccacattgtgctgaatgagtctagagggttccgtctgcagagcagtgtggctttggcagctgcatgcttgcttctgtcccctgtgactcttcctcccgcaccctccctttactcccaaaatattgtttccgggtttgggggaaaaggaaagggaaaaaaataacccttgagcatataactgaaggacacacagctgcctgggccggagatggtgaagaggcacgggagcgtgagaagcacaaggatttgccttcctccaggctggcgaaggctgctccccaaagccatctccagtgcctgggggttgatcttggaggaactctgggtccagggggaggggctggttgaaacatgggccaatgacattcgtgaaacctaatctccatgtcatttggatgtaacaagaaacctgctggagacatggcaggagatgaaaaacccaaacaaaacaaaaacaaaacttgcccgcttaccacagttggtccagggaagttctggtgtgttctgttatgcaaatttagctaagaatgcaaatcaggcaggggccctcaggagctggggaggctgaaaaatgagaagcccaaatgggtgcttcctttctctggcattattttcacagtttgaaaataatgtgcaaagatggcttatgccatgggccagggcagaggaagcttggccccaaccacctgctaatggagacttcagccggagctggctattccagagatggacctcagaggattccttagtctaattaccttctgggctggggtagaagatggtgtctggagggaagcacagaaccaagttccctactgccgcactagctatgcaaatactgcagggcacctgtgggctcatgtccctcctgcaagaaggtgtggtcagtccagtaattcaaaagacgtacttctgaaataggtggagaaatgcatttatagcaaaaagtgctaaaaatatgttaatagttatgctatttggttcaccaggttagtgtaataaaccataacaagagagactaaaggccgtatctatatgaccttgaaatctcatcttcagcgggcttattcattcagtaaccaaactatttttgtaaggtgctgagtatttagcttaaagctaaataagacacatgccctgccctatagtaactgcttggtaatattcccagtggcttccatgggcctgataattttcttagtactgaattcaaagcactttgtgtcttgtctgcaggcccatttgcccagcagtggccttgccaggagagaacaggcccatgctcctgtcctcattttaaggcacacctgaagaggccctaaagaaagggcctatatacacacaggcctcagtcacctgctttccagtgttttggctttaaaacgaagtttcttcatttttcttcctaccttcctcattccattaccttcttttggctagagcttccgagggccctgcctgttgtggtgctcagccctctcttgttttgggcttatgctatttcactgtttcggggggaagtatcaagcataaagtgacaaacttaacacttttatgatattgtgttggacatgaaaatatgtccagcaaaaaacttaattattataactcaacaataaaaacgtaagtagctaaattttaaaaaaggccaaaggattctggtagacattttaccagtgaaggtacacaaatggccagtaagtgcatgaagagatgcttcactatcattagtcattagggaaatgcaaatcgaaaccacaaggagagatcacatccactagagtggctctaattttaaaaatagataataacaagtgttggcaaggatgttgagaaattgaaacccctgcacatgactggtgggaatgtaaactggtgcagccattgtgggaaaacagtttgctgattcctcaaagagttaaacagagtcaccacatgacccagcaattcaactcctagtacacccaaaggaattgaaattgcacgttcacacgaaaacttgtacacaaatgttcacatcagcattattcataatagccaaaagtggaaatgacccaaatatccactaactgatgaacaaataaacaaaatgtggtctacccacataatggaatcttacaactcagccaaaaaaaggagcgaagcattgacacatgcaacaacatggatgaccctcaaaaacatgaggccaagtgaaggatccaggcacaaaggccacccactgtctatgagtccattgacatgcaatgtccaaaataggcaaggccatcaagacaaaaagtggattagaggttcccaggagatggggagacggggagactagggagtcattgctaatgggtacagggcttctttttggagtgatggaaaagttctggaattagctaagggtgatggctgtataaccttttgaatatgctaaaaaccaatgcgctgatcactttaaatggaattttatggcacgtgaactatatcccaataaaagagcttaattatgttccttacacgacatgaagagggactaaactatttttataccatatggaattccacagaagtactggcttgtgatggatcctcggctcacaagtgtaatgaggaatgagacgctgctggttagaaaatgtgcaccactgtcattctccaaaagaaaaaaaggaagaactgtagtaggaggtggcatggtttgtgttctggatgagaagttaggggtcggatgcatgagcagcaatcggggcactcctacttgtaaggtgagcagctcacttcacccctgggaccttcaattttcctcatctgaaaactccgccgtagcgaacctctaagaagtctctctccgctctaccatctgggcttacctagttagtgaccttattcttcaccctttctcgtgcatccttgaggatgtgacttgggttctgttggtgcgtgccagagctgtgttactgtaactattgcagaggatctcctgcttcctctctgtgtggtccatctcttccatccgccacttctccactgctcttctccccacctggcctcagaccctcctgctgtgagttaggaggaggcctttcttggcacagcactgaagctgtgacctctgatgtgcctctgtgcttccaatctctttgcttttatgagcataatccaagttatttgtcccagaccccaacccccatatgcccacaaagccctctgcctctcatgccagttttaattagaactggtgacatcagtgtggcttaaagtagggagcaggtgggaagctctgattatattcaataccgaacaggactctccactgcctgacaggggctggggattccacaggcagactggcgtttggaatagatccaccaactcttttttcttgggatctggagccacacatgtggctctcctccccaccccacgccactgtccatacctgtctccgtatgtgagtagaacataatcactgtgtgctccacagggattggcgacaggcaaatatgctctacttgtcggtcatgatttgggccaagcgtgccgtggctcctgtacctgccatgtgactcgtgaacacggggcatggcccaggctgcctccctctatttttgtcactgcaagagttaattcatgaaaatacgccaaaaatgggaactgaaagcagatgcttgttaagttctgcagcttggcctaatcgctgtcatcaggacatcgctgctgggggcagtgaggggagggagtccttcatttattaaacgtggagggccagagttaggggccaaatgtttggttttcacttgtttaaatcagtaagtgttgactgaggctggtggtgtggggagtacaaagaacctgcatgtcctaataggaatttgctgaaagtggcctcagacctggaggagggtatgtagaagaaaaagagcaaagcagactaggctggaggatgcggcatcctcagccagctgggcactgccagcctccagccctgccttgtctggcacttgctttttgggactggttaagaaatcagcctgggcatcttttctggaagctccacactgcattagctccagggagccctgatgacctaccgcaggcccagacatctgtcgaggaccagatgcaccccggatggtgctggttctgttgttcttggtttggggcaggtaagtcacaaatggctgaaacttcacagcctgcttacatcccactcaaaagcaccccaacgtataatagtcttactcagatcccagctccccagttctgcagctcaatgggtcattctgtgaccgtcaaagtgactgcgatgatcctctgagaagcccatgggagaggcttcttatccacaccatcaatctaccgatcaggaagagaagaacaattacatcctctgtgctctgggggacaaggggagctgacggatggtggtgaactcctcagtgagctccatatgggcatgctaagaaaaatctgctttcattttgtagtttatgatttagttcagttcacctggaaagactcaacatgaataaaaccagatgcatttcaaggaacactgcttggctctttgacaatcctcttccttcctcatcagacagtcttcctgtgcccagggaagacagcagacctctctatcacaaggaaaatgcagtctctgtcagtggcagcagctgttagtaccaggacaggtaaatggtgggccaggtcagcctgtggttctggatcctggctcattaacatatggacaagatacgctggcgtggcctctcatctgaatagctgtttacggcgaaggacctctgacagtatgctttctgttgcaagaaggatactgctgtatatagaactagagagagaagcaaaaacagaaactcagagagagaaacgggagacccagagacccagaaagacaaagagaaagagaaaaagagaagctgaaagcaatcatggatgagttttaagtgagtggaggggctgaaatatcttccatcagcacaacctacaggggcacagttgacagctggctgacctgacccaaggacacgctctcacagtgaagccagtgaagctggcctcctgggggcaggagcaaggtcagaacactacacgtgcccactgtacaaggcctgtcagcattgtcagcagtgggcacttaacacgagaaaagtcgtgcccctgggagatccacttccaaggcaactgtcacttcccgtcaaacgctcaggaccggtcagacacttttgcagcttgcagcggcgagcctgggggaccctgcctgcagaagggatgcaagtatgtgctggctgcattgcaaatggaatttgaactgtgctacggggcctttatacaccgactattcctcaggcaaaaatggcagagccagaatattccaggtgggactggcagctgagtggtcagtggccatgcctatgcatgtgtagcactggcagaaccttgctgccattgcagaaaccttggagcgagttggctcaggttgcattcagggatgcaaacatttactgaccgcctgagttgcacacagcattgtgcagagtgctgcaggggagatagtgagcttgactccatgacaatgagctccttaaggcaggacatcatgctcatcacccaaatcaggtactcagtaaacgctcttccaatgggatgactcagagatatgcacacctaaggtcgtaggaataagctcaagtttgggctggtgaaggcttcaagagaaattttaggtcaagcaaattgctatttccactgaggaaaccccttggccaatcttggatccacaggcaacatgtttttcatagtataattggcgctaactttggatagctcgttttagctctttctttcctctagctttgatctatcttttggacatatctgaatcgagcaatccaaccataggcaaaccactttaaaaagtatttatttagcatctacttctggctaggcactaaatctgggatgacaagagatatttaactgtggtgccaaagcccattaaggtggcttttacaaacaactctagacagaagagactgccatcagaaaggtcacacaacttgctcaaagtcactcagctcattgcagcaaagccggggttcgaatccaggactatatgactgccaggcatgtaccttttcaactatattttgcttctcccaaaggaagcagaaaagacatacaagatccaactccggctcccccggagcaataaatatgagaggctaaacaggaagtcccgaggagtgacagggaacgctcaagaaatgtaccaagagtgtttaagatgggctggaaggcggacagaaagtgagacaggagctgaggcctcaggacttcaaataaaagcaagaaaaccaaggatggtgtttcagggcaaggaagtggcatgggagtttggggccaccctggtgggtcctaaagcaagccggtgtatgccgtcaggggtgagtcagagcgaatggggccacatcaacagaaagaagaccctgtgaccatggagaaaccaccagtcacaggaccttccccatcacccccgcccccgccgccctgggcactgtgcaaggctggatcccacgggaacgtgtgcggcacactctggaagcccttgactgtggtctggccctgttgctagggctgcacgtgccatctcaagagtattttaaaatgttgtatgatatagactcaaatccccaaagagaaattctttccatattattcaggaaaagccctcctatttacagggctgcttcacagggaattctagaatgtgaaagagaacaaaatttccttgagtcacaaaaacaaatccaacttgaggcctaatttagaatattaaaatatgtggccccagagcttccacagtggcaactggattttgatcctttcaagtgatcagctcaactattcttgctggaccaaaagtggttgtgtctgcaacgtgcatgaacaagagtggctccacaccacggacagagcataagccctcaaagaagagacccagggggatacagggggcttccctggccactcgccccactgcccaagagatccagggggtgggggggcttctctgggccgctcgccccactgccccgtcacctgcttcttgcatggtctctctcctcctggaggcacccctcgtgactcctcatgactggaaacagcttttctctactcacatttaaaaaatcttcataatttaacaaaggcagatacctttaaattcctaggaacctacctgccaagtgttttacaagaacctagctctgctcaccaagcatttaatcctttaatgttcgatgtgttactggaaggccagaagtttgcaaggcaagtttgtgattgttgcagtcagacccaacaagccaaacactttctttcagcattttggcagttgcatgctgagagggaatgtgttcagtgcaacatctctaatacaccaaattaaagatgaacaaacaaaaaagcagaatcacagcatccttcatgcacagtgactataagctcagctctgtcctcagcacacaggatgcccaagaccctgctctgtggggtagctgaacagcgaggagttggtgggagacaaaaaatggctggacacggcccaggtccccaagatcccccaaacctctctcccctgccttcactataacccagacaggactcccgtcctatctcccaaatcccttttccctgccaaaattccctttatttttttctccttcactttgtcctttgctttcctgttccctccttgtcttgcattttatcagctgaagttcattcctcagctccgatccccacaacccgttctccatttgcctgttgtagtctaggacagaaaactcagagcctgaatttcctggaagacactaattccccactccctcagatacataaagaaattaagtgttggccgagtgaaacaagtgagacttctgcagccgcagccagggcttggccatagctgcgagggaccttccagcccgcctcctggcagaaggacgctggtcgtggacactgatggggaaatggcggctgtccctgagccccccaagaaatggagcgaggtaactagaggcagtgtggttaccatttgaccgtggaagtctgacaggacgccaggcctgcgatccacgctggagtcagccagaggcccgctctacaagcctcctttaacccttgaggagttaaatgctggcattgtggttatgggacaactggagagggatttgtgttggataaaggagcagaataaaaacgtctaaatttcatcttttctttgtgtgttttcacctctgccaaattcttggaattcttatgtcttacaattttatgtgcttttcatttccgtttgaaccagaaacatcatttaaatgtctttggaggtaatcctaacctactgaaacaccccgagaaactgtgaaaaaagtattaggatcacgcctggtgggttttaagaaatttttgatccccaggcataagttcatggttgatggaatatagattcaaacaggtatgttttactaacttggtacaccacctgaagaaagtgattttattaagggtaactttaaatgcgaaaaaaataatttcactgccatcatgtctacaataccttttggcgagaaaacaagaattcggagcttttaatgtttggcaatggaacacatcctttggaggggaggagtcccaggagagctcaacccctggctctgaagctcatcatgttatcctagatttataaccggataagctggtctgttctgatgtcttggttctatcacaagccacacaatggcaagctgtggggtctgagtgtcgacgcaccctttctcagttcctccacttgtggtccagggattcacctttccaggctttgagagcctcatttgtaacaggaagagatgccccatggtcctctaaaggtccttggtgacactcaagtgacatcacttttagattctgggactccgttttatgtttgtgcatcaaaagcagggaggatgaaaagggtttgatacagttggggcactgggagaaacaggtgcctgcagccctgctggcttgcattcaaagtcgcaatgtgccatcacatttattaccggtgcaaatagaggcttgaatcctagaggggattttactagaagaagccgggacgtgacctgccgtaatatagaagctaggaatgttcttgatattctagacatcaaaagaaacacaagccaaaatcttcatggcaccagacattagaatcccaggcagggtttgtaaagtcccaactatttctgcttaagaatctacccaagagatactccgacagctcaaatggcatgaaaaacatattccaataacactgagatgattttatgaaaaattaagggatgtcttctctggatgtgtcctacttctcagccataaacaatatccattatttatggtaacttttgatgataagttaataccccaaccaaaggagtttatggttttcatccctattcctcgggcaatggaaccatacatcactcaagattacagtgttattccctttggatgcccccaggagatatttcttgtatctcctagaataccctcttgaaccaaaagtttccacatttaagtcttttctcagaatgtttcattctccatgcccgacccctccctgcttggaaaatgcagagaaaatccatcagtcatttttgggttatcagactgtgacaaatttgtttttcaagcttcagaagattgttgaactgcgcttccccgctcccccccatttcagataactcaaaactggtttggatccgtgacatcaaccttggcatgtatgaagaacgaggaatgaggactttgccttgtttggaaccaaaagagaagaatatccattttctctctctctctcttttccatttttattaagtcagtattttttccttttagccagatgatgtatacttttaacattccaggaaaaaagtgtcagtgatatgcgagtcataataaaagaaaatcaaaagaaatgcaattacaagggacagggaactgtatcatttttaatataaaatgcccagatgaaaatctaatttaaaaaattaccagcaccatataaatgagaaaagaatataagaaaacatttgttattttaaaaattagcttaatccttaatctttctggctcttggactttcaactttatttttaaaggccaaaaatggtctttcggtgctggatcaggagtaaacctctcaatgatgcaatgagatactgtgaagtggcaacgaatttccctggcctctggcctgctgcctggaatgtagtaggaaaaaaaaaaaaagttgttaaataaaaacagtgaacaaacaggatgaaataataaccttctcattctccttattatagaggtatctattacaaacaaaaacaaatattcacatggcacgctgttgttgagaaagtgcttccatatagatcatctagtgtggtcctcccaacaagccacagataagttattactgctgtcacccctcttttagagatgaccaagaatacgtaacttttccaaggacacctagttaatcaattatgaaaccagaactcaaacccagaattctgacataaaatatcctgcctttccactcaatcacgcggcctccctaaatgtagctatgactcccagctaaacgggcctgcccagagccacgaagtcataagtgtgcatggagcagcgacgtgcttatgctgacacctctgtctctttgataacgtttacattatgagaaaagaatcaagctcatttatgtcagcagtccacaacctttttggcaccagggacgtgttttgtggaggacaatttttccacgaatggggtgggggatcatttcaggatgaaactgttccaacacagatcatcaggcattcggttcccataaggagcacacaacctagatcccttgtgggcacagttcacaatagggtttgcactcctaggaaaacctaatgtcgccactgatctgacaggagccggagctcaggcagtgatgctcgccagctgctcacctcctgctgtgcggccctgttcctaacaggccacagacccataccggtcccgggctatatgtataagttgcaactgttggctggtgccagacgactttcgcttgttctgtctctgtttctcttctagcccagggagatgtcattctgttaccctcaacccatgtgaggggaagctggaactattcacgtatttacagggagagtccgaataatcatgcagtaacccagccttcctttcaaactctttgcttgatgtaatcgccaattttcatttcaggcctgaaaaataacactgttatgacagtgaccggcagatgattaacagtgaagaagagaggagatgtcactaataatattgatttttaaccctttctctagtttttgtttggaacaaacacagtgcttaattatatggctctctacagaaagggttctcctgacatgaggcatttatttatttatttatttatttatttatttatttatttatttattttgagacagcgtctccctctgtcagttacccaggctggagtgcagtggtgcgatctcggctcactgcagcctctgcctcccaggttcaagcaattctcctgcctcagtcttcccgaatggctgggattacaggcacccaccgccatgcctggctaatttttgtagtttttttgtagaattggggtttcaccatgttggccaggctggcctgaaactcctgacctcaagtgatcctcctgactcagcctcccatagtgctgggattacaggcgtgagccaccgcgcccagcctgacatgaggcttttaggtacagaaagagaagtttcctttgtccagatgcaattttcccctattttgcttgggtcagcctgaaaacgaaagaaagagagtgacctggtggcaagatggctaaggtttctctcttcttcagcaacacccagctgaagagtggacaccagtgaatgcactctgctcctatcttcaatactgtgggcccaggagggctgaaagaaaagcagaaaaatcactttcctgcccaacgggcattgtgatggttttttttcttttattgctaacgtacgtcttctcttgtttttctttccctctgcgtctgaggttgccattccccactttctctccgcattttcttggctccctccagttttctctggagtgacttttccctttctctgtgaaaccatcacttctatgtattttccgtgtcccatgaacatgccacaagttctagaattagactctgctcagccttcccgtgagctgttttagtctgatattccagcagtctccaggtaggaaaaaagaagtcgatttaaatatgaattcctataaggctgaagctaagctaacacattctggagaccttgtggcagaaaaatgtccagaaatattggactataacataagatttgatgcttaagaatgagttatcaggtttgggggtgagaaggggtattaggtctccaacctccactgggctactcctgtcatatttttcctagcaagacaggcaacactcctcaaaggttactaagctgcgcctccaccaagaaggaaaatgggactcctttcaccttgagctctctttgtaccttcagcaaatgacttctgaagtcatcttgatctcctcttctataatgcaatcaggggcattccctgcttctctgtcatctctctaattactgaaagaaattttcccccttcttgtgtttttttctataattagcctcatagattggtcaaattcgtctgtccagatttccccccaaaattcccttctccacactgactgcggtgaccctaagctacttttttgcctatggccgggctacctcccctaacaccaatctaccctgcaactgactaacatctaacccagcagaaattactgggcatctgtaacatgactggcatgatcaaaaccctggggtggattcaagagaaaaatgcaactactcctttccttctatgaggtcaggagcaagcaatacaagcaagaatgtcctggtggcagaaggggtggccatgacggttcagagaagggcgagttcactcaggcaaggggggcgataatagatggggggcgataacagatgaggggctgggggcgaggggaggggacagcataggctacagggggaggataaatgtgtgcatagggaatgctaatggcttggcccgactttgtgggtttcaaaacaaaatctcatggaaaagataatttaaatgaaaatcggagcttattaattttctgtaggcccagcccaatttctcatagttctcagtcatgttggtacatgctagtttccgtggcagcctaagataaagctcttaatgcgatgtgagtcccttagagattagcactattataaatataaatgctcaaacacaagcaagttgaaaccaaatgccccccaaacactggctttctgttatatgaaggtttccagtggtgcactgaacccttggataaatgagctagaaaacagagagttaaatgggctcattggctaaatctcatggccgggctccttcatgggagggaagaaggaaacttagtagctgctccttacctatttaatctatagcagttggcaggacagttttggaggacaatcagagaaatgccctcagaacttcgagtaggggattgagcagggcatccaagaccctgatcaaaacagagggtctttactcaaagccaacctgcaaaacaccttcttgttctcactgctttgtatgacttccaagagactcactaacaactagtcataaatagacatcaaggagtttgtttatctaactaagagaaaacaatgtttgagttctttagaaacatgcatttgacaccacaccaatgtgctgctctgggagcagaatcggagcctgcttccttggggctggtgttttgatgtggtcattatttgctcagcagagcctctacttggcaacacctcgtttgcccaattctaggtatttgaaattttaaaaacatatctcttttaagaaaattctaaaatgaaagagtttttttaaaaattaattcgtaaataccttccccaaagttattctaaaatgcctgagactttaaagaaccatatctaagtcaagtctggtgagggcaaacagacatgacaatgaccaaatctattctttaattttctaacatttgtgtacaaagccaaacaatcaacatacatacagagtgctactcctaaatcttcttgctactaaaaaataaagggccaaccaagtattcccaggaggcaaaacaatagcttatcatgtgcttgtcctcagtgcctactagagcctccttttctcctggaagacataatgacttgggctgggtgaaattgtacaccacctatgagagcaggatgctgggttgatcaggtgataatgcttcaccatatcttcaatttttgtattttccacctatttgataatgggtccttcagcggagactacaagacgtgagtatacccacataacttcagctcagatttctgacggcgtccaacttgcttgcacgaatatccactgcctgcccactctctctcatctgagaaaactatttgactcagcttttgcctctgcctcccacttttcaccctctccagaatgctcacagctcacccatgctagtagcattggagaggaaagagcacacacattagagtcagacagatctgtgcttgaacctcaactctgcaaattactagattcgtcaatgagttgaatgagttatcagttctcctctcgttctctgcaatgcttaaatctaactcatgttagatgagttatttaacctccctgagcctaaatttatgaattcataaaacagagaaaaataaaaggctgtagttgtcgagtggtcaggaggatgaaatgacttctgtgaagtgcctggcagcaaaggcactaaaattcagtcatgactccctctcattcctctctcatttttgcattgaactgtcagagatggcaattttcctttcctaggtaccttctttatttacaagtagcttacagaaaatgcatatatgaaaggagttgtgtgaaacttttgaagccagttaagctctttttgcagagtccgtaatttttaattttaggatcttattttctaacatctttagtcaaggtaagttcttaaagaaaaaattcaaatgaagctcaatacctgtatattatcagctaggggcctggaagtagagttctggagttagcagaagtgatttcttgaaatcgtcagggcagagcggccagccaaatcctgagactcatcaaggcaggatttcctacccaacagcaagaacatcggaccttgtactaagccatgaggtccccacctggaatggtccattcagaattctctacacagacctggccactccaaaaagccagtggtgagtccagaggagggcagctgaaatgggacaaactaggcttctagaagacaatgatgactctgggaagggcaggcctgaatgtggattttgggacattcatgaagtcttcatagtacagaaaggattaagctataaccctattgtgaagcctttaggctcatgactcttgaatctcttttgaacctcaaaccctagtttgcgaccaaacagatctgcatatccatcaggtacatcaaacccaacacagcacaaagggaactgattacaccttcccaaaatctgcctctaagggtctaatcagcccccttgacagccctcagcctatatcctagcagaaaaaccggggtgatcctcaactcctccctcttcttttcctatggacacaccatcactgtcatctccaccttacagaagtctcttaggatgtctcctctttctggtcttacagaagccacttctgttcaccccactgcatggcttacctagacagtggcaagaagctcccaaccgatcttccctcatcttgccccattcagcttccctctggagtattcccagggtgtctgctagacccacaaagcagttgcgtccctctctcttatccaaatgccctgagtggctcctgttatccacagggcgagctggccctgacccacgcttccagactcccctctccccacacccactgcttgccttgaactccatgtgattactggcagcatcagctgcagcctcgttcctctacagatcctggctcacatgcatcctcaggctgggatgccactctgccttttgcacacctctccacactcagctcaaataccacctcctctgtgaagcctttcttgaccaagcccccacctccccatcatgcccttttcttattctgccccctcaaggctcaccagtgaactcactgccacctgtctctctcctccttgggggcactggctacattttcttcatcttggttttcccaggttctgatagtgcctggcaccttgtaaaagctgtgtgcatgtttgcagaatgaatgagtaaacacatggaaattaaaactatttaaacaggtccataaagattgtgttatgctcaaggaagatggattcattacacatctcaaaagaacctcaggaccttctgggactggaatggcaacaccgtgtggggtaaggagcctagaacgttcagttatgttctcaagtcgtcacagcttcaccttacccaagatatctaacatctctgagcctcaacttattcatctataagaataagaggacgctacaacatcaaccacaaaggctggggtgagaacgacacgggctcatgatgccaaacgtctggtggaggtcggcacagggcgggcagaggtggcaaatggcagtgtcctttgtccccaatcaacagaactgagctgaacatgagactctgagaaaggctcgggacagcagggccacagcacgtctcctggcctccagggacagtcaacttgaggaggcgacaaatctcatttgcaaaggtgagaaactgtacagcaagtcaacagtatcggatgagtcacgagacaggacgtgattgatgtcgggtgggcgtggaatgtgctgtgcattgcgtggggagggcccttagtgggggtgagcttggtgggaaaaggagggtctcggagggtccagctgctggggtggaggccacaggggcccaggagtgcagggtgggcgcggtaaagagactgccgttgttgcctttaggctgttctgctgctctctgcttccccctgttggcttgggagggaagagtagggctgttggctgagacggacgttagagcgagcaggtgagaagaggctgggaggaaccggcaatgcagcgaccaggagcaggtggtggagcggggaagagagagggagggctgcttggccagatgccaggcactctgccaattgcaggccctgcagatcttgccccgagctcagggtcaccttgaaccctctcctttctttctccagagtgcttgtcgcaccctctcccttcctggggccctcactcatgttctccttggaggttagaggcccatcctccctctcccaggacccttccccgcctccccagccagtgtgggccattggtgtgaccaaggtgaggggcacttggtgttcttgggactcttgttctttttcttgcttgagggcatttctcaagtaagaccagagatcattttagccctgagtgtcccagttaatattcatgaggcttgctgagaagccaaaaaaaaaaaaaaaaaaaggcttggacggcatcagacgggctggcaggggaggggggtgttcaaagaggagaagaaagcaagagccaacatagagtcttgcccagcaatagcatggaagggagtggcagcccattgtccctcaggaaaataaactgcaaataacttttcccgtttgtgtcaatctagtgctttcaacttacaaactattagtaggctttagaacttagatcaattgacattctgggtcaggtaattctttgttgtggggaggacgggctgccctgtgcactggaggatgtttagcagcttctctggcctctgcccacgacatgccagcggaaacccttgtctagtgtgaaaacccgaaatgtctccaggccgtgccaaatgtcccctggaaggcaaagtcatccccatggagaaccactgccttagattattgttaggtgctacccaaatgcccaacacctgtactggcccctccagtctcaccctcatctgagcactgcaagaacgtcccaccctggcgtccacctcccccgtccacctgatgtttacgtaaacagaaacagaagcttctttcagaagccaaggaatctcctcccaagtccagacgttgtgggttgggggtgggggtgcaggaatgcctctaactctgctcagtaactgcaaccccatggacttcataatggccaaggggactccacacccaaagccctcattccccaatttcctgggcagccagggatccaggtagaaacgcttgcccaggaggcgtctctctggtggaggagtaaaccttggagaatttgccctccgttttcttccctcgctttcttctccattttctctcccaggagctagctggtgagtagctaccgcagctactcatgtgaacatgaatctggggccaccctttttcaaatttcaacagcaagtcctggaactaaacaagaaagcctttgcacaaataaacaattaagttaattgtgggtctgacaaatattttgttttcccgaggaattaagtatgcatctggggttaggcttctgggctgagcctcttgtgtaaaaaaccagaaggcaagaaactgaaggaatatggtcaaagtcccttattttaaaatcaaggacactgagtcccggagaggtgaactgcctgtcagcacggaaaacaggaccagacataatcatggtaccttgttccaagtgaagttacctaatgctcccttcccatccaaacaaggatttgggatatgccgcccaggagggtggtcccaaaggggatcctcagaggatgcatcactaagtatttctgtaccccaggaggtggcttatttcatggaaacccttcacctggggctgttcatagaaccatgcacgcggcagttgaaaaggggcacctacgccttgctctgtgacattgttttcagtgaaaattagcgttcgctgttttcagcgttaaccttaaactccagctggctttatctcctctcacttattataattgtaacgcagtgcactgtgtaaaggtcacacctgtgtttatacgccatatgccatcaaaataccatgaagagaacactatgtggtctctatcagaagatcaaaagagaaggggtgagaagcagaccttcctcctaattcagggcccttcagtccttcccaaacactgaaataggcccatgtgcaccactgctcccgcaggagtttatgtctaggccaagtacgtgctgtttattgacagagaaacaaataccgctcagcacctgtccggtttcagagtgatgagggagtttccaatctggatctgagaaaacttttacactgtacccaaacattctttttcttttcttttcttcttttttttttctgaagccaaaattagaacaaaaacaaacatatacagagttcggcgtagcaggaaaaagaaactcagctcaagacatttcataagaaaagctccaagtccatctatactcacctggcctggaaccctgggattcatttgattgaggagggtcacaagctgtaccccagaggctcgggaggcaccactcggtaggaagaccctcctggtttctcaagctggaggagcagactgaaaggatgtttggggagtgaggaagtaataggggagtggatgcagaaggtattttgttgtctaacctagtggttccttgaggcgtattaatgagtaatattcatgcaccttctccttctgccaaggcagaaataacctggtactttttacctggtggccgagtgacctggccctaccagggacttcactaattagcatagtctctcatagcctggccttgggactggctgtcacacgctctcctccacaccagccatcagttgctctggaccctccgagacccccaggcagcctgacagccagtgagcagaaagacctgactccttcctggggccccttcctccagaggccccccacgaagctgtgctggccctgtttaggcagtggacacaagcctgttccaaccccagaatccaaggtctaagtcatcttcaataaggtattgcctgaaaccatgtgggataaaaagcttcttcctttaaaataaccttcaatgaagccaggccattactggaacttatcatatataatgacacacaaaatgccaagagaaatttatagcgccgcctgtctgcccaccatttaggcactggtgagtcattaattcatgagagatttatcagtttataaaagatgctagataagttaatttttaaaaatcatgtgagtatagatttatgctcaggttatctactttaaaaaaaggatctctcttgggctgtttttccaaagcagtgcaattcacgttaaccccccatcccactgcctccagcccatgccctagagagctgctgaaggacactggagtctgactagaggcagggctgggcccactgagtgtcaccaaaatcacaaaaacacaactgaaagagaactgttcttaaatactcatgtaccataaaaggggaatttccagaggtctctgatattagcaatttgcccttccattcccttcctctctagtttcaagatgagatgatgacaaaaagactgactagtgagaaaaagcatgaaactccatctacaaacgtgcaaaccgacacagagcaaacctgcaggaatttccacacccggtcttctgatttgccttgaaaagggggaaaaagagagaaaggaagcgtaccttcgcctccactaagacatcaacattaactctgttttcttaatttcacacgaacatcactgcgtctggagtctatgttttatttttcctgttaggcaaaagcaatttttcccaagtaaaagttctgaaacggatttcttttagaagcagagataactgggaattttctcaaaactagtacaagtatgaatgtttctccttttactttccatttttacaaatgcatttagggccaaatgcactggctaattttgatagaatgtaacagagacaggagaagcagtccatctcagtgagtgagtggacatttattaggcattcacttttcacaggcctgggatattaggtattgcgggggtgttgtattcaggaaatagaagtcaaaatccaattgagtagggaaatgagccaaacagaaatggacacaaagacaccaaaaacacctacaaaaacacagatgaatgtgcagaatcagctggagtttctatgagctgagctgaatctgctcaccttgcaaagatttccccgcacagtggggactgcccacgcgtacgcatttcttagtttctgctggccaactcgaatcgttttcagcggggtcatttacatcgtgtccactttttctggtttccaaactcaacccactttattatcttaagagttttcattctcagtatcatttacatacaacaaaatgaatatatcatgtgtacagttttatgaatattgacaaaggcatacatccctttaactcactcccctatcaagatatgcagcatttccatcctcccagaaagagcccttggagccactttgtttttaaattatttgcatctgaatatttttgagtggagattatcaaagccaaatgtgtgggaagaaagcctaatcattaatcatctactacaaatacaggtagtaaaggttttgaagatggtgcgtgagcctgcacagacaagtctgcgggattgggtcctgttatgaaatgccaaaggggctttttagcgacaggcacgtgggcccctctcagccgccctgtcggcactcagatacgcaactaagaccgagtgggtttcttttctggttttgttctttaggcatcagagtttacatgtttagaaagagggaagttgaggctgaatagtcacatccaccatattctcataggggcaaatgttctctgattaggagggctcaaccacagtgcagagtcccctcttccaaaattctgtttcaacaccgagaggagttcacatgaccaggcaaattagagattttcttagcatttcctgtttcccagatttcagaggagcccttcagggaatgtctggcccagggtagcacattcaggatgagggaaaaatggttatttttaggtccctccaaccatcacattcctccctgtctccacttgggcactctgttgttctagtgacctgtcaaagggatgggggcggggctgcgagaaaaaagccacatcgcttcctttggggtgggggtaagggtacccctgctccaggggtcctaaactgctcactagcccttctgctggagagggaccagaggtggaagacctgccagagtgagtgccaggcagctctagacttctgggtattcatttctcataaaaggttgcagtatttcctggacacctgaattctatgtcttcacggcaaaaacaattcaaaatgtcccaaaacattatgcaggaaggagtttttaattttttttaaatcacttttccaaaatggtaccctgaggtgatcctgtcttcaatctcccagcaatgaaaacaatgtggttgaaaagttgacagctttcaacccttgaaaaggtcacctccctgcctcacaccctctcgtaagtattaagagcataacggatattttgagtcacatgtattgttctttgttcatttgcatttggtgaaatcccccccttggaccaatttagtaagcagtgccttgggcttccttggtgattgttctcttgtcttctgtatattttttcctgtgaaaaaaatttagactcagccagtgaaatgaagttgcagcctctgtcactgatgctttctttttgctcagatgatctttccatctcgcttgggacagaattccttcttctttgcaacgaatgaagaccttcgaggctcagctgaggcccttgtactccaagactttctgaaagctccctcgcccctccccatctgaccttctgttggactgacatacttctccatatttcagcctcagatggcttggtgttcaccactagactgtgttactgaaagttaatcaagggtcctagggccatttacaaagtgggactgtaagagaaagtctagctagatggaaatgtatcctaaatacccccaagtcccagcacaggggttcccatcaacaaaaagcctcacctccaaatacattgctgaggacgcagggccccgtcttcccacctgacgcactacacaccacgtcagctgtcacaggaggtctgagtgctttatgaagctgcctgctttctctcttacctccatgtgtaagccaaccactctggctttcagaaacatatttctttctctatgagtaatttaaaagtgactcatcctcagcctcaccagccggtccatgtgacctgcagtgctggttgagtgttatctatagatgtgtaaaccaaagcagttcttagaacacagattccccctcccacgtgctgttgatttccctttgctacacagggagggaacgatgtcagacatgagcagccagggactgcccgctccgcactcaaatctggaatgtgtccattagaggaaacaaaggccatcacccagtgacagaaaagaagagacaggcaaaaggcctaatatatttattttagtattagcagaccatcaagaagctctgagaaaactccacaaaaattgaagacgatgatgacccatataaacaaaaaactgctcaaagttctttttctgagccagtagaaatttagacctcatgaaacagagatgacacccacacccaccccaaccaaaaccccaccaacacgtcttcattgctcaatcagaaacacattcctgggatctgctgtggtttgtcttgggaactcacatatatgaacatgtttttatttcttcaacttgcctttattccaccatcaccaaagaatggtgtcaggcccagctcggggacactactggtgcaggcaggcacgcgggtgacacagctggccagcattctagatcgtgtttcttacctctttctcacttcctattttctattaaaccaaatctgaactcatttgcctgctttgtgaagaccttcataatccagctactgtcgcctgattttctagcaccatctatgctcttggcacaattaatccttggctaccactagggcagcatcctcactgctcctccaaggaagacaccagagccttcatttccatgccttcaccctcccaaacccccaaactctgccctccttccttctttccttccctccttccttccttctttccatccctccttccttccctccttccttcctttaaattgagaaacttttgctctgtcactcaggctggagtgcagtcgcaattatagctcactgcagccttgaattcccaggatcaagtgatcctcttgcctcaacctcctgagtagctgggactataggcatgtgccactatgtctggctagtttttgtagagatggggtctggctatgttgccaaggttggtcttgaactcctcggttcaagtcattggtccacctcggcctcccaaagtgctgggattacaggtgtgagtcaccatggctggccacccttccttaccactgtctgtatctttaccttctgggagcactcttaccttcatcacccaaatcttaacccattcttccagctcagctcatcccacctgaaaatctccttaccttcctcacctgaccattcaagctgtcactaatgtctacatctcctaaacttctccaatagttcatcacatctgctcttcagttttgttttgctacctaatatatcacttcttatattttccaatattgtttgattgcaagttcttttgggaggggtatcacatatttcactcctattggccccacagtgcctagccctataacagcagatgaagcaacctttagattgaaacaaatattattttaatattgccaaaaaggtgtaataagcaaggtcttactaaacttttggccagctgttaaatttgattgcatgttgcctgaaagagaaactttactttttatcctagtaggaagttatgtggagaggaataatgtattggatattcagtaaaatgaaaaaaaacacacaacaatagtcatttatatagcactgtgtacaagcactgatctaagcacttaacaaatatccattcatcttaaacttcatagtgactttaaaaagtaggcactattatattccccacttcacacatgaggagatcaaagtattggagggaagttgtccaaagtcacatagtggctaagctagactcaaactctggcaatctggcaatcagactcttcagagtctgtgctcttagtggctgtgctatattcctgttaataggtgtgtgcttttatatggcctttttcattgaagcaaagaggagcttatcttctgtatggataccatgttacagttatgtgtactaaatccatcatgagtcaagtccagtgtaaagaaaactgatggtgagatgtcatcttccagggaagcttcagaaagaagtatggtggtggtatgggagctgaacaaatagagttttctttgaaatgaatggagtaaaatcttccagtccgccctcaggaccctgtgatatggtaccacccttccatgctctgtagaaataagagatttgaacctctgggcaatctttaggtaggcttgctccagaaaaatattactacatacccaagagaatcttcccaaatcctactttctcaacataaactcaatacaactcaaatcacagctgccattagatttgcttacaaattttaaatatgatctggcagccccagacatggtatgcctgagaactccagattaggtacaagaagaaaacctcatcctggtggtcaaatcacggcaggaagtgatgccactgacaattattcctgtattagcagttgcttaagtaccatgaggcttttagggggaaagactgggaggcagtggttggaaatgaagcccattattaatgtagtcaagctcttcagctggattcaataaaataaaaagccctgcccagaccagtgtctgtagtagaagatgctaaagagctgtttttcaaaaatctggctttattgaatccaggctttatacacagcattccttcttcctgaatggctgaaaaatcattccatgcatttgaaaccactggaggagaaatgaacttaagccatggcaagaaagcacagttagatttaaggcgtgaacgtcagcgttcaaggtaatggaaaccttggtagccctgtagatagattttcaagagagactgtgaaatcctcaagtcaattaatagaagaatatttttcacaatagcaaagacttggaaccaacccaaatgtccaacaatgatagactggattaagaaaatgtgaatgctagatgacgagttagttggtgcagcgcaccagcatggcacatgtatacatatgtaactaacctgcacattgtgcacatgtaccctaaaacttaaagtataataataaataaataaataaataaaaatagaagaatatttttattaattcaattcaggttcaaaattattattgggcgcctaccatgtgccagcccccatgtggtgccctgcaaggctctaaggataccaagatgaataaacacaaccactgctcaggaggaatttacaacccaagggaggaaacaggagctcagggctgacaaccatggagggaagtgtcttggtttggatgaacctcattgggtgtgactctgttggtctctgtccctctctctgggtttgctgctgtcacttttcatggctctggctctgtcttcattgttctctgactgccttgtctccatcttccaggcccctagctgcagacctccctggcttggggagccgcaggcatcttctgtgtttatccctccaaccacatccctggccaatggctgcttctgcttccataccctgctcagcaggctcatccacactcatcaggaatcctggagagacctctcctatcccaaacctctctcaggctaaatggctacacaaccggaaaaggagccgtggagaaactgactccttgggggtgaaggcctcgggcctaggtgttttacagtcacctgtgcaacaaacatttacaaagggatgcaaagggcccagacactggcgggagacaaaaagagattgagcaagactctgtcctcaaggaccttaggatctagagaaggcttgcaggggaggggggtggaatctaagcccgaggggatgtccgaataacaaacaagctatatgacaatgttgaaaacagagttcactcccaggttgggtctaattgagccagacagtcattgtcaaaaatcacatgccccaaatgggcagagttcgtttgctggatcgctttaaagctgtgccgtctgccttgaagcaagtccactgtcattttgttaaacaagggtccttcatccaatactggttatggccagggttgcagacccacaggacacaaagcctggccctcagtatgaggaccagctgctggctggcttcctcggagggggactgtgggcttggggggcactcacggctttatagactgcccagtcccatgccccagagagaggtggttggcaggaagaaatgtgacaccaggaagtgctaaggagaaagacaaggcagctcccagagtggggagaaggatccgctgtggaggaggagaaacttggccaaccttggaatgggccttggaagacgagaggatttggactgggggatgtaaggcgaggagtcaagccagctccaggaccctggacggggcagggacggcgtccctggaccctggacagcacgcatatcctgactggggaacgaggtacctgcagaagccacactgtcactggctgggaggacaccctgcagttgactgcgccagctctcactggccaagcccatacgatatcatgatcagatcatggaaaacgtatacatattaacagggaaccctggtgaaatacattttttggaaattatttaggagacaaacagtataataatgaactggtgtcccttagaacagtgttaaacaggagtgagcattaacacacccctccaacactgggcagatgctatcactgtattgacttggagtatgacagcttaccgacgggatatgaggtatcacataggttaagtttggttagtaaaacattaatgattgcagcattagaaatgatgcattcctgacaagggacactatcgtcttatacaggtttctttatcatattggttgactgatgtacttccctcccctccttctttccttttgtctttccttccatggagcactgaccaggtgctaggcactgggctagatgctgagactacacggcagaatgagatgtaatccctgctttatggtcgcatgctccagccagggagaccaacagctaacaaattctaatgttgcaacatgagaaggtgctggagtagagggatgtgggaaaggtgatgggagcacgaaggaaggtggcttctgttttgaatgggttttaagaggcctcctttggtgtataattctataataaatatgtctcattgctagggggttggctgtctcttacagtcacctatttcctgtctttctcgccttccttcattcatctatctacctccctttctctttcatctatctattcatctatcatgaatatcatctattcatttatctacttctttttctctttctctccatccaacatccatcatccatccatctagccttctaggacattttaaatacataacttttctctctaagtcagatttctcttcttgctataggaaaagcctagctaccaaggatcattttgctaaagtgaaggctgacaaaggagatttagaattccttctttgggcacatttaaaaataaaataggactggggccaggtgtgatggctcatgactatcatcctagtgctttgggaggccgaggcaggaggatcacttgagcctaagagtttgaaaccagcctgggcaacatagcaagacctccatctctacaaaaaaaattaagaattagccggatgttggctgggcgtggtggctcctgtctgtaatcccagcatatggggaggccaaggcgggtggatcataaggtcaagagatcaagactatcctggccaacatggtgaaaccctgtctctactaaaaatacaaaaattagctgggtgtgatggtgcatgcctgtggtcccacctactcaggaggctgaggtaggagaatcatttaaacccgggaggcagaggttgcagtgagcagagatcacaccactgcactccagcctgggtgacagagtgagactccgtctcaaaaaaaaaaaaaaataaataaaggaattagcaggactgaggcaggaggatcacttgagcccgggagtttgtggctgcagtgacctatgatcatgccactgcactccaggctggacaagagagtggggccctttctctaaacaacaacaacaacatgattgttgccatctggctggaatgggcaggtggttctgcctaaaggcagaggggcctattggagaatgtgtcaagagtgcccatgcctccttgttccatccattgccaatgtaccaaggatcattttgccaaagtgaagtctgacaaaggaggtttagaattccttccctgggcacatttaaaaacaggactggggtcaggtgtgatggctcatgggcaggaggatcacttgagcccatgagcttgagaccagcctgggcaacatagcaagacctccatgtctacaaaacaattaaaaatgtcctaagtccccttggaccaccagcagctgccacctgtcaacactggaactgatcgcccaggccaaatgttgaggtggggactgaggccctggaggatgcacatccatagtctctgaggtcattctttgctggctgcagttctaacacggactgatgactctgcatggagagtcacaggaggcttatcgtcatccatagctgacgtccacagccagacatccacgagatgctcaaactcagaatgctatgtggctagcattttccaatgcctaaagcttctgatctgtttccaactggggggaaatgtggactgctccgtttattggtatgtctggcctctgtcgcctaaatttccaaagattccctcatcttctgtgaagtataaagtcctcctggaatgccagggctttttaggcggtctgcatgttgtaggaagagaaaaggtgacctgagggtgggatctagaaacattgcactttccctattggaatccaaagtggggagccattctcaacaactaactagcaacaacccaagtcctcaggattgaacacgctcagcggtcatctgtctttatcttggggtcttaactgtatttgatgaaagctgcttattggcctaacagcattgaataaacaggcaaaattcccagcctctggctgactctcctgaagtatctccagccttgattctgagaatctaacatgggcttcccagcactacaggcacaggcaggcacctgatcatccctggtgacacttatttcctaatcgattccatggagggcttcttttgggcggtcagaaacaacaggcccttgttttctaagttaaatgcagacagaatagtttttccccttcgtgtttttctttctttctttctttctttctttctttctttctttctttctttctttctttctttcttccttccttccttctttcctttccttcctttctttctttctttctttctttctttctttctctttctttctttctttctttttctttctttctttttctttctctctctctctctctctttctttttctttctttcctttctccctctctctccctccctgtctccctccctccctccctccctcctctctttcttttctcttctcttctcttttttttcttccttccttttcaatggagtctcgctctgtcacccaggctggagtgcagtggcatgatcttggctcactgcaacctccacctcctgggttcaagcaattctcctgctctagtcacccgagtagctgggactacagtgtgtgtgacaccatgcccagctaatttttgtatttttagtagagaagggggtttcaccatgttggccaggctggtcttgatctcttgacctcatgatccacccgcctcggcctcccaaagtgctgggattacaggtgtgagccaccgtgcccagcgcgttttctttaaggggtagatgccggtggccgtcatcaaagtaattctaatgctatttaaaattcttatctcttgagaagaatagagatgatcctttaatgttcttttacacatttttcaatgttttccttgcaactgtaacaagcaaactcatgtcatcaatagccatattatgaccgtaatcagtgatcagtatgtggaaggaagcctaacttggtgactaacagcacacacatggctttaaacctggctcagtcacttaccactgcatgaccttgcgcaagctgctaaatgcctctgtgcctcagtttttttcatctataaaatggggctaatgatagtgcatacctcattaggttcttgggagtataaaatatgttactatatacgacatgcttaaaacagtgacgggcacatggtaagtgtgagctctcatactaatgaatgaataactcattgaactaagcaacaccaagcagacaaggcagcatctagaaacttgggttttcaatgggctacaataatatagcaatgagcttggaatggtgccttgtgcatagtcagtgttcaatgttagcaactcgtaatatggacacctgggccccacttttgcttggaactgttttatatgaccttgacttaatccatccaaagctcagctacattacattttgcttcctttcttccatctttggtgtttatgcggaaaagacccaaccccaggtcagagaaagtcctccactaacactgtgagatgcaagtcacattcggtatatgaccagtaaattgggtcccactttggagttcttctcccatttcattatccttctgcaaattttccttgtgtctgccctttatatgtgctcaagacttcaaatcatggggccatctgcactctttaaaactttcattcagtcgtacttctattttgcacataaggaaacacaagtacaaacgataatgtgcaaagcaggtatgaaattaatcaggcttgtcatggacggtcactgggctcacaagctacaggtcgcacatgggtgactgtcaacagttggctggacactgatagagagttacaccaatcgagtgtcttcttccaaaaacttagaatcaggtagacgccaatgttttcttaggtattcttagtaaatagacttttttgagcagattagaaaaggaacgatttatttttgaaataatgctagtaaaatatataaattcagcttttatgagattttcttactgttataatgttttcctctattctgaattcaaagtgaacttttaaaatgtctaaaaaccatgctttgcctaagtattcataagccatgtgtgatacgtgtccatcatttgacaatggccagagtttactagtgtaattttcaagtatcagtccctgtgccaggttaatggatttaagaaaaaaaacaaaaaccaacaccttaatttctaagatctggccttttaaccttttaggaaatgaaaggatttaaatagcctgctgatatatctcatagtgtgtctaccctgcaattccactagcacggtgtgaatgagcctgattcactgctggagtgagggaggttaggagatcctgataaactcagataacatgtaaagaaaatgcttagcaactggtggcccaggagcattcagaaggcttgcaagggcaaagcacttataatcatgaaatgagaagggatgttactgacaataaccaactgattgataacatctagttataatagagtctagttaagtgcactcacaaaacagctatatgatgccacaggtaaaatgaaactttgaaagaaagctagtccatatatggtaaatatgcttcaagctgtaagagataaaaataataaatatggccaggcacatagctcatgcctgtgatcccagcacttgggaggccaaagctggaggattccttgagccttgaagtttgagactagcctaggtgacagagcaagaccttgtctctacaaaaaattaaaagaaaaaaattatctgggagtggtggcacaggcctgtagtcccacatactcatgaggcccaggcagaaggattgcttgagtccaggggtttgaggctgcagtgagctatgatcacaccactgcactccagcctgggtgacaaagcgagaccccatctctaataaatagatacatacataaatatatacacaaattagatagaatatcaaatacatttgttatatatcagagttagatttcaactctgacctgtaattgggctaatacctataaggcacaggatgattctgactcccatgattcagagcatgttgagcttagcatggtcttatgtattaatagtttaaaaacacagtgaatgaacacaatcctaatgaacaatttctaaagatggacagagcacttcacctggtaattacttttcacatcctttcattcacgtactcacttgctgcacagctactatctcctcactcgtgagtattattcctcacttatctgtctgttgagcaagaacaacgcagacactaaacaccctgatgctgcttggtcctgaagaactggtgagatggatctggctttttcatcagaatattattattttcccacttgagtctttggggactcaacaatcatgccctgagagtaggcatcaaaatggtaaacagtgaattcccggccgggcgtggtggttcacgcctgtaatcccagcactttgggaggccgaggcgggtggatcacaaggtcaggagatcgagaccatcctagctaacacggtgaaaccctgtctctactaaaaatataaaaaattagccaggtgtggtggcgggcgcctgtagtcccagctactcgggaggctgaggcaggagaatggcgtgaacctgggaggtggagctggcagtgagccgagatcgtgccactgcactccagcctgggcgacagaggaagactgtgtctcaaaaacaaaaaacaaaaaacaaaaacagtgaattcccatctaaatgaccaactctacctgaaaatgtaaaagtattcaatgagatcatgaaggcagaaaagtcatgatgcaccaacggatctcaactccgcattcattcctcctttaggtcagctttgtcttcacttgcaccatagcctgcattcccattgattgactctacgcaggatgtctataaatagtaattaaaaactgaaaaaagacatcatattgtttaacttgaaataacctttcaaaaccacaaaaagtttagctccaatatagaagttgtgatcaattctcctttttgttttattccagaaagaaactggcacataatcgtaattaaaaactgaaaaaagacatcatattgtttaacttgaaataacctttcacaaccacaagaagtttagctccaatatagaagttgtgatcaattctcctttttgttttattccagaaagaaactggcacatgtaagatgaagaaaaattctgtttccaacatatattttgctaggctcaccgttaaaatacacacaagccaaaaacaccgactctacctgaacattttgggggttgtttaaacatgtttgttttcttagtgaagctaaaaatgtttttccctggtgtttttgaagagacatttagactaaaataaaaataaaaataaatgacatgtataaaaagttatagtcatcagacctggagcagaattcggaaagcggatggaggaagtgaattttaagacctgtgcagcagttttcctattttggttgctctaaatagacgtggaaaaacaaatcgaaagaaaaaagcccatctctctccaccctgtacaaatgagatataaaaactgattcctcatctggagttaagctcaggaatagattaatgtatgtccatgcaatattttttctgttattatagatcaaatgctattactatgaactctaataggacaagacttcttgtttgtatcagacttcttatcatttggtatattctagacatgactgagcttaaaaatcttagggggatgaaaaccacaaagaaatatttattgtagaatactgactataatcaaatttgacttgcagtttccttttaagtgagaaaaacataataagaatttcagtatagaaagggtttcctcacttggataattggaatgaggcccatggctttggaaaatctctgaaaatattaggctaagtttcttgtgtttgtgaatttttctggagagaggatacatagctgtaatttaattatcaaaggatgcacacacacatctataatactatatgtatatatgactatatatagacacatacacatatgtatatttactcatttaattcttaaaacctctatgaaatgagtactcttttgttcctcattttacagataataaataaacaaagattacctacttcctaggttagcagttgtttcacttaatgctaagggacccagccaagactatgaacccaaaactcaatgagaaacacaattgaaactcagaatttctagtacgcatggacgggtggatgaatggatgtctcaggtcttttattgttgttttttttttcttctctgctcctctttttctgatgtatgtggatggctctcctgtcaatttacaacctagtctaatgttaaacaccaactcatacttgtcttttctgagacccaagtaaaaaatggtacattcattttctgttataaagagcataaagaggctgggcatggtggctcatgcctgtaatcccagcactttgggaggccgaggcgggtgtatcacctgaggtcaggagttcgagaccagcctggccaacatggtgaaaccccgtctctactaaaaataccaaaactagccgggcgtagtggcaggcacctgtaatcccagctactcggggggctgaggcaggagaattgcttgaacccaggaggcggaagttgcagggagtcgagatcatgccactgcactccagcatgggggacaagagtgagactttgtctcaaaaaaaaaaaaaaaaaaaagcattaagaagttctacggtcttccctcaatctctctgtcatctcccccaaaacactaaattttgtggaattccattaagaactatatagcatactcctaaaaacacatgtctgccgttttcacctaagatgccacactgacccacaaatccaggttgaggggtatctgtcttgacattgtttgaagtctaccacattttgtcaaaagccaccttcctcaaatattatcgtcattcgcaagccccccacaagcacttcctcagtcactctccaaagcttggataaagttcattccctggaactttgggcaaccaaatcactagcattcatgaaaaaatactggaaaagaaggctcagccctaaacactgaataacttctttgttgaccctcaaaagatacaggcaaatttaaagattgttccatttgtcaattgattaaaaaaattatgaaacataatttaagttagacgtgggagtggtactagccaaatgctatagtcgaattagctaaccatctgttgtactgcctagagactttcacatatattatttccaaaagtcatattcaaaacatctagcaaccagcatagtgtgcacctaggccaatcagactaggcttcagccagctgtaagcagccagcacagctgggcaacctaggtgaattccagccctgttagttcatgtaaggtccccattggtgctaaacctgttttaccaatggatttaagaaggaacccaaagtgtgaaaattcaggcttcaggaagtgaaggggtggcctggatcaatcagctggtaaatgatagagaggagattcaaagtcagatttcccaacccttgctctctcctcctcccactacacaggtgcccaaaaatactctcagggagacaaagttgtctggagctccacgccacatcagacagcaaagctattgggactactcaggagacaatctatttagacaccttcttaagagtatcaggagcctgagagacgggcatcctctgatctccagctttctacggggctcacacctctctgaatagtttcactgtaatcttctctgctgcctgtgacatgggaggcactcacactggagatgtgacttgttatgatggaaggatacatgacttgggatgatgggaaggtgggtgaaaattgtggatggaattttcaagcaaagggaaatctaaaaaatgatctcagcttgaactcccacagcgtggtttggttgcctgcttccctagacgagctgttctgttcgctctggtcaggacttggcatggtctattgaaagaattttcctttattagcatggggagcaatggcaggatggaaatgagtgttttgagaatgcttgagataaaatcactggcagactattcaatattttctataatgatgagacctaacctaacaaattggtctgtctctcatcctctggccagtcctttctgacactagagacccagtgggcctgaggagggcagcctaggaggccaatgtgggtggtcaggcacctggggaccagggttccaaaaccctcctcctgtcggctcccaatagggtgtttgcctgcctagaccgtgtcaggcacagagtcagcatttgttcagggactgcttgttgattgaatgagtgagtgaacgagtgaaagaaaggatgaataaatcaaacagtgaataagtcagtgaataaaagagtgagtgggtggtagtagcgggtaaatgggcaagggcagtaatagtcttttctttcttttttttacaattgatacatagtaattatacatatttatagagtacatgtgatattttgatacatgcatacaatacctaacaaatcagagtgtttaggatactcatcacctcacttatcatttctttgtgttgggaacatttaaaatcttctcttccagctattttgaaatatataataaattgctaactatagccaacttactgtgctattaaacacaataacttattccttcatctaactgtatgtttgtacccattaatcagcctctctttatcacctcccaacccttcccgaagaacttgatgtttttcttcttttctttttttttttttgagacagggtctcactcccatcttctgggctggagtgcagtggtacaatcacagctctctgcagcctcgacttcctgggctcaggtgattctctcacctcagcctcccgagtagctgggaccacaggtgcacacccccacgcccatgtaatttttctatttttagtagagacgggttttcatcatgttgatcaggctggtctcaaactcttgggctcaagtaattcacccgcttccataggggtgagtcactgcaccctgccaacatttttcaaaagtaaaaaataaattaaaaaaaaagtctttagtggattgctgagtcccctctgacaggaggtaccaaatgtgcttttcctgaggacaggggaagagttcactattcagccatacctttgcatattttacaaaattcacttctaccaaggatgcctctccacaaaatgaggagtagcacaaagaacacctaagaaaccaggcctgacccagggcctctgatgctggggcaggttccccgcgtgctaatatcccaggggaccctgttgcagttctctgaataccggctgtgagctttccaacttcagctgagtcccagcatcctcctcacaccacttatcctccttgcctgtccctggcgcgtttagacaactggaatctttgctgacattttaaatgggctggctacttctccagcgtggaggcacctagcacaaggtgtgatagatcagtatttgttgatgagtaacaaagttattctggcaaattggacttttcccctgaaacgttttggcttttacatttttaatgatgggtcaagaaacagcccccaagaagaaggggcggagatagggggtaggaccctgcctgaagcttccaagctgactctgtttgcagtcacttaattcactagggagggctggatctgcctccctgtggtggactctccgcatctccagaaagtgcaggggtggagaattaactcagcccccctcctccccataagagccccgccaggtcagcctgcatgaggagggcacgtgcacacctccaaaaggactggtgcagccacttccctaagctcacagtcccagtgtgagctcagggcccagactcggggcctctggtgtttcaggcgtgagccaagtcccctgagcaagaggcctcatgataaatcagttggagcctgggggccatgaaagcattggttatggcagaaactaccagctcgtcaccgtttatgctgctttgcttaaaaatgacaccgcgtaagggattttgccaattcccaacctcgggagatcacccaccacctggctgtggtccgccgctgaacaggaaagcactccgagatgccaagagactaaaaggctcgtaactgttgtttagaaatgaaaatggccctaaattataaccagagatggaagcgcgtctcaggggagggcggggcgctgtgtaatcgagcctcccatgcgcaaggcggatacaaacggtttatggatgtgggcgaaggttctcagagcaaagaatgtccatttccatcagattaaaatacagtttgggaaaacaattacctgcctgagatcctgggaaagtaaaacttcctggtttctttgccaggaagaacgattgtaaaacaagggctgagaatctcccaaacaagattttagaattttatccaaacagctgcagttcacctttgaggagccccagactcacttgggtctgatggatgttgcaacaccaagtttgaggtctccccagcctggtgccaagagtgggccccaggggacaaacagagaacagttgctctcttaatcggagtagaaaacaaaactccctccccttcccacccccaacctccctgctttgttgtgaaattgtcactgcgcctttgaggagtgattaaaatcccagccatgaccaatttaaagggcaggttcccaggcagggaagggaaaggggttcaaggcaaaaaaaaaaaaaaaaagtcagttgaagtgagtttatggaggatttggggatcacaaaagtcatgggacttgagtcaattaaaattaatggaaaagcaccaacatgcaatttaaaaaataataataaaataaagcagtaaggatatttctggcttgctctctgcttccattcttgagcctgcttgggaatcttggagcagacttcctgaagcacagcatgagtgcccaatggctgttttaacctattttcctgcccttcacacacaaagattctgcaatggagagtgggaatgaatggtccacccacccctgaacatttcctgtgagttgggaatgcgctcagtaaggctgctggagtggagggaaaagaaaaggtgtctgagttctctagacatgggcagaaaaggagagaatttgagacaggctgagagaaagctgctccggttggcagcattgccagattctcagacacaccgtacattccagcccccgaaaaggccatcctgagtccctctagggcccctggggctctcatctcatcccaaatatttggaactgtctgtgcctgctataatacacaagagccccttcccatgttttctcctggtgctatttgtaaaggtgaggaaaggtaacgataccaaaggagttctaatcctatgggcttggttcccagaaagccctatgttgcggtgcggaaggcaggtaaggaggcgaaggttcccaactccacctaggggagggagcatatctcagcaaaggactcagtctttacccagcctgaatcttacctgtggtccttggatggacactcacattgattaagtcaagagattccgatcaagccctctcatcctcattcctacggtggggatgataatagtacctaactcgccggtgagagttcttatgacgatgaaatgagttgccaggtattatagtgtttagaatgcagcatagcacacagtagctcaacagatgctcgatttcattgctgttgtaagtgtccttattctctgattgatcattcatttagctttctcttttctcactcaatgagacttctgcagtattgtgatgaatgtcttatagctatccctttcatgaaagacctcagagccccaagttacaaaagcacatggccatctacgcaatctatcaattaagcactatgcttcacctgattaggaaacccttacctttcggcatcattccttcttccctttcattttcctcccttcttctcccttccaaacccactacacatgcctagctgatattttattaacccctgacggcttatggaaaatgtgttttagccataggaacactgatgtcctatagccaagttgcttttctgaatcagacaccagctccctagccaaatggggaagagcagggaagggagatattaaaatcctttgctaaagcagaagctctgggtgttgctaggaagtcttgctcttcagcaaaaactgcagcaggaatcccttctcctcctttgtgaaacggaaaacaaacggcttgctccgattccccggctctatgggggctgctgagcagcactgcttcccctggagagagaaggtggaggcagaagctgtccgcccaccccaccccagaccgcccatcccaccccaggcttaatctccatggcgttttccactttcccaggctgaccacggcaacgtgaatgcttcgctgccagccagctgagtactgcccttggtgagaactctgcctcggagaagcagggggaactgaagctgcattgtaggatagggggtctccagccaatgctcctagaccccctactagtgatggggctctcaaactactagtgatggggctctccatcatcaaggtcccttagccctccagctcccgggcctctcagggctcctacggtagctgctcctatgggcagacacatcccttttcctattatagttacagcaaaaacaataagcagtaaatccaccaagggtcctgtgggctcccacagaccaacattcccacaatgcccagtggaaacgtgtcagtgtacagacgctttgattcattgtgatccaaggggcttttcatgcctttaaaaacaaatattaatgtggagaagatgctttgtttcaccatgcactctcatggctcacgacggaggccccaaatgtaaagctttcaggacaagcaagtgcaacatgcaagacagaccagtcatttttacctctgccaccagaaatgaaaaagcgttttctccttgtttggctgcaggttactaatttggaggatgccagttttagagttcatctcagtttgacttgtaaatgaaaggtggaacctagccaaaattacccctgtgtggctgctggccctggcacgcctcgcatacccctctttcctatgttgaggtgggacagtcactgaaatcattagaaagagcaactaggaggtgcaaaacaagccctggaaggcagtaaagctctgtgagcaacacagaatctctctctcttagctttgcgattgggaccttcacctgtagagaggatcccaagcactggccgtcagaatcacccagggcgcttgggaaaaatgcagatgcctggacccgtcagtgagcccggacctctgtgtttctttttagctctcctaaaacaacatttcagaaccactgcctttcagcacagcagagagaacgaagttatggggagggttaacttgaaatagagttgtggacttcttctaaggtctatcatcattaagcttcccttgcagaatgtcagacatgtgtccaacttcaccatcatcctatcaaatccacatgacaacctgcaagtacgatttgacgtctctgttttgtggatgaagaaacagaagctaagagacattccagtgaactctggatctggaaatccacggctaggaagcagtctgtctgatgggaagggcagatgcatgcaggttccacagaaggagccctgcctcctcttctgagcctctcttggttcctcacgtccaagtgcagggtcagagatggggcaggcacatcgtccttttgctggggatctccaggcacctgctggggggcacctccttacttcaccacctctggccagcccttgatttcttccttctccctggttccaatcttctccccttatcttgctctgccttcctctttcctcctttctcttttcccagagagtagttagtctcaatcttgcaaacacagtgaaatcacttggagagcactgggtcttatccttagggagtgtggcagaattgatttggggtgtggcttggacaccagaacttttaaatactccaggctgattctagtggacagccaaggttggaagctgttccctatccagagctgtcagccacagcctgcacaatcaggagattcacctggacatgctcaggctgaagagggtctggccaccagcccacggtttgaaacagagccctgtgaagaaggatcaggtggtcccagtgccagtccagccacatctgtactgagaaaacacagagctaccaccagctgaccgcatggagcgaggatcctaacacctgatggacaaaatgcgtccttggctggcctctgcagagaagggactgtggaaaaacatatgctgctcccttgagaccgggggatgtccacagggtgggtgacaggaagaagagagagcagctaccacagccaccctgcatattaaacagcctgaaacaaggggtggctgtgcaaactccattctcctgccataaattagaccataaaacaggcttcattggcccattctgcaaatcaactctgcagttttattacacacacaaacatgcataccacatgtaggacaaaaaaattttgcatagagttctgctttgcactaatctctttaaggaaattttacagacggtaaataaaacctcatgtccctacctggggtatttgcctgaagataagagcaactcattgcaaaaggattcctgctgtaagacagactgtagcccatcaggggagagcaggatggaaacagaggcttcctgaaatacttgaagggttctgcaaactgttgaagccacggtactgcctggagcactcagcaccgagctgggcatgcctaggtcactgacgaatctctgtcaatgcacaaatgagcagatgcatgtcacactgatggtggggctcagacccaccccttgctatggacaaggaagtgctggggaaggaaaacaaacacaaaaccttccacccgaagtaagatcagctggcagatgagcgtgcagaaggggtaacagcaactcatggagggcaagccaccagagagggcaggaaatgacccctctggacacctccctcttggctgtgggctagcagtgagggagagaaagaagagggcaggtgtctgctcctctattgctccaggagaggaaaatgccccccacccccacccaggagttggtgttgtggctcacatcacagcaggcttcatggaagttgagctattatggcgaagagggtgaggtggggcacagagctgtttgggacacaggacttgctctccccatgggcatgggacagctgttcctcatgagagacagctgcagatggggcctccgcgcttggccatcagctcagctgtgcccgtgggtacctcagagggccaaagcagcctctagatgagagaaaattcaaagacaacaagaagtaaaccaattctgaaaaaggcgactgaagacaagggctggcaatggcatcattccatgtgtggaaggagttcagaagaaaggaaacacgccatcgccttctgcatggggcgggggcggggggcttaaacagatgtctgagaattgtatatggacatctgtaatcacacagtttccatagtaaacatttgcctggagagaattcttttgctctcttctttttcccatctcttgtgtacattaaacagtgcaatttatgttagcaagaataaccacacacctctctcaccacccttctttgagtgtatcttaaggcagcactccattatgctgtggaaggagcctgcatggggccctgccctcaaacataccatccccaggaccacagtggcacagacgcatgacagagcagaagagaaaaaggccccgcaaagaaacagaatggtcccaatcctgaagtgtttgattacaactcaactgagtacctgcaggagacagagctaccaatcagagcagggactcatcggctgctggttgagaggccaacgctggccttggccatggataaggagccttgaccaactacctaagaagaccttgggaatgcacgtgtgggctcagcttgacaccgacccactcttctaacttcctgtattcagattctgtgctcaccaagctgcctctgcagcatatctggcttcctaggaaaacttccctgcagagagagcatgggctggccaggcaagcatgaatattaatctgaaatattctcattacagatgaatacactggcattcttgtttgaacacctatatagttggcttttaatgggtgtcagcccctaagagatggatctggcctttgagggatgaacagatcagatcttcaagcatgccaggaggaagtccatagagctctgctttgcaccaatctctttagggaaattttgcagactgtaaataaaacctcatatccccatctggggcatttgcctgaagataagtgcaactcattgcaaaaggattcctgctgtaatacagactgtagcccatcaggggagagtaggatggaagcagaggcttcctgaaatatttgaaggcttctgtaaactgttgaagccccccgaccatgatgaattcagcaagtaatgccatccttgaaggcgccttgagggccatactcttagtcttcccctgatgacatccgagtaagttgttgaaagtctttcttggccacttcttgaatttctacccttcttcttgaatgtagactgtagactcagaaacgaccctgagttttccagggtctggatgtctgaatgtgatcaatgtggccccagaagcagtgggcatcttggttccactccttagcgacactgccaacttcacagctgataatcactcctgacctgctaaatcctctggtcctgtccaattctgatccaatcagactgaaagccaggcaagaaaggctaaccagagggagttatgagagatgcttgctctcacagaacacaggctttggttgggaagacataacatatacatgaaatggtcaaacatattcagtgtcacaaatgaaaatacagcccacactgatcaagaagtgagtaggccagaattgggtggcattaatcttaaaaggatttctgaaggaagtatttctatggaaaagcagtgtcgtgataaaaggacaggtcttcaggtcaattctttgggttctaacgtctgactatttgtgatttcacaaagtatggtcaaggctaggtgagtggggtaggaacaaagtgcttgacatacagagatgctaaaaaaagtgtccttacaaatatccctgcaagggaaaggatgagaagagacaagaagaagaaaatctgaagtgtttccttcagggctagctgctttccatatggtatctcatttgattctcacagtcacactgtaagatgtttattatcctttgcatcttacaaagaagaaaccaaaggtcaaggttaagtaacctatctaaagtcattctgctgatctgtggcagagtctaggtagtaaccctcactctgtgtcaggcattattctaaatgttttatttgtattaattatttcggcttcacaaccctatgaggtaggtactatccttaaccccacttactaaggaggaaactgaggcacagagaggttaagtaacttgcccaaagtcaacacagctagtaagtaacagagccaggacttgaacccaggcaatctgggtcctgagtttggaatgctaaccactttactatctttttccattacatatgccatactgcctctctttgaagaatatttatgaacagacaaaactgtcaaaacagcttggagctttaggatgaatattttaaatattataaatccctcactcgtaggggagtggttgtttgatatggtttctgctgatcactcagtaatctatccaagacagtgatgtgcacagactattttggtttcagttaatatatagcaccatataaacattgactcaactggagagcctgaacaataaattatcactagctcaagtgctaaaatagcacttgcttttctctgtgcctgagcatgctatctatttatactttgcttacttctgtggagttcaaactgctttatgcacatttcatcattgctgtacttacatggatttattgtctttattatacacatgtgactaatgtaccacacaacgcttaatatttactacaggaatctcagttttcaactagctttttaatctatgggtattactgactgcctttaatttataattagtggaagtctgctaacaataaaaaccatagcattttactgtttatcttttagctcaattcattttgtacatgatatgaccattcttgttcttgagtatgaaccatatattattttctggcctttctttacaattccacttatggctgaccttgaaccagaataggtctgtgattttactttccaaagtccaatacatgtatttttcttttgttcatgttgatatctgcattggcacacgtgaatttccaaatttggtcttcaccttttcagttttcataggcaaaaaataaatttggatgatgcaatagtcagtaaagaactccaaacaaaggttttcttgactagctggaggatatatggaaatccctaactgtggtgtatataaactgtaaacccaagtttatacattgtcaggagttaatagaacttaagatttagtagcattctttagtactagattcataaagagaaatgaagaaagaattgtcatttgatgtttttgtcctgacaaataaaaatagccaactgcttagcccacagctggggcattctgttttcttttgtcttcttttcatgtgaatatccatcttcattattgaaaacagaaactccaaccttaagcatttccctgtttttgcaaaaaggatattatatcaacagtcccttttaagaacaggaagttatcgtttcattctacacaagtccctacagttttcatcttgccctggtgtgtcatctgtcagtgtgactttaggaaggtgagacaggtatggccagatatgagagatttttaaaagtcacagtgtcaacaatggtgttataaggggagtgtttagtaacagagccatttattttaggaatgtttttgtaccctggtaatcctgatatgataaggctttaacaaggtcaactaagtaacctgtagtcaatatcctcattcaagagaggtcagatgcttggggactcacagctgtacagatgtactgtgtgcccttttatctctcccttatgcacatgccgttctctctacctagataagtgggcacctctacctctatgatttctctttcaggactccgtgtagttatcatttcctctaaaaagcctttcctaaaaccaagttggatgtctgttttgtgggcacagccccctacacccaccccacttatcctaatgggttgaaaataccaggaaaaacttcagataaagaccatgccccagtaaatagctgaataaagaacaggtgaagggtgtcagaaaagcaagaaatggagacagaggcttggaatggtcttcctagtattgttgttgttacctctacatggccaccctgggggtacacgtggagctgtggaaatctctaaaatcaaaaccaggccaggcttagaattagttcgactaatacagattacgttacttgaatgttttcaaatgcagattttgcttttttatttttctttgctctttatctcattaaaataaacagtggtatggcattcccatttgaaccaggtccagctctgaaagctggagcagtcttcagatggcatgctccatttggcccctgctcatagggctggcgttcagaccatggaaatatcagcagaatcgaatgcacttgggcagtttccataaactttgtaagtatacgatcaaagttaagacaaatgggaaacacagaataattaataacaatggtgagtggaaaatgctagcaagccataacaatccaaagcatgttttctatctctttttaagcagctatctgtcttacccacaaagacactgcctgaaaaatgaattcaccagctctatatctgaggcagaatgacatatggaaatagtacagtctttggcgttagacctgagtttcagtgctagctctgaaacttacttgctggctgcatggctttagcaagttccttaagatggcagggcctctgcttcctcatcaacttttacaattttggaggtttagagaaaatataagtacaagtgtttagcacatcataggggttcaataagggatgactagtgccatcatcattatcttcaacactactgaagaaacagtaaaataatcagtttggaaattatgaatgaccctaaactgaattggagtttaattatataggtgatagaaataaagattggaataagcaaattagaacataaactggaaaatatttaacaaatgtaagaaagcaaacttttgaataatttaattatactcattttaccataatactatgtatacatcaacaaatcttaatttgtattaatttgtaataatattaatttcaatttataatactcataatccttaaattatatattagctgaacagtatattatatatccttccagaaaatgctatgaatatacatgcatttgtatatgtatctaatttttttctcatcaataaaataatattatccatacagacttccactttttccctctacaataaatctcagacattttaaaatgtgagttcatatgtatccatcacctttcttaatagcagcattttatttcatatcagtttaccaatttagccagtaccctacacagacatttctttttttccccaagttttttttttttttttgctgcaaaattaaaatacataatgctgtaatagacatccttacacataggtagaaaaaacttgtagaagtgaaattaccaagacaaaggctatgtaaacttagcattttcaaaattaaggtcaaagcgctctccaaaaactttacaagaatttaccctcccattaacagcatataaaaaaaaaaaaaaaagaaaaagaaaaacaacctaggcttttttacacttgcttctcccaactctctctgtctaggcttgtcccagggcagaaggtacaatccagtcatactaataactgatttaaagggtcaccattcagcatttagccataattcatgatagttccttgtagttatcttctgttgttgcttagtctgaaaccataaacaacgctggaggtcaaaaagttcctgcttgtcctaggttaggtatatcaagttcctctagttgaaggtcccttaactatgtaggaagagctcccccacccctaaaagaaaaaagcaaaagtaaaccaaaccaatcacagataaactgagtcaagtcatcttgtatgtactgaatgtttttctgcgttaggctcagcactagggggcttttcatacattatctattttaggttctacgtatttttgaggaagccccccagattgccgaattatacctgggaaaacgagaactggtgtcccaccccccacccaccgcatccaatgaagtgctgctttcaatcagcaaaaacaggccatcccactatcagccagaaatccctattaacagccgtttctgagataactgatgttctccgtgtgactctgaggcttggtgagatatttaagtgtcttttaagtcattagaagagataaatatgtgttcagtatagttgtggtgtcaagtatattttgttgtatttgaattctataaaaatctgttgtggaaaagtggtctattgggtattcccagattaaatagaatgttgaactaaccagaatacgtcactcttctagctgcctgggggtttactgcacttaagataaactgggatttaccatattactcagccctgatcttggcatcataaatcttctcttcacttcactctcactgtcacactgagcgaaagaatagaggccccctctcccaggataaaaaaatgtgaaaaagggtaatttcccatcattctccctaaaaagaatcccatgtaagactgttgaatccaccctaaataataatctccaaattaacaattaccaccctgagatgagagcaaataaaaaattggattggaatgcagagcttgacaaaatgattccatgccacgggacattctctgtgatttgcgaatacaaatgatagcccattctttatttaaaacatcttttctaaggtcaggtttttgaaacttaatctacatcttctctctaaattaataaggttagatcccaagtacaaaggaatgtcccatgaagtatcagaagctggacaccaatagtattgtgagatataagtcaacatttaaagtccacttttcactttcagatggcagggacacaactgccacccagcccatgctccctgcaagggaagaagggattctcccttcctgagggtcaagcccctggagattgttctcaaccctagaaaccatgggcctgccccagtaagtgaaagtcttattttactttatttattttttaaaattttactttaagttctgggatacatgtgcaccatgtacaggcttgtgacataggtaaacgtgtgccatggtggtttgctgcacctatcaaccatcacctaggtattaagccccacatgcattagctatttgtcctgatgctctccctctcctcgcccaccctcaacaggctccagtgtgttgttcccctccctgtgtccatgtgttctcattgttcagctcccatttataagtgagaacatgcagtgtttggttttctgttcctgtgttagtttgctgaggatgatggcttccagcttcatctatgtccctgcaaaggacatgatcttattcctttttatggctgcatagtattccatgatgtacatgtaccacattttctttatccagtctatcattgaggggcatttgggttggctccatgtctttgcgattgtgaatagtactgcaataaacatacatgtgcatgtatctttataacagaatgatttatattcctttgggtatatacccagtaatgggattgatggctcaaatggtatttctggttctagatccttgaggaatcgctatactatcttccacaatggttcaactaatttacattcccaccaacagtgtaaaagcattcctatttctccacagccttgccagcatctgttgttttttgaagtctttattttatttatttttattttagcaactataataacttggtcttctaaggacagacccatcttcaactgaattccacttctgaggcagaaaaaactttgtgagattccagtatattcaaaaacagttaatttgtattcagtagtgtcactaacctactcatatgaaaaaacactttgtgtgtatgaaatacatcacactttaagtagctgaggtgggtttctggtgaaatcactcattgtaggcatccatgcataagcagctgcttactgaagaagttaagccagccttggagttcaggataagccctaaaggtttctgatgtgttaagtggagattctgaaatctgtgccagagagtaggttttaggccggtgcatttgcaaatcactggaaaaagcagtgcatttgaaccccctcaggacagactgttgcatgtgattaattaatctctgaccaatcagaaataactaagcgttgaggctgaaatatgaaattaaaaaagaaaattggcctagtcttcatttcttttgcattattaaaaaataacctacaaatacgtttgttacatttaaatcatctacagcctgagtgcctccttccttcatttgacaaactactcattgaactactatgtgcagggtgctcacctagggcttgggagcactgtcgggactatgacaggcatggtccctgctttcatggatctcaaagaataaacaagcacagcattgactgtatagaaatattcagagaattaaagtagggtgataggagagggaatgattgggtgttccaggggagcctctcaaaggaagtgacatttaagctgagatttgaaaggcaagaaggagccagccctgggaaagttaggggcagtacaatgtaggcagaagtcacaagtagtggaagatcccaaggagggagcaacctgatgtgtttggaggatcaggaagtcagttcgagtggcccacaagcaatgggggagtgtgcagttggtgagagctgaggcttgagaatcagtgcgaaggcagtgtaagattttggaaatcagatcgagagcctggatattattctaggatgacgggaagtatttggggtgataagacaagctaaaaagcatggcccatacatcttttccacaaagaccccaaactagagagatggccaacaagatggcaggtgtcctgaggtgcacgtctatcccttggtgcccctcacccaaagagccagactcttgaaagcactgatggcagctggctccttggaatgacatcaccaggggataccacggccacagcacttgccattgcatcagctccaacctggtcaagacctacatcatcaagacctcctccttcacccctgccccagcatccagacttaatacagcttctcactcctccccagaaatgcttccctgtctacttctgcattttcaatacacagaagggttttgtccccaagcactgacagattccatacttctgtgtaactaattttggccaaaaatattttcaatatctttgaaattctgaatgcgtttcatcaaggaaacaagggtaatcaattctacagccatacttgtttcatgtatgaagagaaaaactcccaaataacaccccgtgatgaaatgtcacactcaaccattaaagacctatttttagcaaagtcaaccgctgagttctcagccaaatgaaaggtcatgtgttatctgagaagcacatgttactgtggtcatcaaattgctaatctggggcaaggtattccatggaagatgcctgttatgaaaggagagtgtactgtagtgattactgctattcagaaatgaggatcaatctacaaaaatgataaggagaacatgaacttaacaactacatttcaaatgatgttttaaacatgtccattaaagtgacatttgtgtgtgtctgtgtgtgagtgtgtgtgttaagaactcttaacatgagatttgcttattctttattcctgttgaagggcaactccccatttctctcttcccctaggccctgacaaccaccactgtgttctcggcttctgtgaatttggctactgtagatgctcatataagtggaatcatgcagtatttgtccttctgtgactggtttatttcactgagcatgatgtcctcaagaatcatccatgtagttgcatatgaaaatattcttaaggcggagtagtatgtatgtgtgtgtgtgtgtgtgtgtgtgtgtgtatacacacacacacatacaaatacacacacacatatatatacacatacatatatatacacacacacacacattttccgtatccatgcatctgtgaaatgacattccttgatatatattattagtggacaaaaatgtgccctgaggtttcagtatggtggtccatatatcaaacatatggttctaaaatgatatcatcacatctagcatggtattgaaaagactgatgtagatttatttcctcactagtatgaccttaagcaagatatattatattcctaaatcttggttcttcatctgtaaaaaataaaaataatcatattcatctttcacagggctgctgtgatgattaaatgagataaaccacacaacacagcatatgacatagtcactgatattcaatacatatgagttcccttttcctttagctctctgctcccacagtaatccaaatttttggcaagctaatagtttttatttttcgatacagttattagcaccatccaatcccatataaaccacaaacaggctggaatttttgtctatttgtttgatgctgaagcagaaaagtgtctgccagatagtaggtgctcaataaatagccattgaatgaaatgaatgaatgggaagttacactggaatgaggctgaatgtgaaggtcagtcaaatatcttagcagaattattggatatgtttttaatggaagagatacatttttaaacttttttctttttttttttttgagatggagtctcactctattgtccaggctggagtgcagtggcatgatctcggctcactgcaacctctgccccacaggattcaagcaattctcctgcctcagtctccctagtagctgggattacaggcgtgcgctaccacgcccagctaatttttgtatttttagtagagacgggatttcaccatgttggccaggctgtaataatatagtgattattatagtatactctatactgtagcatagagattgaggttggcacatctcacatatgactatgaatacccaatcattatgcttatgaactacaaaaaaatcagcagataacttacaagtgcagccatgttacaaaataattaagtataaaaaccatctaataaagacagcagtggtcccactaaactctgtgatattttaaccataaacaaagcattaatgggaaaagtctgatcccaagggttcctggatcagcagtaggtcagtgatacccaggagagcaggaaccatggcgtataaggcttgccttggactcagcttcaggatctgagagtcggcctggggaagtcctggtaacctgcaaggtcacctctatagaagagccagtggtggcaggcatcgcctctccagctcttccagcttattttcccatgatagtgcagtgatatatcattttagaattatgattctagaattatgtagtcacatggagggggcatacccaacatcacagtggatggaaatcgaccagagtgaccccagaacaccaagaaaacatcatagtggggatggaaacctcccttgctcacaaagctggggattgggagctaactctgccaccaacaagctgtgtagctttgggtaagtcattgaatcttggtccagcaggccttggtttcatcatctgtcatttatcaatacaggccgctttcatctctatctcctcacttcagaagtcccatgcctggactgtggcggccctggctggtatcccttcccatgccttgctgttttggaaaagttacatgtgtagaaactacagatggtagtaggggagacaataaggaagaaaaagtcactccttcaccttcttttaaagtactatgctcacaactgctcacatctggcacacttcaatagcaatcacttgcaaggtccaaaaatcttgaaccatgaaagtgaaagaaggagctttatcttcaaaaggaaaattaaagacctggagaggaccacttgggacctttttattacacctagataatggcaggtattattgctctatgcagcagtatgtttttatgaatagactaacacacacccttaggctgtaaaatagtgctttaggatataacatgttgattcagatacaaaataaaatactgtttgtattgtaggcttttaatgaaaagtctaaaaacacacctatttaacaaacctctatttttatagggcctgcctaaaaaagcctgctttaaaaaaaatctaagtatgggtggtctcacacctagaagtggcacaagaatcctttgtcagacgacgtgtcttaatttttgccatggaaaatgtggtcaccataattatagcccagagaaaataaaaggtttttaaaattccatgcaggaggggaataagagtttgttagcattcaataaaactataatttaaccagcttttaggtacagcggaatcagcagttaaattacagcactggacaattctctattttaccttgtggctatttgtcgaagtgtcttatttcctcttggagacctaagctccttgggaacaaatgccaagttatctgtatccctgtaacctctaccagacctggtacacggtttgttttttgtgttcaatgaaccacaaagaatctttcaggaaaaatcacttgagaaatatttcagagtaagaggaaatcaatgcataacttgttaaaaactattttcttaggctgaaagatatttcaaatacacattttaaaaggttcatttatggaaaaagttcagttgtgcaggctctgaaatgagatttagccaagaaaagcatcaatactaattaagtattgataaagaaggaggggggagtttagctaggtaacttagtcacttggttactaaaaccttcttctcgatggaaagaaaccattagagattgagcgactcatattgaaggaggagctataatgcaatcgtttctctctatgtatggtcttttttttggctttgaaataaaagggtcaaaggtaaatgagcctattgaaaattaatgagagctgaacgctgcatgctgttaatatgctcacttaactcaggcatcaagaaagaaccgtgcggccctttatcatacgggataaaatacaaaagcctttatatacaatttttgtttgtcaattaaaaataactaaataaaaattttaaaaacttttttaaataaaagctttccaggaaggttgggcgcagaaggacctgaagtttcctgcacatggaaacatcatagttatgagtttttctcagcttggatttcctgtatttctcagatttcttaactccacagtgcaacttactttccctctaaccatgaatatgcatcaatcagaaattccaatattttagcatctgaactccatcttcctaactgcatctcatcatcagaagtagccaaaaaaaggtcttcttcaaatctatcttcttcacgttttgatttcttgcaacagaaataggatgacgataaatacaggtgagagaaaataatgttttcccgaaataggtaagaaagttatggcttgttgacatgtggctgccaaacacacatgggtggaaatcgatttgaagggtttgggtctgtgtaaagatgctgcatgaccttcagagtccaacccggctaagcgccccctgccacttcctagctgtgtgaccactgacaaatcgttcactttctttgagctgctgtctcctggtctgaaaatggagcaaatgctcgtacctgctacaggtgttcagggctcagacagtgcaagtcacaagcttatagcagcaccgtgtctgtcatgtggtgagaacccactacatggtggctatttctggtgtcatcttctgcagcaatttgtcctgcttgaattgtgcagaatgcaatcaaatgccaaactcttcttgcattttcagtgacaatcctctggtgacagctacctcagaggacggtgtctgtgaggcgccagtcactcctacagttgactcccccatgtccacgtctgctcaatcaggggaacggtcacagcaggaacagaaaagggaagggagagaggaaaggagggagggaaaaagggagagaaaggaggaagaaaggaagaaggaagtgagggaggaggaagctttcataagatgatgtaatattcaatttcccatcctcattctttgccaatcgtcaccaaatattttgaattcaaatgaaaagcatgttagtcagacattgaggggtgaacctgtcccctgtgagagagcatagttttgttggcaaatgggagtggagagtagaaaagaaatataaaacaaacagagactccagttaaactgatctgtcttcctcagtctggtgtgggattttctccattgaaaatttctgtttcttaatattgtatcataaggtggattttatttgagcttttcaggttatttggtctttcttttgtaagaaagtagtttatttgttttcacaacaaagcagagtggcttctggttgaggaaggagagaactatgagttgaaggaagacggttttgcatgactatgctatgcccctgtatacgcaaagatgtagagacacacacacacagacatacacacacacacacacacagagacacacacagacacacacaaacacacacagacacacactgacatagagacacacacacagacacacactgacacagagacacacatagacacagagacacacacagacacacactgacacagacacagagacacacacacagacacagagacacacacagacacacactgacatagacacacacagacacccattgacacacagacacacatagacacagagacacacacagacacacactgacacacagacacagagacacacacagacacacactgacagagacacacacagacacacattgacacacagacacacatagacacagacacacattgacacacagacacacatagacacagacacacattgacacacagacacatagacacagagacacacacacagacacacactgacacacagacacagagacacacacacagacatacacagacacacacagacacaaagacacaacagacacagacacacacactgacacacagagacacacacacacagacacacacagacacagggacacacacagacacacactgacacagagacacacagacacagagacacagacacacactgacacagagacacacagacacacagacatacacagacacacatagacacagagacacacacaaagacacacagtgacacacagacacagagacacacacacagacatatacagacacacacagacacagagacacacactgacacagagacacacacagacacacactgacacacagacacagagacacccacagacatacacagacacacacagacacacactgacatacagacacagacatacaaaagacacacacactacacaacacatgcacacatagagacacacaaatgcacacacacaacacacacacagacccatgtacaggcacagacacagagacgcagacacacacaccacacacatcacatagacacatacacagacacgcacaacacacagacacacacaacacacacactacacaacacatgcacacagaaacacacagacaaatgcacacacacaacacacacagacacatgcacagacacagagacacacacatatactacacaacatgcacacacaagacacacaggcacacagacacagagacacacacaacacacacagacatgcatagacacacacaacacacacagccataaacatacaaacactacacaacataggcacatacacagagacacacgcagacaaatgcacatagacaacacacacagagacacatgcatacacagacacagagacacacacaacacacagacacatgcacagacccacacacacagataccacacaacacacacacagatacagacacaacatagacacacatacaacacatgcacagacacatacacagagacacacacatacacgcagacacatgtacacagacatacacacaggtacagacacgcagacacactacatatgcacagacacacagacactggcacagaaacacatggagatgacacagacataaacacacagacgcacacgtatacaccatagtgaggctcatcccacttctgtgctgtgagtggcataatctcttatttcctttttcaatcaagaaaccctgacatttccaaccaccacacatggggtaaatacggtagcacggaccaaaaccgtaacaaacaaaacaacgcgcacacatgcacacacacacacgcacacacacacacacgaaggatattttcaagcaagccagtctctcatgaacttttcaaggctcagctcgtaaccttagttccagacgtatacctctgactgtttccaacatgttcctgttttgtttgtttgggtttacttgccttcgttctgcaggaagccctcacagatatgacagggtgatttaattctgcacaaacctcgcctccctcagttcttagaatgaagatagataccactaccggtattcttagagttagacttacacagcctcccacaccaaacagagtgaagcagaacccacatttcactggaatccttacttttaggtatttgcaggtttttctttatgacacaggaaaccaaatatgaggtaccattgcagatagtaataaatgggcttctaaaatgttcccagtggctggcagaacaataactgatttatatcccaaaaggggcaatacatctgaccccttacactttgtaaaggaaaggaagattctagacactcttttgtcaggtgttcaaatttattcaggacaacagattgtcaaagccatctttgaagggactggcaaaagtttctccctacactcccgcgtataagacagtcaagagccaaaaatgatagagttggcagtgggccatgggatgggaaaacaaatcaagctttattttttgttttgttttcttttagagccagggtcttgctctatcactcaggctggagtgcaatggtgcaacatagctcaacacgggtgggagaaaactcatcaactcctgggaaaaagtgattctcccacctcagtttcccaaatagctgggacacgcctggttaattttttaatatttttatagagatggggtctcgctaggttgcctaggctggtcttgaactcctgggctcaagtgatcctcccacctcagccttccaaagtgctgagatacaggcatgagccactgcgcctgggccaaattgagctttgaatgaaggggtccattcctatggagctaatgaatccgctgcatcctcagctccagcaggcacgggatgtttgaaacaagccaggcataacctgcaccaaatgggcaatgtgcaggcagcattacggagcagaagtcaagtgacaggctggggggtccacggtcttgatgatttctgctcctgctgctacgctgatagccagtttactgacgtacacatagagaccactcttaaccgcaggctgaattgtccctaccaagctatctgcaccttgagcatataacaaaccattgtgagaaaagttaaatttttttcacccaattctgacatttaagactttctgtaagatggccaaaatgtcttaagacccaaattcctgaaagtctttcaaaagacgctagtcaattcatccttataaccctcccttttcccaccgcccctaatagaaagtaccttgggggaatctcctttggttaatacataagtaaattaaggagatgactttccatgattttacggaatcagtgactcttaaataaatctctttaaaaaggaaataaatgtgtcttcatagtagaaggatttatgcacatgtatgtttgttgtggcactattcacaatagcgacgacttggaaccaacccaaatgtccatcaataatagactggataaagaaactgtggcacatatacaccatggaatactatgcagctctaaaaaaggatgagttcatgtcctttgcaggaacatgaatgaaactggaaaccatcattctcagcaaactatcacaagaacagaaaacctaacaccacatgttctcactcgtaagtaggagttgaacaatgagaacaacatgaacctagggaggagaacatcacacactggggcctgttagggggtgggggtctaggggagggatagcattaggagaaatacctaatgtatgtgacagggtgatgagtgcagcaaaccaccatggcacgtgtatacctatgtaagaagcctgcacgttctgcacatgtaccccagaaattaaagtataataataataataaattctacaatgaaaaaaaggaaataaatgtattcctttggctgggcacagtgtctcatgcctgtaatcccagcacttggagaggccgaagcaggcggatcacttgaggtcaggagtttctgaccagcctggcgaacatggtgaaaccctgtctctactaaaaatacaaaaattagccaggcatggtggtgcatgcctgtaatcccaggtacttgggtgcctgaggcaggagaatcacttgaactcaggaggcggaggttgcagtgagacgagatcgggccactgcactccagcctgggcgacagagcaagactcagtctcaaaaaaaataaaatattcctacattcacataacatttgttagaatactggcagcacaattttatgacaactacttcactaagatttagaagacctggtctgactcagaacaactgaggccacttacctaacctgtctgtacctctgttaactcattcctaaaatggtgaggcctggacaagacggtttgtaagataattttcagctctaacattttgtgactatatatttatgcagattctacttgtaaaagacacgctgttagatgccacagagacaaacatgcaaagacatgatctgtacctcgttctgtttacagtattattgcttggctgtatttccaaacttccatcataggctactttgattaggcatcaaatttctatctttctttaactctctttgatgtttagaggttcttagacaaatggggatcagtaccatatgcacaggctttgcctaaacatctttatattcaccttcactctgtgtgtcttgtgcagccatggttttcttggcacccaacaccatcaggggctctctaaacaaggactatgttggcctgccctgctgtgtcttgggaattctataatatagcttaattcttgcccccggagtggatttcttctcctctcttctccctcaagaacaagcgtcctggcctacagcctgcagcctggggactggcgacctgcttgaaaatctgtgcatgtcggacctgtcagcatccaggctggggaaaacaggctgcccttgagcagaacagctttgctaatcaatcacgcttcaggaaagtgggtggtttgtatgtgaggcccactttgccaggaccaagccccttacgaaaacgtctgagtgtgaattaaaagaaagaaaacagtctaccttctgcatccattgcgggagggccagacaaggttttatttaaaaaaactcctcttttctgaagtctgaaagcaagaccctgggcttaaagagaattcctccgtcaagatttactagaggctatgatcaggagatggagctctcaacctggatgccaatgacatgtgtaaaacaagagaaaacttcagggaggttccccacctattcagaaattagaaattaactacttatatatttttaaaaagagcctcctgaggtgatatcatatatgattgtgattgtactagcaaagcaattagcaagttgagcacatgtatatctttagaagctaagccagatacaagatacaagtccctactagtaagatgcgattaatgggacaacgtcaagtttattgtcacagggctgggtatatattctggctattacttgttagttggggcaagttaggtaacttctctaagcctttaaatacattcatacatatgcacacgcacacacacacacacatacacacacataatggggccaattatactttcaactcatagaattgttctgagaattgagatactaaaagcaaactaagtgtttctatgctgtaaacacaacagaaatgtaaagtattgttataacagacatacttgtatttcttcaaataatgtacacattactttactcaaaattatttgatttctattctagctttcatgttttttgttattttaggagtgagtttctaattaattcagtttatatgcatttcctatctaaagtcttttcacattttcaaagctcctgcacgagtgacagaaaaacacaagcttaaaatatctagagaaacagcaccacagaaataggatagatagataattgagaaggcatctgccctctatccagcacagggtcagtactacttctggtacttaccctgctcacatatgaactgactaatatacaagattatctattggagcattatctgcaataccaaaagactggaaataaacaggtgtccatcatcaggggctggttaattactccatgggtagtaaatagttacataatgacatctaatgaatttctcatcctgaaattgcttccacattgactctgggcttggccccatgacctgcttttgccaatggaacattaaccaatgggattcaagtagaagcttaataaaacctccacagcggggccaacccctctctgtttttgtgggacccagtcgccatatgaagcagctggggctggtttactcaaggcacatattccaactgaggtcagactctcccaacaacctgctagtgaggccatcttagaccatctagccccaaataatcacatccatatgaacaaatccaggcaaaagcagcagtaaaaaacccttggcagatctcaggccaaatagttcacccatagaattatgactaataaaagggttgttgttttaaaccactatgttatggagtaatctgttatgcagctaattgataactggcacactctgatatctccaaaacgatgcaatactaggaagtattatactacctaggaagaaaggaaaagcatgcattctatgtactgacatggtacatctcaagatgtaccatgataagatcttacatggtaaaatctcaagatatactgttaaattaacagggcaaacagtaagctgccttttgtgtaagaaagggaaaattttaaaatgtgtatatgttattttgcatggatgggcgctggatatatactcaagaaattaatagacaatggttccttattctgatggaagagcgagtagtgaattgggtggatggggacggaggtgctagcgagactttccaataaacacctttctaaactgttccagtataggaaccatgtgactaatacctatgcaaataagtattttgaaaaagggaaaaataaggctaatacaagatagaaatgacaaagcttgaaaaagttgaatttcaaactgacgattataattctgctatgcaaccatccttcatcaacaacagccttcctttgaaccggaataatcgtttctttgtaacacatatgattatttgtacacctggctgtcttccctgctagattgtaagtgctttaaaagcagggaccatatctcatgcatctttgtctcttcagcaagtggcaagcatcttgccgggcacagaagaaagccttgctcaataactgtttgttgagtcaaaaaaataaacaaaaacattcggacctcactaacagtgtctgttgttaatgctgatgagttcaataaaatcttcaacagcctagcttctatctgtacacatcctccacacaccatctttcaggaaaatggtgagcattcctcatgatctgggctcatgaatgtactctgaactactggggagagtatatacaaaagctaaattcgaacactacgaaaagaaaaatgcaaaacaacctcctctatttaaaaaaacaacaacatttgactagagggggtctagaaaaagaaaagaagaaggatcttttattatttctcataagtaacacatttgactactgtggttggaataagcagccccgctcccaccccctgcttgcaaagcaaactaagccacccgaataagtggaccatggggatatagaggcagaaaactcccggccccatccccaggcctccagagaatttgacactcaagccacggtggagaggttttctgttatgagtttagcatttctaagaaagaggagaccacaggctttccctgtagtccatttcaagagtctgatagctctcactggaaatcttcacttcctttgaacttgtaccttcctgctgtgcctcaggcctctccctcttctgagagttcttgtctccatgtctgatccctgtgaaagtgcaggcatttaaggaggaggtctgggcccccttcacggtggtgtccacacctctcccagggggatgtgctcggtaagtgtgcatgcagcaccatctcagccctgtgcatcctggaccgcaccaacaaacagcaccacacagcttggggaccatgtccagattcacacgcagacgataagcaccgtggccaatacccaagcgttagataattaaaggtccctccaaggataaacacaagtaagagtggaagcaaaggaagtgcacacgcttgtctcaagaaagacagggcatgtagccttttccctaggatctctcatcatcttcgcttctctttctcacatcaaatgatgccaattctttaactttcctaggttccatttcccaatgctttcatcagtttcactgtcttctgcgaggctgaatttccctaattaagggcagtgggagacgctccacatttggagtccctgtgaggcagcaaagatggagagctgagactgaccatccagaatccaggtgtgccttcgccacacagaacaacaagcatcgttgatgcctctagtaagtgccaggtgttgggttagatgctgttggagatataaaaggtggagacatcatctctgtcacttaatgagagtgacactgatcggacaggatttaaagaaggggactctggtgtgggtgggaagagcacagtgggagggttggggcaggggcacggccttgggactagagtaggtggaggcagtggggcggggaggaggaaaagaaggaaggaagaggccggtcagaggaagcccaaaagtggattcctggacacacagtaaaaaggggaggacgacttaaagacggtttccagatgtgggggtctggggagaagggaagcttttacagctgctgacagaggctgacagatgcagagagggctcgtggtgagctggctgaattcggggtaaacaagaggagatttcatgcttcacctcagatgaggaaataggactaggaatacagttttatgattgaagccgtgacagaaaagcctttccaaaggagcacagtggaggagagaactggagaagaggcacggagaccgccaagcgttccaggtgcaggcggcaggagggagcccaggatgccggcagagcgagccttggtctgtgaaccccagggccgatgggcaccggctcatctaattcatttgtgtacagatccacaaaactgcacctggctgtggccgtcagtaagtgctatataaatgcttcataagtgtttgttgaaggaagttgaaatgtagtcgtcagaagagtgagagggaaaccagcgacagagccttgtaagtctaagaaaaagaattcaaagatggtcaagagctaacattgcacagggaattacagtatttccggaagaccaagggcaactctgattgttccagactgcctgggagcaccagagtctgattgttccagactgcctgggagcaccagagtctgattgttccagactgcctgggagcaccagaggtctgggtgggggcaggagtcagtccacctggaacttctgcctccagtgcactgagtctgcacggaccaccagggctgacactgccttacttaatatgggggtgggggaagtccctgcgatatataatggtctcaatttaaattctgtgctgtttttattttagctgtgtaatttggaaacttcaaataaaaagcctgaaaggaaagttggactatttaagcttacacagactctattaatgctatatggttattctacccctgactttggaagaaggagaaactggcatgggaatacacttttctaaaaaaaatactatttaaaaatatgaaagtttatttaacatctaaggaaaggtacttaattagagggacactcaacaagaagaattgaggatctaagtaaatagtccccatctgctcctggtcctaccacctggcgattacttcctcttcttctctgatagattttagccaaccaattttgttttatttgtgcaagttgagaggccacctgttatggaatatacttccacattaaacaaagtgaacatttcctatttctgtgcttcccatatgatttttaaaacacaaagcactcactttcaccttaaacagatttaagaaatgctgactctgatgaacaggtataaacaaggcaatcttttgtttatgaaaattgttaacgacctacccacagaaagacatgccctgcgccacactgtaccccccacccccgcccacccggctccccgatgctggtgaattaatctatccacacgtttttgctcatttccctggctgttaccagctgaagtgaagaaaagacattttacaaggggacatggtatatttgtgctaaaacaggcaccacacaaatccagagaaaggagccaaaaggaaataccaggcagagggaacagcgtggataaaggcaaagctgagaagagggtaagtgtttcgtgttgggggatggtgtatctgggggctggggggagtggggtacagtgtattgggttgaggatttatagccaggaaaactggaaataaaggggaaggagactttgtgaagggttttaactatcgggctaaggaaagctgcattgttcctaacaactgggcaccagtggaagtttagagccaggaatataattgtcacagaggtgctttggactgaataatactgtggctgtaggcagctctgggttgggggttgggaggtacaagcctccaggaatccactgcagcagtgtgggccctgccacgttgtcctgaacaaagtgctatggggatggacacaaacatgaagtgaaaactccagagatcacctgacctccacgtgccactgctctgactgctggaccacagtgatgtttggggtctcctggaattagtgtcagctcagagccagtcaccagtagtccccaaaaggtctgattaattccttttccccagtgcacagtcaccctggcaaaaggctataggtccctttggggaaggctgggagaaaaagcaacagtattaattcttgacagtgtggtagggtccttcgtcaaggagacccggcctcctcttcattcaagggcttctgggtcggtaaattggtgcaagtgtgtgaattgatcgaggggccgtgactctctgttttcagggtgcaagttgggcttttgttcccttcacctagaactcctccacttatacagaccaagtaagggtttagtagatgtccgcctatgtcatttctaggaacgccatgaggacagggttggaagtgggggaaatgaagtgttagtctgtgtacggatacaaagaaagtgagatgatggaactgaagatgactaagatgtggggagccaggactagtggttcccattggcaggtggtctcctaactggcaatgctagggagaagtgtataaatcctcaacccaatacactgtacccaatacactgttagtggcggagggagaggcagagcttggtttgaaatggtgggggattctccaaggtggcatggacatacaggatggaaatgggagacgtgtcaggcctggagatatgggttttggaacaacctgcattaaaattggaaggattagagagagtaggtgagatctccgagacagaggaaacagagcgaggaagctaagacctaggctggggcaaatgtctgaatttacctgagtgggggaagacagagaagctggcatgttggacagagatgactggtcaccaagacagaaggaagaatcaggccgtttaacaggatcaagagggtctagtgtttaaagagagatctttccaactgctacaggaaagtaaaatgttatggctccagacacctgctgaaattggtgcatgatcccctcaaagacagtgtttccttaaaaacctgggaaaagaagagcccctggtgtggtggagggtggcagtagggacagttgggagtgaagctgtgcagtcaggaagaaaccatccagcttgaggaagctaaagacatggggaggagacacagtgcagaccaaaggagcagccaagctaaaggcaacttttttctaggacttcggggtcctaagtaaacttgtgggcagtgaacatgctggaagtgtctggactgttcaggtggagaacaggcagtacaagggacgaaaagcaaatgtccagatggcgattagtggaggccttgggggtggaagatctcagggctcacccctgtggttatcatcttagtgagggggctagtgtggacttcaggcccaaggaagaataatattttattctttacaaaatagtgcatgaaagattagctctgagtctttataatcttatcattggcttcaaatttcaatcccatattatactttccaagtatattttgttaaaatttccttaattcataatattctaatcagcaatgagtttctatccacatgtctatgagcacatatattaatttaaaaatctgcattgctcttgtatgaatgaaatataaagaaactgaacttctaacgaatgaaagacgctggatgaaaagataatattttatctgagtttcagttcagtcatatgtctgagaatgagtttatctagcccataagccttctgctttcctttcagttcttttttttccactgccattcataggttttttaaagatctttccattcacttctgcaggactctgctaaataatgctggttgcttgcagcttagccctaccctggagatgtggctcctcctggcagtcctggcgacccacactttggaccccattcaccatctcattgttctgtgacccacttctgacttctccagcccttttctttatttcatttcacctaagcccaaatagcaagtctcacgctcaaatcctgctctgtccttgctttccgccctgaatctgtccatttgtccttttgcagcttttatttcttcccatctttttcttttcatttctttttttttttttttttttttttttgagacagagtctcactctgtcacccaggctggagtgcagtggtgcgatcttggctcactgcaaccaccacctcctgggttccagcgattctcccgagtagctgggactacaggtgggcatcaccacacccagctaatttttgtattttcagtagagacgggatttcactatgttggccaggctggtctcaaactcctgacctcaagtgacctgcctgtctcagcctcccaaggtgctgggattccaggtgtgacccaccgcgcctggccatatttatttccatctttccaaagactgcagaaatctgccacttgagagaggctggccttgttttctctcgactcaaatctcctcctggttttctaagctcatgaaaatctctatgtgacatttttttatttgcagttttaagctatctatatatttttaagtcttcacctttaaaccttcactgacttccctttgcaggtgcactgtcattttggtaactcaacactgtctgcattttattttggtgcatgggcggggggctctggcttcgatttagtccttcagacacatacagtgaaataaataggtactcgacgatagtatgtgttgttgctgtgtagttcttttgctcctgaacagcaaataccattggacttggcattgtcctactgtggctgcaagctgtgtctcaccacagctaacgccagtgcagaggagccatgccacgcaaaggtcccctgcggcagcaccagcctgaagctcttcagtcatgaaaatcagggaacacgtcattgatgactgtcctggtcctggcacaggttttaccaaaatgcaatcaggtttcgccagaaatgcagtcatgtgactcctttcttctctgagggaggatggtgttcatgaatgcaatggtagcatatgacatttttagttgcccctaaccatgtggccctaaaaatactccatttaggtcaggtgtggtggctcacgcctgtaatcccagcactttgggaggctgaggcaggtggatcacaaggtcaggagttcgagaccatcctggccaacatggtgaaaccccgtctctactaaaaatacaaaaattagctgggcgtggtggcgggcgcctgtagtcccagctactcgggaggctgaggcgagacagaattgcttgaacccaggaggcagaggttgcagtgagccaagagcatgccactgcactccagcctgggcgacagagcgagactctgtctcaaacaaacaaacaaacaacaacaacaaaaaaaacacaaaaaaactccatttagtagctttgaaaattccaagtttcctttaaagaagggaggtaaggaaggaaattatgatgcatttaacagccacgtgaagtagacagtctcattttagagatcagaaaaccaagggtagagagtgagtatcacaataggtggccacaagccacagtgggaactcagggagcttaggtcaggattccaagctttctcaaataaaagttgctaccttggccgggtgcggtggctcacaactgtaatcccagcactttgggagatccaggcgggcggatcacgaggtcaggagttcgagagcagcctggccaacatggtgaaatcctgtctctactaaaaatataaaaaattagccagtcacagtggcacatgcctgtagtcccagttactcaggaggctgaggcaggagaatcacttgaacccagaaggcggaggttgcagtgagccgagatcacactgctgcactccagcctgggcaacggagcgagactctgtctcaaaaaacaaaaaaaaagttgctacctttacacaaaggatgaaaaagtaggaaagagactgcaggaaaggaatgtgagagaggaaaaacataaagaaatttcaaatttgtgaatacacctttcccctaactcatgtgttgttcatgattaggactaagtgctgaagccagaggtgacccaaattcttaggagcagaggaggacagaggcaggcaggtaggccgattcctgctggttctctgtgttacttttgctcccataacctcccctacataggttggtttcagattctccaataaaaatgtatgttaaaactgtaaaaacaataaaacatgcaaatctcttccatttgcagccaattgttaccatgcaggtattcttcctggcaaatattcaaatgtcaccagcatcacgtgcttaatattattttagtcaatatgatttgtgtcaaaatcgcctgaattcagtgattgttggatctcattatcaccaatgtaggtcctcacaccacacccctcactgctgatgaactcacaagaaagacttcatactttaagaactagtattttcttagaaaaggaagaaaaaaagcagttctcagtaaaagataaaccacagagcaactgggttcagatgagttgtacacattaaaccacacacacacacacacataaacacacacacacacacacacacacacacacactatgaaaatgatgttgaggcattgtctaatccacaaatgtgagtaagttcataatttaggagttaaaacgagaaccctactcatgacttttcccggcactgagaatgcactgaagaatgatgaaatcacactccagattaccccatttgttctcctgacagctctgtggaccattatcatatagaggccctttgcttggtgagaccctgaccacttgacattctttctcagagcgggctggtcagagttctctcgacggcagaatctacagggcccacctcaacgcacaaggaagccccaggccctcagggacctctaggtcccaaaaaacagtgtcagataaagaaattaagagggggctgggagaagcactctgtcaaatagaaagcctatccacagaaaacttagggatgaacagagctaagatgggctgatgaccttgaagttgcagccaaaatgatgaggccaggtgggcttgctggccaagaaatgcaatctcaagagtgggccatggctgtgatgcccaagcctttttgtgataaagctaagaaatacgggagaaatggaagggagaggggcagaacagacaaggaagatgggaagcaagaaggacaggaagtgccagcagacaccagcagcagggacgagtgcagaaagtgtcagacaatccatgaattggaggaggacacccagtgaggagggaaaagggattggactgtgccaccatctctgtaggggaggtgagacaaacgtccggtgcagctcggaagatggcctggaaggcctaacccttccacctgcctgactcctgacaccacgacatacacagttatttttaaagtgtttaaaatataaaccacattcatgggaacttgaagtcaggtctcaccctgacatccatccatctgtgtattttcaaggttgactcaaatgttgaaaagtcacctgtgatgtgttgtaccatttgagcttttgacaaaaactataaagaagcaaattaaaccaggagggaaatttctagctgccacactaatcaaaaactgtcgggtaataaaaaaaaaaatcatgctaaaaataaaattacatttcgggccctaaggctcatttcttttcttttttatttatttatttatttatttatctatttttgagacatacgctcactctgtcacccaggctggagtggagtggcacgatcttggctcactgcaacctccgcctcctggtttcaagtgtttctcatgcctcagccccccaagtagctgggactacaggcatgtgccaccatgcccagctaatttttgtatttttagtaaatggggtttcaccatgttggccaggctggtctcaaactcctgacctcaagtgacccacctgcctctgcctcccaaaatgctgggattacagacgtgagccagtgtgcctggcctcctaaggctcatttctataaataatacttccccagaacccaactctagaaagcgataatcatcccttaatgaattctcttttatatatattattgtgatggtcatattattgccccatatttgtcttgatgttttggatttcaaatggacaaggcatcccaccctttcttgcaatttagaggcatcgtcccttggcaagatacagaaagacttgctggtagaaatacgaatcaccatgccatttagaaagcaatctggaaatgtctattccaatctaaaaatctattcttttcttaatcaagtcatctcacgtcctgtaagcacagaaatgtttattacagtattatttgtcatagctacattcaataattcatgctacagtcaatcaaggaatagtacgcagtcatgaaaaaacaaaagagggatttcagcaatctatcactgttaaatgagaaaaagaaagatgcataaagggacatatgatatgatctgatttgtataaaaaacaatcacaacatatatttgtgactacaaaacatttggtaagattgtagaagcataaagtatggaaggacacagacaaggctgatgccactggcaatctagaagagaggaattagagtggaaggagggaagggaatgagaggaaaaaagtaaataagtgaaaaatgaaagcaagtgtccatgataagaaccgcatgggtgctcctatctcatttatgggaaatcatgtgtgtggaggtgacataaacacatggtggtgagatggtccccaaaatatcaatggcttttatttcagggtggtgagattttttttaataaggtgaaatgtttttaaaaataatttttactttattttccttataggtactattggaaatatgtacaaccacatgaattatttacataatcagaaaaaattcattgagagagaaatatgaaaagtcttatgccaggcaatgtatgtccccagaggaggtgcaagcagggagatgaggttgtaaagttaatttagaacctgactaggagggttctaagtgctaggcaaagacaggagcctatcaacatattaacaatagggctgtggttttgtttgtttgtttgtttttggtggtgggttatgagtgatttttttttcttctgtttgcttttctctattttccggatttttctgcaaaaattctatcttgcttttgtaaccagaacaaaaatattatgtaaaaaataacacagtggaagtggaagtggataatcatcaaagtgctgacccccagcaaaagaaatgaaaatccatttatgaatcagtaacgtcaaggtgagtcagtaaggaccccagataaagaagaaacagcgaacactgaaaggaacataggaggccttaaatgttttctaaaaaaaaaaaaaaaaagaatgagtgaaactttgcttaggaagaactgctaaggctcagtggccctctgtaaagtttacactgatgtctgcaaaaacacattcaaccaaatgtcaaagctggttgataggatccaaaaattacagagaactgtaattgctttagagactggcctatttttaccatcaagtctttaagtacagctacatcttggaacccatatcaaggaaaggtacaataccaagggaaaaggcaatagaagtgatagaaaccacagaagtggaagacactgtgctaagatgatgtaaagagccttcctctgcacaggagagacgtgcaccactgaaagcactgcctcaaagaaacactgggattttgcacaccaaaaaaagattccaatgtgattctggcttgattcgttttgcagtgcagtcaacataacaaatctacgatccatgttaggataaattaatttaaaagtttctattcaattgtggttttccttcttctaacagttggcacattctgagaactgccttttgttagacacattcagggggaggatggtggcatcacgttgaagaaggcggcagcaggaggcttccaaaagaacctcccagcttcaagattctctgactcgagatgagacgccatgccaaccaccagattttatgctttctctctctcagatgctccaactgaggtagtttagtaaataaactgtgtttatgttctctagcattcctgaagcagatgtaatataactgaaggcaaacaattttagtaatgcaattcatgcattgccatctaaacaccacgtcatcatgaaactgaaatgtttaccaaataatcaaagcccaagacaaagaaaccgaaaggcattctgtaaggcaaagtaccagccagtacttccaataaaataatttattgagagttatcctggagtggcttgtcagaaaaagtcaatgtgacttggtttctaatcactaaaaggactgtcttgctgttattcccaatggtcaggaaaaaaatgaggagaaactgggtttgttttcatagagtagtagggttttcctaacagagtttcaggataggctggtcagaaggtaagcaacgttctccttccaatgatccccaatagttcacccacatttcccaaaagcatcaaatcttgtcttgacaacctggcaagtgctgaccgccaaatgacaggcctcctccttatgatgttgtgaaataagagtgaccatcctttgagttcagtcccagcttttccactaactggccacgtgtctgtgggcaaatggctttatcagtgttgagcctcagtttccttaagtaaaatgctaaggttagacaaagtgatctttagaaaccttttgatctctggcaatccatgaccctttacaatcaattccaggttttgtttactacgttctaggtttaacacaaaattagacgttgagtgttcactttaagcaaaatggcaaacaataggttagtcctatgggttccttgtactacgaagatgtgaaattcccaagaaaatgtcacagagttgagttcagaaaaatagaagaatggaaaaaaggaaggaagggagggatagagggaaggatagaaagataggccccagaacatgcagaaactgcctccaaggtcagtcagcatccttctctttctctgcatcggtggtgtgttttcttccgtcttccttcttgccttcacaacttctactcccataattctcagtatggccttttcatcaacccaattctctttctttcttcaaatgtggctcaagctcatgtcttttctgtctgacaccagcaagttctgatcttctgttctttctgagtcccctcttggtgtgccacctaactaacatgaaaccagcagcaagtctattggtaggaacagcccaggaaaaatgcccaccagatctcctaaaaccctcaatgtctctccctactggggcacagcagagaggtagagagaagggaaaagctccttcttccctttcttttttttctttcgttccttccctttttctttcaatttaatgttcattgaatatctcctttatgcaaagcattgttcaaagttctttcacatactatttcatcttatctctccacaacctccctggaaatccagagtcttggccaatcaaattctgatcctctctgtgtctctccaccaccatccactcatccccctccactcatcccatccactcatcccatcctccactcatccccatcctccagtcatccccatcctccactcatcccattctccactcatccccatcctccactcctccccatcctccactcatctccatcctccactcatccccctctactcatccccatcctccactcatccccatctactcatccccctccactcatccccatccactctgtcccttgggattgtgtttggttgttctctccaccttggcccttccttcaatcaactgccaattctgaatctcatttctggctcctttttcttctcctgcctttatatctctcctgaacacctaagcctcttcttaactggtctccctgcaaccaggttctcattctaaagcatgagttggttgatatcactgcactcatccaacactttatgtgactccattttctatataacataacctgagttccatcatttgacattaaaggacttctaacttccccaaaccaacatcattaaatcttatcttctgaacataccaggctttttctgattctccaaatatggcttgcaattttactcttgcaggtttttgtttgtgctgttcctaccatgtggaacagccttctctcacctcagtcctagagaaaaatcttatttttcaaacctagctcaagtgctacctcattcctccaagtcaaaagtgattgtcctttctcctgaactttctaaattttagtggcttatggttctaaagttgcctctaggtcacaaagttctggagggcagggatcttctctatttttctttgcattccaacaccatgtatcaaccacagcagaactttttttttttttttttttttttgagacggattctcgctctgtcgcccagggtagaacacagtggcacaatctcagctcactgcaacctctgcctccctggttcaagcaattctcctgtctcagcctcctcacgcagcactttttaagcgtaagcagaaatgaagttgctaaccctgataattaatttaccagccaccattgtcttccaagtgtgcctccgaatttaaaatctacaagcattgatgagggcctactatgtacaaagcactctggcaggagatgcaagggcaagtgagctcaggaacaatgatgtttataatgagccattttaaagacctacctcacctcactatgctaggccaccaaatacaccattatcatgaacacataatccagtttggggatcatcaatccttcagaagccttccttcctcactgaatatactagcggtaaaatccgtatgtttcaaaatgcacccaagaaaagtaggctcagaactccagaaatcggggcctttatttccttccagaagacagagtggttgataaagaagaatgaaggcatttgttactcagcagtactaatcttcaaatctacaatctagtttaacttcagttataatgcgcatttggagccatggaagtagctgaaaaaacaagaatgtctggaaaaactaaaaattttattacctgtaaagttgggctcgtggatgaaaacttttgtaagggatgataattttttgtttgaaagactggtatcaagagcagctgtgcaaatagttctgacgagctcaaggtgatctagaacataagttgaccgtctgtcccagcatgttagggaaagtcccaatttatacctgttgtccctgcacaattattaccattgccccctttcactctgaaaactgtcccagcttgcatgaaaaattttacaaccactgtatcagtgctattgtcagacaccagtagtttctccatacaacatcggtggtttgcataggtctaccagggagcagagaaatggggcagaatccaggcttcctgacaccaaactcaggctctatctaaaagaacatatttcctctaggtttttcgtcatcaactcatccacaggaaaacactttggaaaatggtaaagatatataagccatggtttctgcaagctagcacttacaatcttggggagatgaagcacatacatattcaacaattaaagaggatcagatgaattcatcatatggtgctaatgacatggttcaaatgacaatttcaaaaggagctagaaaaggtgaaaaaccctctaagagcttcagacttcagggaaggtttccggtaggtgatggatcctgaaagatgtcttcaaggagaaaaaaaaaaaggcgtttttctttgaaaaaataaaggtagaaaaacaaacaaactggcacagcaataagccacttaaataattcaacaagcattactactctgtattcaagaagagaaaaacacaacagcaagtcaagacaaacacaaatggtatatgtggcttttccaaaatgtctcagtgacttaaggctcaacaagcattggatcttggtgtcttgataacctggcaagtgctgtcagatgttcctccttgtgatgctgtgagataaaagtgaccactctttgaggtcagtcccaccttttccactaactggccacgtgtctgtgggcaagtggttttatcagtgttgaggctcagtttccttaagtaaaatgctagggttggacaacggatctttaaatgccttttgatctctggcaacccatgaccctttacaaccaattccaggtttgtttagtatgttccaggtttaacacaaaattagatgtgagtgttcattttcagcaaaatggcaaacaacaggttaatcatatgggtcccttcccactacaaggatgtgaaattcccaagaaaatatcacagagttaagtttgggggaaaaaaagggaaaaaaggaaggaaaagggggatagaggaagggagagaaacagaggccccagaaataaagataaaattgaagccagagcttttatgtaaggctgactacacagtgctcaaggaagtttcagactctcgcaaatgctcccgaagccctgggaatagtggtgagattctaatgcccatgcagggacatgaccttggtcttgcatgaggtagcggggccagaactgagcccctttcctaaatctcaaagcctcaaaaagtcaccctaaccatgaaaaggtggactaaagcactctgcccactgcctcagagataaagagcagaacattcccttgtatccctagctcaggacacctttgggaaatcagaaccttaagcatgaaccactttcagttgtaagatcggaatttatactacctgtgtatctgagtaggggaatcccatgacaataaattaatacaaacacagttctaggatcattgaaagtccttagatctccagaaaagacaaacatatgtccactatgtagaaacgatttcacaactcaggactcacaagattcctatagaaaagaggccgggcatggcagcacatgcctgtaatcccagcacttttggaggctgaggcaggcagatcacttgaggtcaggagttcaaaactagcctggccaacaaggctaaatcccatttcaatacaaaaattagccaggcatactggcatatgcctgtagtctcagctactagggagactgaggcaggagtaatatctgaacttgggaggcagaggtttcagtgagccgagatcgcaccactgcactccagcctgggcaactaagtgagactccacctcaaaaaaaaaaaaaaagaaaaagaaaaaagaaagaaagaaagaaaaaagaaacaaagaaaaggaaaaatatctgaggttgaactgccagtatcaccccccaacacacacacaaataaactgccatgagggacagtgataaagggaaaaaaaaaactttaaatcctaagaactggaaagatacaatctcaaatggagtacaaaataagattgtttaaaaatattatagtgataaagactaaaagccataaggagaaaattaggattacatgaaaaaaagagaataagcagatttgaaaaaataaagtagaactcctagtaatcactcaatggaaaggttagacagtagagtaacacaaaacaggccatcagtgaaccggaagacagccttgagaaaattaaaccaaaatgtaacacaggacttccaagcaaaaatggagaattgaacacactgtatctaatatggctttcacctgaaacgtcactgtaacgagggaagatgaccttttaaaagacataaaaccaccaggacaataggagaggagattttaaataccttttgatctctggcaatccatgacccttttacaaccaattccaggattgtttagtatgttgtaggtttaacaagtaacaagattttagaaataacagtaataagattttagaagacggaaagcagatggagaagcagtgatagaattaacagacaaaggaagctgaatcctcagtgaggagcaggaaagttaggaacaaccagtggatcctccaaaggctcaggaacagatagcaccggtgacctctggaactgtgcggaagggagatgagtcactaaaataagaagaacagggcagggcgtggtggctcacgcctgtaatcccagcactttgggaggccaacgtgggcggatcacgaggtcaggagattgagaccatcctggctaacaggtgaaaccccgtctctactaaaaatagaaaaagttagccgggcgtggtggcgggcacctgtagtcccagctacttgggaggctgaggcaggagcatggtgtgaacccgggaggcggagcttgcagtgagccaagatggcgtcactgcactccagcctgggcgacagagcaagactccgtttcaaaaaaaaaaaataaataaagaagaatgtgagggaaactgtttaagaatcagttagatccctggatcctttccttgaatccaccctgctaggcagcagcctttatcacaactgctaatactggaggtttgaactctgggagaggattttggaattgggagatgccacacatcaaataaaaggaaatatgcatgctgaaggctgaaccctccagtctcattcctcatctcagctcccagcctgggacaggcagggcggcatcttgcagccaggagtctggaagagtgttctctggagaatctgaccattccctggttttcccattaggagactttaggagttgttagcattaggagttctccaacctatgacagaaacattttattctacagtgatgctcagagttgacaagtccctcacgcatcctcagagctttcaatacatctgttattcattcttaaatatggtcagacaatcaggactgcccgacatgcaaggaaagtctctacaggaaagacagagttcaaaacaaacagactgaaaaagacaacatggaggagacagagaccaggagaggcaaagacaatttctgaaaagaaaaaaaaatgcagaaaactaagagaatgacacacatcctgaaaacagaacagaatgcttaaaaaactatttatagatgaaaagaggaaacttaagacggtaacagaaatgaacccaatagatgggttggaaattgaagttaaagaaattgtacaaaaagagtgaaaaaagataaagagatggaaaacaggtgagaaaatatgaaaaaatcacaaaactgtccaggaagttcaactcccaaataatagaagttctggaaagaaagagcagcttacagagagaacacagtcttgacagattgaaagaccacaatgatcactgagtacaacaggtgaaaacagacccacaattagaacagtcatcgtgaaatttagaatatagggggacaggaaaaatcagaggttccaggggaaaagaaaaataaggtaaggcacagaacatcaagaatcagaacagtggcagctttctgatagcaacattgggagattgcgtgcaataaagcaatatcttcaaacttctggggaaaactgttttttaacctggattttcccgtacaagacagacaagtcatcatgtgacacaacagaatgaagacaatttcagacatgtgaagtgtgaatgtgtctctcagggatccattttccataggctactgtaagctgggagccacagaaatgagagagtgtaaagggagttttatgagaactaacacaggaccacaacagagggatgacggcactgaagtgagataccccaggatgatgactggctcagccacaggaccagtcatccagacagggccagcagaccaagagcaaggcatatgaaggctgttaccactgcaccaggttttaattctgatagctgctggaggctgtgcttcctcaaacaatggggtaaaacaagagagagaatccaacacagaagaaaaggcaaagggaagttctagaataacagtgaagacaaatctcaggatgtcagctatctagcaggccgagagagaagtctagctagaaggaaaatgtaggtctccagcagagatatcaccaagaaaagaaggagaactgacagattactaatgtgatcagctttgtggaaaaaggtactgtgagcctatggaagatagaggaaaagtctgtaccaggtacaaagatcaattaaggacatgaaaaaaagacagatattaacttcattgttaaaggtttagctgttaatgccatttattttgacaaaatagtgaaaacactaggggctgatttacccccaaattgtaatataactacactgggagaaagaggggagaggaagctgtggatatgatcatatcagacaggtaaatttttatctactataatataaggttaagatatacataaaattgatgaaacaaaagataacagtatatacattatttagaaatgcagagacatatatatgctagaagaaaaagctaaaatatacaaagttatattctttgagaatagggactggggtaagtaaagtggcattgaattggcttccacagaaattaaggaaccagcacataagtaaatatgcacaaggatgtttatggccacaatgtttgtggtgatgaagcaggattatttccctgaacgcttcatgggtgggaactggagtgcatgggcgctggaacttgccagccactctggcactggcaggggtgaactccactcatgaagacatgctgcactccacccctcacggaggtggagcacgcaggtgagtagatgcaggagccaggtgagtgctttttgggtgctggaaggagcgaattccataccagccccacagcagcgtctggagcagtgcctgcaacccctgaagcccaagaggacaggttacagtactcttttagctctgccatccatggacgccttaagtgctaacagctcagtgggggcggtcagtgtgacacagcattttacacctgcattgtggcacccaagttcttgtccggcgtccaggagaaatgaggtcgcacaaacaaactgaagatggtaaatacagaggattttactgccaatgaaagtggctttcagtaggaaggggagctgaaaaggggacggggatggaaggtaatcttcccctgaagtccagccatccctggccaaactcctgtctgaagctacaccgtcaaactgtccctctgaactcaagccacttctctccaacgtccaactgtagtcttcaacatccagctgcttctcttctctctgccagtggagccagggattttttatgggctcaggatgggaggcagggcaggccatgggtggttttggaaaaggcaacattcgagtgggaaaacagggatgtaaattctccctttggaccatggtatcaggcttttcagcttgagggtggggccctcactgggacccaccctcttctgcccagaatttccctgtctcctgtccctatcagtgacataaaactgaaaacaatctgaatgctcattaatagggagaaggttgaataaactataatatagccataacatggaattttacttagctatttttaaaaatgaattaaatttgtatccatttatctggagattatccttcatgtactatcaagagagaaaaacaagttgtgaaaaaatacatgctgtatgattggattttttttgcaaacaacagtaacaaaacacccttatttaagatatatatgaatatatatgtgcatgtgtttataggagcttggagaaacatgtagaagaatgcataccaagtgttaacattggttaccttggagggacaggaataaaaaaggtagggagatgttaaagaaaaaaatagaacacaaaaaagagagacatgagaaatctgaaaaacacattcagagacatgaaaaagagaataacaaggtccaatatacatataaaagaggactcagatagataaatagaggactgaggagagaaaatattcagagactaggacaaaatttttcagaatcggtgaatgtcaggaattcttagtcttgaatcccaagcaggattgtggtgaaaccgcagatcaccaaagataaaaacaaaaaaaaattttaaagcaatatgagagagagagagagaaccctctaaataaatgacagcctgaagcagactacaccttatcaattacacaaatcaaaaggtaatgaaataatatactcaaatgctgagggaagatatctatgtaaaattctatacctagaaaaattattattcaagaccaagagtgaattaaagatactttcagtcagagactgagatgctttaatattcccaaatccttaatgaaatagctattcaaggatgtacttcagtaagaaggaatttgaactgggactacaggtgcatgccatgcctggctaattttttgtatttttggtagagacgtggtttcaccgtattgcccaggctagtctcaaaactcctggactcaagcaatctgcctgcctcagcctctcaaagtgctgggattacaggtgttagccaccacgcccagctctcaaatataatttttaatgtttgagggtaacaactgtcaaaacaataggacaaaatgtatacattacaaatcagtggaaaacagtgtaagaaaaagtcaagtaatttaatgtgaggcagaataagaagaaaaaacaagtaaagaagtagcatggtatatagaaaacattcaggctcctagtgaattccaaatatatgagtaatcataataaatataaatgactttaacctgttagaagacagaaaacctcagattggattttttaaaactccagctctttacaagaaagaagcctaaaacacaaggattaacataaaggaagagaaagcaataccatagggaaatgctcacaagaacttggtatagtcattagacaaatcagcttgggctgtcataccaaaatgccacagaccaggtgtcttaaacagcagaagtttacttctcacagttctggaggctggtaagtccaaaatcaaggtgctggctgatttcatttctggtgaggcctctctttttggcctacagatggccgccttcttgctgtgtcctcacatggtctttcctcaggtgtacatacagaaagaaaaatctcttccttctttttcttaaaagatcactaatgccattgtgagggccctgctgttctgacctaatgacatgggaagagaacactccacccaataagcatggaatacacagtagagaatgtaactttaattacttcccaaaggcctcatctccaaatattatcacattagaggttggagcttctgcgtatgaattttggtgggacacaaacattcagtttatataagcaatataaacatcaggtggctccttcaggcctctgctcaagtgtcaactaatccaagagctgcccacgactacatgatatagaacagcataactttataccccccagcataactttatctacctcaccttgccttatttttctttatagcactataccacctgacaaattatatattttgtttgtttattatctgtgatctccaaataaaatataagatctctcagatccaagagagtagggactttctcatttgttcactactgtatctccagtgtttaggacattccttaaaaacaataaatgttcaataaatgtttattttaattgaatcagtgaatgaataaatgaacggatctgataaaacagactttacagccaaaagcaatttttttttttttttgagacagaatcttgttctgccgcccagctggagtgcagtggcatgatctccgcttactgcaacctccgcctcccgggctcaagtaattcttgtgcctcagcctctcgagtagctgggactacaggcatgtgccaccaggctcaactggttttttgtatttttagtggagataaggtttcgccatgttggcgaggatggtctctaactcctgaccttgagtgatctgcccgcctctgcctcccaaagtgctgggattacaggcatgagccaccacgcccggcctacagccaaaagcattttgagggataaagaggatcacttgttaatatgaagatatattcaccagaatccttttgtatgcctcatgacgcagtgtcaaatatttacagcaaaaattgaattaactacaagaaagtaacaattcaaaattatagtgggagattttatttatttatttatttatattttattttttatgtctctattgaacttaatacattaaaaatagaagaaaatcattttacatgtattcaatttattattttaaaaattgaggtattcaatgaaaatgtcaaaaatatgcaagaaaatagaatacaggaaagtggtatttaggtggtgtgattgtgtgcctttgcatttagaatgaagtcctctgttattaactgatatatttgagtatttgtccccccgaatctcatattgaaatataatccccaatgctgaaggaggaggtgactggatcatgggtctggatttctcatgaatggtttagcactatccccttggtgtcttctttgtgatagtgagttctcatgacatctagttgtttcaaagtgtttggcaccttccccgtctcctctctcttactccttctctggctatgtgatgtgcctgcacccatttcaccttctgctacgagtaaaagctccctgtggctttcctagaagctgagcagattctggcaccatgactgtacagcctgcagaaccgtaagtcaattaaacctcttttgtttataaattacccagtctccggtgttcctctatggcaatgcaagaatttcttggcctactcctgttcagctaaaatgtcacatccatgaggatcttctttatcctcctgcaaggatgggtgccttggatatgctgtttcatttaccacatttgtgattccttaacacacatgatctgccagaagcatatagtgggagatttttagtacacatctctatgaaattgacagctcaagttttttttttaaaaaagggaaaagatttaatattgaaataaggcattatacaagcttcagctaatgacatgggaagagaattctctacccaataaatagagaatgcacatgaaatgttcataaaaattgaacaggttccaggccacagaacaaataacaaatttcaaagaactgttatcatacagaccacattcttcaaccaaaatacaataaaaaaattgagatagataaaaccacaatccctaaacccaagtacattttgaaatttcagaagcacactgctaaattattaatatgaaatcaaaatgaaagtaaaacatatttaggactgaacaactgaagccctaaatttcagttgaagaaaatgtttagcattgaatttaatattagtaaacaagaaaaattttaagaaagttagagaaagggcaacaatgtaaactcaaaaacaatagaagaaaatcctttttccacacatggttaaagtagcaggaaggcaataataaagacaacaaatcaatagaatcaaaacagaaacaatagagaatagaaacaaaatagaggctgattctttaaaaagactaataaaataggtaaatatttgacaagattgagcaaggaaaaagaaagagcacaaataaacactattaggcataaaatgggtcataactaaatagagtaaagattttaaagcatgagaattcttttctgtattttaaagcaataaatctaaaaacagataaaatggaaaaccttttagaaaaatatgttaccaaagttgacacataaaaatatggaaaaagaacaaagaatcctgaatgtatttttatgagttcagtctaaacctacattgtagaaaaacactaagacaatacaaaaaaaggcaagtattggtcaatctcagttaaagtatcaatgcaaaaaatctgaaaaaaaaaattagcaaaaattccagcagtatagtgtgtgcacaaatatatagtatttctttaatatacatatttgagattatatctatcaaaatatcatgtttatcacacaataaatatacggaatgtgtgtgagatgacccagtaggttttatcccagaagctcaagtaagagtcaacattagaaaatcttaatgtaattccccacattggcaaattaggaaggaaaaaccatataatcatctcaatagatgcagaaaaatcatttaacaaatttaacccccattcacaatttaaaaataaaataaaatacctagccaacagaaacagaaggaagtttctcctaagaacctacaagaaactttaggaacatttcctttaaaatcagcaactagataaatatgtcttctctctcaccactctattcattattgtatgagataccttgctgatgtaataaagcaagaaaaaggagtaagaaaatcagaattagaaatgaagggggaatatgtggcattatttgcaaatgataagattgtctacatagataatccatgagaaactatgaacaattacaagaaataagagggtttggcagggacgctggagacaagattaatatacaaacatccatggcatcagtaacaaccaattagaaaatgtaattttcataagatgtcattagcaatagagatcttacacctgtgaggtacctaggaataaatctaaagaaagaggtgcaaggcctatatggaaaaaaaaattataaaacttcattgaaactcataagacctaaataaacagagatatatctcatgctcaggagtgagaagattccacaatttcaacatcaaatcccctaaaattaatacataaattgaatgaaattcatataaaaatcccagaaaggttttcttcatggatatttgtaaccggttttaaaattgtggtccaaaagcagccaagataactttgaaaaagaataatatggggacttgtcctaccagatatcaagacatatacaatatacttaattatgccataaaattaagacactatagtattggtgtaaatatagataactagactaacgcaatagagagagccccacacatgtgggaatttggtatgtgacagagatagcattacaaactatggggaaaacaaaaactaaactaataggtggttcgcagacaactgttacccatatggagaaaaaaaatagatcactaactcacactatatccaaaaatgaattccaagagaattacagttaactttaaaacatttaggaaaaaatgttttttagacactatttttatggtcttaagtgagggactgacaaaaaaaaatacaaaccataaagtaaaaaagaagaagaaggaaagaagataaaattgagaaatttgatgttaaacattctgtgatgaaggatgccaaaaaacaatgtttaaaggcaataaatagccttggagagagaaaatttctgtaagtattcataatatttagtgaacacttagtactctataaggaaaaaacaacccactacaaaaaagtgagcaaagtctagagtcaggtaatacaaagagaaagaaaaaaatcccaaatgatgaaaaaccgtaggaaaaaccaacactaaacacataacctcataagtaatcagagaaatacaaatcaagacaattaaataccttttcaatacatcagattagcaaattttaaaagcccaacaatgtcaagagtgggagaagatgcagaataataagaattgtacacattgttgctgaaagcaaactgagagcaatttggcaacgcctaccaacctttatgatgtttgtaccccaagacccagtaattccacttcttctgtatctttgaaaagttcaacaaatccacatggaaacaagtccagagaaggtcacaatagaactgtttataaaatgacaacctggaaacatcagttagggagtggatatattatgatatatttatagaaagaaattggtttatgtctgagtcttttcaggttgctataacacaaataccatagactgggtgacttatgtaacatttatctttcagttctgaaggatggaatcccagatcaaggagccagcagatgtggtggtgtggacccacttcctggttcatagaggaccttcccactgtgccctcatacagtgaaggggtaagagagctccgtggggtctcttttagaagggcactaaacccactcatgagggctctacccttgtgacctaatcacctccaaaatcctgcctcctaatagcatcgtatttgggattaggatttcagcatatgaattttgcagggaaagaaacattcagtttataacaatataacagttaaaggaattagctctacatacattaattaggataaatctcagaaacataacttcaagtgataaagcaagttccagaaagatggattattgataacattaccattcgttttttaaacttgcaaaatgatactagttattgtttatgacagtggtccccaacctttctggcactggtttaatagaagacagtttttccatagacgggggtgggggatggtttcaggatgactcaagcacattacatttatcattagattctcataaggagcgagcaaccaagatccctcgggtgcacagttcacaatagggttgcgctcctatgagaatctaatgccgtggctgatctgacaggaggtggggctcaggtggtcatgctggctctcctgcagctcaccttctgcggtgctgccaggttcctaacaggccacggacctgtaccggtccatggcctgggggctggggacccctggcttatgacacataatcacatagcaaaatgcaacaggtatgtaacagtgcaacttctaaagagtgtttactgctgggaaagctgtggaagaatgctgtcagtttggggtcacaaaagaggcttaaactacaacattttctgttaaaaaatatttttaaaatgtggctaatgtcaatatttattaaatctgagttggggtacctgattgtttgctatattattctctgtaaattttgtattttaaatattaaatagttcataatttttaaagttactgtttaaaagggtatacatgatctttttctgcacatttccccaacattttctttttcttttaaaatttaattttattttattttaagcactgggatacatttgtaggatgtgcaggttagttacataggtaaacgtgtgccatggtggtttgctgcacctatcaacccatcacctaggtattaagctccgtatgcattagctatttattctgatgctctccctcctcctgccccctccaataggccccagtgtgtgttgtctccctccctgcatcaatgtgttttcattgttcagctcccacttataagtgagaacatgcagtatttggttttctgttcccgtgttagtttgctgaggataatggcttccagttccatccatgtccctgcaaaggacatgatctcattcctttttatggctgcgtagtattccatggtgtatatgtatcacatttcctttatctagtctatcaccgatcatttccccaacatttcaatctaggtatacagttgtgttggcagtctgggacctgaggaacagtccttgttccaacactaccacgctgagtgactctgagcaaatcagtgaacctctctgggccttatctgtgtgctcatctgtaaaatggggatactcatagtagttatgacttagaggcagtggttaagcgcatgggctctggaattcgatctggacttgatcctcagctctgctacttaccagctgtgagaccttagtcaatttacttaaactctctaagatgtactatcctcatctaaaaatgcaaacagagatagcatctagctcacagatctcttatgagaataaaacaaaaggaataatgaaaatctcttagcagaccatcatcaacaaaataaaattacaaaaccaagagaagatatttgctgtgcatataatggacaagggagtggtgtcaagcatacattacatactccaataagccaataaagaaacaacgaaccaatagaaaaacgggccaaggaaagaaagagataactcatggaggaaatcctgactactcggtatgcaaatgaaaatatgctcaacctcactggtaatcaggaaattgcaactgaaacctgaaacaactatcagattggcaaaggaaaaaaatttttaaatatgactctaacaagtattgaagagaatactgagcattaggaattctcagaccctgctgctgagaaggggcttgcactttggagagcaatttggcaacatccagggaagacgatgtgctaattcatcactttgctactggctacatatccaagagaaactaccaggcatggtgtgcaaagaacatatcaaaaagctagacacacctgtagcattcttccaaaggacatcttaaaattagaaataacttccatgtcctccatctgataactacaacacagcatggaaaatgtatagaggtccatgttttgcaacggacaaatcttacaaatacaatgtagaacacaaactccatgatatcctttatataaagtttaaatacatttaaaaatatatatatatagtttaaggatacacacatgtgaaagataaaaccatgcatggttataatgagcattgagcatcacatttaaactgatgactgtgacgttcagggaaggaaaaagcgggtggaaatggggaaagtctatctcttttttacaaaaaagaacaaggacatgacaaaatagtggtgaatgcacatttatacacaatcttattctctgcattttctgtttgctcgagatctttcacaataaaaaaatactgtgtgatgctcaatgctcattatcaccatgcatggttttatctttcacatgtgtgtatccttaaactatatatatatatttttaaatgtatttaaactttatataaaggatatcatggagtttgtgttctacatttataagatgatatgatttggctgtgtctccacccaaatctcaccttgaattgtagctcccataatccccacgtatcatgggaggcacctggtgggaggcaactgaatcatggaggtgggtttttcccaagttctcgtatattgaataagtctcacaagatctgatggttttataaatgggagttcccctgcacatggctctcttgcctgccctcatgtaagacgtgcctttgctcctccttcaccttccacagattgtgaggcctccccagccatgtggaactgtgagtccattaaaactttttctttacaaattacccagtctcgggtatttcttcatagcagtatgaaaacagactaatacataacctgtcaataaatatttgtttttaggagccccctaaagtaggtaggagagtgttaatatgatcatttgacagataatagaggtgcgggacaaaaagctgacagagtgggctcgtggtctattgtcccataatgtcaacgccctacccttgacattatgatgttcattccactcatttagtaatttacttaatacagggaactggaacttgacgcaacttagggcaggcgggtgaagaagacaacctcttcctttctggaacaaaccacagtttgaggaacacaatgacagaactcgataaaaagggaagaaaccagactgctccagtcatctgacggctcttcaatgaatctgtaattcactcacggagggcctgaccattcactgcgcatctgccgaagaggaggaaggggccggaggaagtgagatcgatggcctccgttccagcatgatttcgcctttccagcaccctatctaaattaagaacagggcactgcgctgcgtttaggggcattagctctgagatcttgtccgggacaggtcccttttctgctctgggctcttcttgtttaaaattgaggagtagactaccatctcgaggccagtgaaattctagactcttcattctgtttttcaggattttttcttttcttttcttttaaaatctgaaacgggagcttccgcatttattatttgcacgtggttttgaggcgcactcctggccacatcacagctatgttctcttgcctctgggaaatacataaaatgcctagcaacagttcctggtggcggctggtccccataaacgccgctggtcggcccccaccccacctctataccacgacccctctcccagcccggggactgtggtatggaggccgagagaggcccattttaaggaagaagcaagacatatgcaccatcccatccaaggagtaaacaggcgggggggaggtgggcgtggcctcgatcaatcacctcccctgaagctgcaccacatgcacattttaggctggaaataagaaagaatttcctggctgtaggaattgttaaataatagggcggatgaccaagggaggttccggaatctcctcttgagatctttaaaaatgcgatacaagatcgcatgtctgagatgatttcttgcagtcctggctagagacagacggactaggtgccttaacgggcctgaccctcctcccaaggcatatgattctgtcttttgctttctcttacccttagcaatatcctcagtgcctcctttatatgttcatccccctggtgaagctcacttactgccatccctcaggctagttttcacccaatccctagcctcctcacacctttccttgttattttatggaaagctggtcaaaggtcagagttgcccaactccccacacatagtttggtggtagcatctgatacccagacaaaacacggcaaggattccaataccagcatattgaagcttaaacaccaaatctggatggaaacagagaattagctgttgctaacaacccattgtaaatgaaaatatgatcttggtaattgattttaaatagttttttttaaaagaacccttggccgcatttcatcaagaatacagagtttcaaaagcgttcattccagggttggattttttttttttcctctttcttctggcttaaaccccaaatggccaagatcccagtctgaataaacaatgtgggtggtgacttttctgtgaggcccagtagaggatgcaatcactttcttattcggttcaacattaaatcatgtgaaactagcctgattactccacacaacttttactccgtaatggagggcaacacaacatgtattctttctctgcttctcagggagaaagaaatgaattctcctaactgggagtgtttaattatgtataaagttcgttgacctcacaggcggctgtcagatgatcttgctaaggcctgtgaacggcatcccaggaatgcagtgatgtgggcagaaaccgagtgagttcatgccaccgaatgctttaaatgggaccgaatcagcagccgtccagaaagactccagcgaaaacagaacttttggataatcagtaatttaatctcacctaagcattttgaggccttcaaaagtgattgttataaatcagaaactcaggaaaaatcccataggcatggggcccataacaacggggtgaagtaattttgtttgctggttattgccacagctggttggaaatgtatgtatttgcaatgttctgtccccgttttagaggtaatgctttctgacttccctgctactgacattaaaagaaaatgatgaagcaatcccattcataaatacatggtggggcctgaaggagtgtgcagagtctatgtttatttacagttttgatataatgcagcctccacatgtgtatgcagtaactatacctacttgtcagtaaatgccttgaaatgtgttcttcctacgcagagggctgggttctcctctttgggctcagggagcggaagggtaccagcaagatgagcgtatggattgtgtgttctcttttgtctctacctggagcatccccatctgtctattgtgaaaggaccaggaaacgctgggagacgggctggcatgtgcttcttggtaacgagagagcagagcccctggagagctgtgggatggctaactgcgggagccctgctactccgggtaggggagaggcgggggcctgtgaaataggtgggcttggtgcttcctataacatttaaattacctgattgggggtccaatattatgttccttcagtagctttctcaccaaacacacattttatccatccaaatattatgctttcggctggtaaaacttcacaggattatattctaaaacaaaactctgctgcattcatgctggtacctttattgttatgagtataaagaaagggaggctggaatttagccaataactttgacaccctgctggaagcaaaatggaaggggcctcccctgagcatctcttagactaacctaaaagtcttgaatctttttccaaatcaatcacctaggttttgagtgcacaatgtctgtctgcatccaattcgagttaattcaatagatatttggaaaacacaaataatggacaaggcaattctggtgacacaaaaatcaggccaggcgcagtgactcacacctgtaatcacagccctttgggaggccaagatgagcggatcacctgaggtcaggagtttgagaccagcctggccaacatggtgaaaccccgtctctacaaaaataaaaaattagccgggcatggcaatgcatgcctgtaatcccagctacttgggaggctaaggcaggagaattgcttgaacccgagaggtggaggttgcagtgagctgagatcgcgccactgcactccagcctgggagacagagagagactctgtctcaaaaaaaaaaaaaaatcagaactctttatcaggtcacattaatcccaactgggaggatttgggtagttttcatgcatggaatcttcccagggttgggggctgaacccttaaaggggttcaataggccaaagggaaatgggaacttaccaaaatctcagttcacactcgcatgcattgtggagaagagagagatgtaattgtcactgagtcctgctattccatggttagggttctataattttatcttgattttttgtttgtttgttttaagacagggtctcgctgtgtctcccaggctggagtgcagtggcataaacttggctcactacaatctctccctcctgggctcaagcaatcctcccacctcagactcccaagtagctgggactacagacgtgccaccacgtttggttaatttttgtatttcttggtagagacggggtcttgccaccttgcccaggctggtcttgaactcctgggctcaagtgatccatccaccttggcctcccaaagtgctgggattaccgctgtgagccactgcacccagcctatcttgtttttatagtccacttgatatttgagggtttccccacagaagcctttctttaagacccatagcatttaatattacactgtgaagtgaacaatcagcaaaaaagaaaaggaattccttctgtcttcccaccctgataaaggaagccttccttcaaatgttcaaaaattttctataaatatgatcatccccatagttacaggggaaatatgcttctagataaaggaatctggacacaaagtaatattctaaatcacttccactcttttggatactacaatttataaaattccatgaaggaaattagcctgatttctcatgaagttccctattgggaaatcactgtgtgccacagttatggaagcaatatctttgtgcatttcccaattccctgcctttgtcggaggctctcatcatctctaaactaccacagcaatttagctatttcttgtctgtagtacgtgctgcattctgcctggtcagaggtaaagatgaatacatgacttgtctctgttatttgagtacataacttgtctctgttacattataagctcttggaaattagagactgatgtacttatctttacattccccagcgtcattaacagggttggtgtccactgaaagaatgaacaaacgagtcagtaaataaataccatgaaaatatctatagcatgggttggaaaacatttccagtgaaaaaccagatagcaaatatcttaagccatatggtctctatcataattactcaactctgatgttgcagtgtgaaagcagacatagacaatacatagcaaatgggcatagctatgttccaataaaactttatttacaaaagcacgtggtgagcaagatttggcccacaggccatagctttctaactcccggtctttggtggttatccttgctgtaaacctcagtatattctttacgcttttacatagcgcttgttattttcaataatgagacaaagtgcagaaaacataaatgttaaagggttgttttggaactctatagcaataaattcacttaaaaaccaatcacaaagcacatatggaaattagctgacccaccaagcatatttcatggtcacctattttgtatattgtattcctttaaagcgaaaaattcttatcccaagaaataagggtagtagttttgccatttacgtcatcatgactgagataacttgatatgataagatctcagagttactgagtgaaaggtctggtgctaggtcatgctgaacttgacactctcctgggaaaggggaagaaatgctcccccatcctgctgtccagcagatcatctggtctctaattttactgctaaaatccttcccgaggttattaatgcagaagatactcctttttcttgataaccctctggaaaatatccagctagaaagagcacaatagaatctcacaagttcagcaaacacacagaaaagtcaagagtaactacgagaatctgatgaaaacaagatgtcccggcctgccaccctggcctgatttgagagtgcctcacccgtcattactcttgtctcgctatcaggtcacctttcgtaaaaaatacaactttgaaaaggagttggatttgaattgtggccgacactaataggatgcaaagtcctaggtcaattgcttggtttggaacaaattcaactagtcctttccaaggtatgaggaaatatacaacaaacaatgtaccaatgagcaccccggctgacattttgtgagatgggtgactccaaggtgtagatcttcaaactgcgtcagctatccacaggttgtgatgaaacagttctacagatttcttctaagaaggaaaaaaaaatgaaatttgagtctttccattatgccaagcttctcctcaacaccagaccaagtaatgggatgaattctgtgccttaagaatatgagaaaacagaggcttggaaatggaaggtgccatgaggcagtcaaaagacctgagatcacatctaccacattcaacccatgtgacatgaggcagattatctgacttcaatgtcacttgatgtcctaattttcaatgcagggctgggaagcacacattattgaggagaaatcagggaacacatgatatagagcccaatttatttcaacaaaccctgagaccccattgtgtgccagtgttggagagtgcaaaacggctgtcagggattctgagtatagcgtaggtgagcattccatggggagagcatcacatattgctttatttgcaacactccagtgcccaactatcctgagttcctctcttctgtttattgaatttcctcccctgccagttcaccacaatcccttattaccagtctctcctcattaaaacatcccccctcacccctgccacaaaacaaggagggcattctcaccgttctccagaacagggctgtagcaaacaacttcacgtatgtgaagtggtatgatttataccagcttaattgatattagataaaatttcaaattgctgaaaatgcatgtggcaatgcacataggaatcttactgcaatctgggtttggggtaagatgtataaaaataaagacaagagtttgaaagagggatcaggtggagaagacaatgaaagggaacggagaggcgctggaatattgtgaaatgccccaaaaagttgtttacagtaatttaggacaaattcctacacctcagttacggtcgtcttcaagtaacatggattgggtaaggtatgttcttcaaggcgaaaatcactgaatatgaagtgcaaattcatcagcatctgcactactcacaatagcaaagacacagaaacaacctcaatgcccatcagtgatagactggataaagaaaatttggtacatatacaccatggaatgaatacttactatacagccataaaaaagaattagatcatgtcttttgcaggaacatggatggagctggaggccattatcctaagtaaactaacatcaggaacagaaaaccaaatactgcatgttcttacttattagtgggagctaactgatgagaacacatggacatatacaggggaacaacacacactaggacctatcagaggatgaagggtgggaggagggagaggatcaggaaaaataactaatgagtactgggcttaaaacctgggtgacaaaataatctgtacaacaaagccccatgacacaagtttatctgtgtaacaaacctgcacatgtaccgctgaacttaaaataaaagttaaatttaaaaataaaaattaacattaaaaaattcaccagcatcccactgtgaagtctgtgcagggaggaggggtaatgtcccagggtgagggctgaaactctttgctcataattctctcctgctcccactccgggaaatcgagcatgggaatctatggagaacacctgatctccatttcctttaaaatagcctcttaggctgtgtttacagaacacaaaccaatggctcaagagaaaaaatatgaataagtcaagggactaatatgacaaattttcaattcaatctaatatcgagatagatgctcctaatgtcttctgaggcttcatgagaacattatctgctcctctcttctggctttcaacttcattattactgaaaacttctacttgaaatacaaaatattggaagagtcactctcaagatttctagaagtttcgcggccgggtgcagtggctcacgcctgtaatcccagcactttgggagaccacagcaggtggatcacttgaggtcaggagttcgagaccagcctgtccaacatagtgagacctcgtctctattaaaaatacaaaaattaggcccggcacagtggctcatgcttgtaatcccagcattttgcgaggccgaggtgggtagattgtgaggtcaggaattcaagactggcctggccaagatggtgaaaccctgtctctaccaaaaatacaaaaattagctgggcgtggtggcaggcacctgtaatcccagctactcgggaggctgaggcaggagaatcacttgaacctgggaggcggaggttgcagtgagccgagatcgcgccactgcactccagcttgggcgacagagcaagactctgtctcaaaaacaacaacaacaacaacaaatacaaaaattagccaggcatggtgacgggtgcctgtaattcctgctactcaggaggctgaggcaggagaatcacttgaatctaggaggcggaggttacagtgagccaagatcgcaccgctgcactccagcctgggtgacagagcaagactgtctttaaaaaaaaagatttccagaagtttcgtttggcagagtaaatggactccccttatcagtatgtctagaataatccaggtaaaatgttgctgcaaccaactgttctaaagttaacttctctggcgtgctacttcagcattgagaaacaggaccagatgagttcatttcatccgtcctaggcagtattctgggcagagcaaacagaaaatctcaaggaaagaaagaaactttcagagcccgctttgggcctctgtggattccttttttaagcgttacaagattggtcctagaccacagatgcaacttttggatgtcagatccaccagacagatgttttcccttaaagctgttgtctctctctcaatctgtttatagcgtgtttccatttcagcctgcaccttccttaagttctcactgctaactgcacgtcctaaaggtttcttgcctccacacacaaaaggctatttttctatcatgtgttctgttttccataaggaatgcacccactcttcgggtgacctgttaacccattactggtgtgtctgcttcctgggtcatcttcgagaaatgtgccaaacgctccatatatatattattaatcccccaagttgtgtggtgccagaaagagttttcttcttagaaataaactactcaggccacatgactggtattagcttcttaaaccaattgagcatcaactgatggactctcataatgtggtcagggttacttattcaaacctgtgttttttggttctgagcttgtagatggtcttcatataagtcagaccaaggaactccatttctatatcaattaagcagattctcagtgccaatacatttcaaccaatagatttcaaagactcatccaccttctctcactgtagatttttccagaatatgattcagactaaaagcaggacagcatctgctgccatttctcatacataaaagtacagggagacaagggagtttcttggtagggatggaataaccctgtgtcctgatggcggtggtggttacaggaatctagacatggggtgagatacacacacacatacaaatcagtgcacataaaccatggtgaaatctgtttaaggcctaatactaacgtcagtttcctggtattgataatgtgatgctatatacatgataccatttactattgttatgcaagacgttaccattcaagaagcaggatgaagagtacatgggccctctctgtactatttttgcaacttcccacaagtctataattattgcaaaataaaactttttaaagttctatgagaaagttactgcctataaggcagtagcttgcccaacttagcccgattgaatttgaagctctaaactgcttctttcttctactcacagtatttttaagtattttccacaactttcctctaagaaatggagtctactgactttctaatctgtgaaaggtatcctttgtcaatatgagagctctagagagtgggtggggtgggatcaataggtttttgaaaagttcacactgggttcaccagcatcctgcattacaacgagcattctaacaaaacagcatctttcagctgttttgtggatgttcccaatgacctagaggtttaaagaggcatcaggtcatagtcccaagtggcaaacatatacatgaggtcattcagtgggagaggagtccgtttgttcttccttctgtctccaagtttttcctcaggacttctcagggctggctcctcatctcacaggcctcaagccaaagaaacaggtcctgtgaaactcatatttaaactagccttccccctgtattagtccgtgttcacgctgctggtaaagatatacccaagactgtgtaatttataaagaaaattataaatcacaatcatggtggaaggcgaaagacatggcggcaaacaagagaaaataacagaacttgtgcaggcaaactcccctttataaaaccaccaggtctcatgagacttattcattatcacaacagcacaggaaagacccgcccccatgattcaattacatcctacccgctccctcccatgacatgtgggaattgtgggagctacgatccaagatgaaatttgggtggggacacagccaaaccatatcaccatcctccccagttacaccctacgttatccattttgttgtctgccacgttcttatttttcggttttacttattgcccatgtggcaccatgagaattgtgtccctttgctcacactgtgtccccagcacctaggacagtgtgttatttgttgactgaaagactgaagaaatgaatgaaacattcctaaagccatggcccattcttagacaatggtgattgtcaaacatgcagatcattattaaatagcctcaattaatgatcatctaggttagtttatgtaggtaatgatcatttttatgtttggctacgagaataaacaagacaaatttgagtgatgtcttcaacactagcagctgagctcaagtgctatggggaatcccaatgaaaagccatgattcctattgaattttctgaccgggctagaaagagatcagtaggcaggtagatagatggggagataggaatgaacatatactcaagtacacatacacacgcacattttctcatctttgaagatgcaacaggattttttttttttttttgagacgaagttttattctgttgctcaggctggagtgcaatgatgcaatctcggctcactgcaacctccccctcccaagttcaagcaattctcctgcctaagcctcccgagtagctgggattataggcgcccgccaccacccccagctaattttgtatttttagtagagatggggttttgccatgttgaccaggctggtcttgaactcctgatctcaggtgatctgcccaccttgacctcccaaagtgctggcattacaagtgtgagccaccgcgcccggccacaataggatcttggtacttcctttatccttgcaagtcaacctgcaaagaatggaaatcttctactaggggaagaaccagaaaaacatcagggagataggttttctgggcataggtaggcagagcactagggagaaggagttccctgttgcggctggtggagagcgtcctgaatggtgtcatcacctccactgtctggactcacaaggtcatgagaggtcaggagtgagggatgccctgtcaccaagccaccattccagtgccaagctggcctccccatcacgtcacatcaatgtttaaaagaggagaggcttcagataatctaccatgcccaagatgtcgtaagaaaacttagagggttatgtttatagacatagtgaaatatatttttttaattactaaccttacatgcatctgctttagcaaggaaaaaaaaattcccccaaaagactccttcaaaatcatgggaataagaaacaaagaggccaatgaccccataactttaaaagcatacatggtgccaagcagcccaaaagttagccttctgataccagagtcagcatgtgctgactgactccccttcatttcacgcttctcttaaaagaaaacaggctggattgtttcagtaaataacaaaaggtcagagaaacgctactcacaacatgagcaaaataactgctcaatctgccaaaatgtttccaaaggcctaacaggcagaaaaatccagtggtgaaataatccacggatctgaccggtgagaaaaggtccttcccagtaaaatctgccatcaggcctctggctcatctttcatcaatgagaaataaaaacaaactacgtcgtcaggttctgccaacattgagatgccatgtccttcacagtaaagcaaggttgtctactacatagtttttagacttctcgccttagattatattttgactttaaggccaagtgtagaaatggtggtcaaataactatgtactcaaaaacgaagtccaaagagtccattttgtaaaatcttctcctgaatgaaacttcccattggtttagctcctacgttcattttatctgcagaatttctccgtggtgaactggatgctaataccattataagagcttcatagagagacagagaataagcacatccgagagagaaatcaggactttgcaccctggggatactgcctcaactgaatctgcatcagtaattcggtgggatattgtctcccccaaggcatccctgctattagccatgtagacaatgccaccactaatggcttattgccagccttgttgcagaggtgggatcttatccatttccgccctccacaggatcttgcgaggtcagtgctcagcacattcactgggttgagtcaatgcccctatattgtacctcattcttggtttaaaaccatagagcagcacttcacagagtattttccatgaaatactggtcctgtaagatgctacttgggtgcaacataattctgattccatgaagaaataagctttagaaatgcttcctactatgactacattccccaatttcagaatcatcatgcatatgggcatattaaagaatcagagaagtcctgcaggaaagaaacctggtgaagttagcatttcccaaatgcttttcagaaaccttttttcaattaacatctattcccatcctcagcaactagtgttttggagagggcatcctggggaacattacctcaaaatagtttccaattcatgtctaatcacatttaatgtgtcactaagtccaattggttcttccttcaccatataagattgtgatcagtcctgtccatttaacaccctactgttaatctcctagtctcaacttaatgcttcatagtatcatagcatcacagaaggatagatctggaagtgctttagaaataatcataaagtaaaggtcaactggccaagtgtggtggctcacacctgtaatcccagcactctgggaggccgaggtgggtggatcacttgaggtcaggaattcaagaccagcctggccaacatggtgaaacccagtctctactaaaaatgccaaaaaaattagctgggcatggtggtgcgtgactgtagctccagctactcgggaggctgaggcaggagaatcgcttgaacccaggaggcggaagttgcagtgagctgagattgcaccactgcactccagcctgggtgacagagtaagactccgcctcaaaaaaaaaaaaaaaaaaaaaaaggcaagctctgaatttaacagaggagttaaccaagacccccagggtgaagggacatgcctaagatgtcacaacatgacacgtttgactcactaaaaaaaatggtagtttcaggcaccactctcttcctccccgtctacttggtgaacaggaattagaggagcaggcccccagtgtggaaggaaagggaagccagtgctgtggagtacccaccgaatgccgcaccgcacacttgcacatacatcctctcacttcaactcagcaagaactctgcagggcgggtattttacagaccaggaagcccaagaccacacagtaagcaagtagctgtgccaggatctgagccaagaacagtttgactccaaaacatatactcctgctagtgtattatactctctctcgacaaggaggccctcaataaaagcacactgaatcacatagtaaactaggaactgcacatctgaagttggtggctgcaactactaccgctactgcaaaggagaacatatagtgagtctttggttttccatcaaaatagcctatcatttgtgaatgtaggaaagagtgaatttttaccattcatgaaaaatgaattaagttaatgaagtcataaacactaattgagagtattactgaatacacaaataatatacctgcaaacttttacaggaccatttaatgttagggcttgttggcttctcctgtcaagtcatttttgatggttggttatttttcatgaaatctacaatgggcacaagcccagttaatatgatgacgatgatgatggtttattttcattgtatacacaaaagcatatactattcaaagccgttggagtcttaatggagaatggaaactttctccagggatagacaattgataaactctaggagtaccctttttcatattcatctttccatatttgcatcttttgaggtacttggaatactgttaagtgatttttcttcccacttactagggatttgctgtcttttgaagaatttctgaaacaaacatgtggtccataagtccaagtaaaatattttaaaaacaacaacaaaccaataaacagcaaataataatggtcacaaatccatgaataatcaaatttaataaaatattgacatgcaaggatttttattgcttattacaatcactaacatgcaacccagcttatggataccacggagttccaatattggtgggtggggacatttttaattttagtatttaaaagttgtaggggagagagaaatggctttcctccaccgctctgggtttcttggctgggttatgaattgacgtaagacaaattaacagaaagaaaccccatatttaataatgtaggtgcacatgggagtcccacaaaatatgagacttgaagaagggtcacacggttgaaactcatttagcatcctgagctatggaacggaataggggcttggggcttctgggggtggtggggacacaagctgtgcgttgatgaggggaggctctgtatggtgggtcaagtgtgtcttattatgcagagaaagtctctcaggtactagaaattatattggaacagtccttggaaaaggagatgatagtctggggtggcatgtcctgagcccctacaaagtcaaccatgactgtgtaaccttaagaaaaagagtgactacccagcactttgggaggccgaggcaggcggatcaccaggtcaggagatcgagaccatcccggctaacacggtgaaaccccgtctctactaaaaaatacaaaaaaattagccaggcgtggtggcgggcgcctgtagtcccagctactgaggaggctgaggcaggagaatggcgtgaacccgggaggcggagcttgcagtgagccgagatcccgccactgcactccagcctgggtgacagagcaagactctgtctcaaaaaaaaaaagaaagaaagaaaagaaaaagagtgactgacactaaggaaggtttttttttctttttttttttgacgtagtttctctcttgttgcccaggctggagtgcaatggcgtgatctcgtctcactacaaactccaccttccgggttcaagcgattctcctgcctcagcctcccaagtagctgggattacaagcacctgccaccacgcccagctaatttttgtatttttagtagagatggggtttcaccatgttggtcaggctggtctcaaactcctaacctcaggtgatctacccatgtcgacctcccaaagtgctgggattacaggcgtgagccactgtgcccagcccaaagaaggtattttatatctgattgtcaagacatttttattcaatcttaagtactgaactttagcattaaagtatgcaaagaagccacaaggatagaattatgtctctaccaatcttttagtcctcaaatataagtaatcctaatattcttaatatcttaaaaaagacaccaatgagatcttcattcacaaagattattagatatagtgaagtaaatatttacaaggaaacaaaacctgttaaaactttaacattcgtgtcacatcttactgacagaaaatttgcttttgaaagccaattttgagttttatttcctcactttctttgagttttatttcctcactttctgcatatgtcctcatatcttagtgggagagctcttaccaaaaaatagtattttacttccttccatacctattgatacggtttggctgtgtccccacccaaatctcatcttgagttgtaactcccacaattcccacatgctgtgggaggaacccggtgggaggcaattgaattatggtggtaggtctttctgcactgttctcatgataatgaatgagtctcacaagatgtgatggttttaaaaatgggagttccctgcacaagctctctttgcctgccaccatccatgtaagatgtgacttgatcctctcctcttgtctgccacgtgagatgtgcctttcaccatccaccgtgattgtgaggtctccccagccacgtggaactgtatgtccaataaacctctttcttttgtaaattgtccagtctaaggtatatctttatcaacagcgtgaaaacagactaatacactttgtaaatttgatggggtcagttctgcattggttgtacataggagcaaccctgcacagagaaacagatcaagtctggaactagaatagagtaggtagcaagcagaaagtagaaggaagagcaagcaaaataaataggttcctaacatctgctatttcccgatttttaaaaagtgaatgcacagacaacagacaccaactctgtacacaaaaacacactttaatgttaactagaattattcctcagatgcacacagtttgcgtttgtttatgcatggtgtagctgccacttacgtagtgtttattacatagctggcactgttctaagcagttaactcataaacgcatttaaagctcacagcagccctatgaggaaaatgctgtaatacgtggcacttagcagatgagcagaaggagccccagaaaagcctgggtaggaaaggacagagcagaggtttgaatccaggcagaccatctccagtccatactgctcacacctgacactacactgatcgcctacgaagtctgctgtacttactctgctgacatgcttggaaaagaaacacattctaagtagttaataatcaatcatttcccatataagaatatattgcaacattcagaaaagggttaaaatattctgtaatcctaccactatatcacattgctggggtagcccaatcaccgcagagactttatgaaagaggtttctgagtcctatttcaaaacatcagtgactagggcaaaacccctccctaaacctaagccgtttacagtataaatttgggaaggaaactatttgagatggccgttggagatttctactagaacaatttgattatttcttttacagtctacatatgaatagttgaatcatttaattgcaggagttaaaagacttgtctgtgtttagaaaaatgagatttttatttgggattccccagtatattagaaagatgattctcagtaaattgtgggcaagaaggaaataatatacatatttgtggctatgagagctaaccagaaaaaaaaaaaagaaagaaagaaagaaagaaactctctggactcgcacagttccaaaaactgctgaatgttgtcttttttttttttccaccctactaagcatttctctcttatcgaggaggattcatttcccacctgtttcttttacgttcttgaaatacatataaagttagtgtttattttctacccactgaaatcttgttcaagttattctttctttggtctctactttcagaagtcacaacttgttttgaaaacattagcatgagagaaggcttctttttatgtaccacaaactctcaactatttagaatgcttgcttcagaggtaaagagatgcctggtggcttttctgctttgtaacaatggccgtgtaaacaacatgactggacaaaaccaaaaatgtgcttagacagagttccttcttcctgtccaggcaaggtggctcacgtctataatcccaacactttaggaggctgaggcgggtggatcacttgaggtcaggagttcaagaccagcctgggcggcatagggaaaccctgtctttgctaaaaaaaaaaaaaaaaaaaaaaaaaagctgggtgtggtggtgcactcctgtgatctcagctacttgggaggctgaggtgggaggatcgcttgaaccagggaggcagaggttgcaggagctgaaatcatgtcactgcactcaagcctgggcaacagagcaagaccctgccttaaaaaaaaaaaatggaattccttcttcttctgatgagtgcttctcatcattggggtcacaattatcaataccagttttttatagcccaacgttatttgaaacatccatatgtttgtgttataaattaatacacgtatttaaaatatgggttatagaaaagataccatatgcagtggtccagaattttgagttgtactgtccttgttcttcacatggggtattagatttcaaccaaaatgaagatcatatcttcaagtagattgccagaaggcaccatactggaagctcacgggtagtgcactctgttcaatgagggcagaaagacagtgacatatgaggtcttccaaaggtgacatggaatgcaggcagagatgaaatgtagaggagaaagaatgcaaagctgcaaaacatgggccctatctgtacttggatctggtccttggattgcagagctcactgctgtgtgcatagacctggcaagtgtacggctgccagtttgattccgatgaagggcatttagaagaatcaaaggatgaaagacaacggaaaggagttaacatcatgacctccattttactgatggcatggctgaggtccaaaagagttaagtgacacagagctagagcagcataaagccagcacttgtcaccttctctagtttcataattcataacttttctgtggtatatgttcctggtcaccaataaaatgggatgacagtgtggacagctctatccaaaccattacttctgataaacaaatcaaactcagggatgctgctggttcagagctgcttcctcctctctggggactggcctatgtcccaggggctcaaaagcatcaccaccttcatttatccttacaatgaaaccttgagggacacgactgtctacacttctaattggaaagccgtatctgattcattcaaatgttcagatcttcaaaaagtaaagtggcctagagtggaatcttaaagttgagagtatggactcagggagatgctgttcattagccaggataagagatgtggtttgaaagagctggacttccttttctcactttgcaattgacctgctgactaaacttgggctactcacttcttaacctcagtctgtcttgaatttcccctgtgcaaaaaaacatgggaagacaatatctaaatgcctctcagggatgttgtgaagaggacctcatcgatgttttaaaccacatggtcctaggaaggtgctatatattaccatcattaaaatcacctgtggttggctgcagccctccccccccgccacacacacaaacatttcttaccaaaaaaaaaaaagtaagaaattaattttcttcttatctgaagggatttcacaaaacttcctattaaagcattaacattctgaaaactgaattcaattcaatgtggcaagggtatgactgataaccaatcttaatcccaatctcttcttccttaaggagagaaagaattttacctgatggttaattaatcaaatatagtcgatgggatacatttagtcaataatattccattttagacttagtttagtcagagaagattagaaaaatggtgtcattgtgcattggttgaatgcttaagttttactagttatattacctcaagctggtaaaatatatatgggaagacaacattatggaaaaaaattattattatttgagaccgagtctcgctctgtcacccaggctcaagtacagtggtgtgatctcagctcactgcaacctccaccttccaggttcaagcgattcttctgccacagcttcctaagtaactgggactacaggtgtgcaccaccacacccagctaatttttgtgtttttagtacagacggggtttcaccatgttggccaggctggtcttgaacttccgacctcgagtgatctgcccgccttgacctcccaaagtgctgggattacaggcgtgagccaccatgcccggccaactttatggtaataaattaagacagtgaaagcgtgacttactcaagggctacatatataaaggtgacagatctgtatgtatctacttaaattcatgcccaacacagcacatgttgggcaagaatttgtgagctagctcagcttacaaatggcttagactaggggcatgtggcaaggggtatggggttctacttacagtttagggtcacaaaatagggcgatccaactctcccacttcacacaaagcctgcccccttctcctgcacatcttccataccaggtcctaatcaatcaacctaaccatctacagagtaagcagagtcattaacagtatgttctactctattaaaaccagacacatggccactaaacaaggttgatctaggacaaccattccattcagaatgttttcaccagtctatgccaaatgggaaaaatgagggaaagtaatgagttctttgaaagttaaattcattcaaaatttttaaaattgtgtaacttattccaaggttatgtccttactattttgtttttcatgttaaatgttcttattttaccagtgagagtaaataatagctgatttattaatatcccattctggcaaaataaaaagttagcatctctgtattggtctttaaaaaaaagaaatgaaaagcattgaaatccaaagtttggctagcactaccttagaatggcttacctgttgctaaaaactcacagagagacccatgcggctactgtgtcatgtgatcaaacatttataagacacaaagcctcatttcaatatgtaatgccaaaggacatcaagaaaaacgaatagacagtttcccaattcagagcaagcaaagtatgctgccatctaaaatcaaataaatgtagattctaaagtactaaacaaacagaaattatgctgtcatttttcaaatggtataaagtattttaattaaaacccagagggcatgcaaaggtataataatccaggagacagagtcacgataacactgtttattggttttcaactttcagatcctatcaatagaagctgtagacaaatatccattcttcgtctgaggacaaatgacagaggatttaaccattcagggaactgaaaagaacacggatggcatcaagcttggccctagctgacagaggctcagaggtagaagatgggagccgaaagagtgaatgctttcattttttaaatgagtaattaagtgatgctctctaaggtcaacagaatgagaaatgaggtttccaagaatttgtttgagaaataagcaatgtcctttaagtggagggacggagcatggagagggaagaggtctgagagaagacacagacgaggctgaatcagggagagaaaccccattgactataaaaggaaggcaataaactgagaaagagtagtgttatgggtcgaattatgtcccctcaaaagatatgttcaagtccccagtacctgtaaatgtgacttaatttggaaacacggtctttgtaaatgtaatcaagttaagaggaggtcgttagggtgggctctaacccaataggactgcgtccttataggcagaggaaaatgccatgtgaggagggacacacagggacacagagggcaagctaaggaccgatggcacttccaggagctggaagaggtggggggtggatccccctgagccttcagaacaagtgtggccatgctggcaccttgattacagacttccagccctcagaactatgagataataaatttctattgttttaagccacccagtttacggtattttgtcacagcagccctagaaaactagtacaaatggtactaccatatattatttaaagatatgaaggtagccacccaaagaactttcaacaaagctgggagggttcaaaggtgtttcctctggaaagtgggaccaaggaaggacaggacccaggcagggctgttattttttattaaaagccttctgtgttatttggctttttaaccacacagatgtcactctgatcatcttttaaaaagtataaaatatctatgtgatgttatcagaacaaaacctggccagctttcttcatagtggatgacaaactctgaggattgatagccacctcctccacttgttctctggcgttgccctccggtcccccagatccctatacacggtctccggcttcagggggagcagagccgagttgggagggcattggcctggacctcaaagtagcctaaatgtcttggcacgttttgttcacatgcctaccatctccatctcaaaatcaaacacaaattatttttggactttttacgggtttgcgtcatcgatgatggtgattttctctattgacttggatgattaagaaccgactaaagggaaaacagagaacagtggtgagcttgtcactggcttcctttgtagataaaaatgcaaaacaatgcctgacaaagatttcagtaattatgttacatatgatcagaaaacctcacaatagagcttcaccacaaacatttgttcatcacattttattgaacccataaaaagacattctaagtgctccccatggcccagatggaggatcttcgcactgtggtgcaggctgtgacttccctggccgtcagaagtcccatgccctttgctcactctaagaagaatgttcacattgagccctgcagcctgtaatgtggcaaaatgttgctgtcacctcccacatgaacagggctattgatgactgtgggggcctagtgcaaaggcaccagcccccatcacagaaagaaagcgggcagcgtgtaagtgtcccaagcatggccccgagagaaaagcagaatgcaaaaggcaaacgcagtttgcatgcacgcagggcttcgctgaggtctatttgtacccggctccccatggcagctggggagcaccttgccgttggttggcactgaagcagtgccaggtgggtgaaagctgaatgaaatgtctaacagctatcatatggatgaacacgcaggaagcagaacaaaggagcagcattttatcagcagcagaatcctgatggcagtcattgcccaaggggaaaccgtttgcttttattttcatcctggccttcagtttccctgggtaacaccttccagccatcccagtggttaccttacccacctacgtggttatcagacgtctagactcagccaggtgttttcccattccatattgcagggggcaaggtcacctcggaatggacttccaaaggcaggtgggaattacgccaatgagaaagcaagtcacaattcaaatactcgctgtatgtgggaatctatattgaacagaaagaataaaatgactccatttttattctgtgaactctcccttccagaccctcatacagaagagagtgtggatccatttaaggctgactacattcaattgcacacatctgctttctaattgtctcagttaccattctccacagctggccttttctccgtttttgcttttaaaacatcacctctcaacatattgtgaggaagaccaaacccttagactcagatgttccagaaacctgatctattagttgtgttttgaacacgtctggctacttttcatctgcttttttttttcttggtcacatgaacactgctgtaaacaaattctgtagtttgagttatgatatccatcagaaaagcctaacaacactgtagccttcactacaatgcataagcatgaaacacctaattttcctcattccatacatacacacacatgcatgcacatgtacacgcacacacacagcaatgtatcatttgaaaacggaggcatagttccctagcaacataaccaaaaacatggcaatatcttttggatctccaagttctggatttattatgtaaattgtttgaggctcatgattgaaggcttcaagatctcattttatcaaaaaagatcttagcagttactagtccatagaactttccctgacagcagggtacctctgcaaggagctgccctgtccatgagccaggcacgccctggtcagcaggggcggacgatagcacagacagcaaagggccaaccaggccagaacagtgccttaatccctaggaataaacataacccaacttcttaagggtcaggttcgttactaatgaggctctgcgttatgaaacaaactcacgagagaaaggtgatatctagccaattgattttaaaaatggaaaaaaaaaagtggcccatgtcttctcctattctcctggcagataacgggggtagatgaagtgggagaaataagaggaacaataactccttcaaaaagaagaaataaaatgaaaaagaaaaacaaacatgagctggatcaggaaaaaaaatagggcaaaacaagcagaaatgatctttagataagaacagtattacataaaacagcacccataatatgttaaagccactctgcagtacaaatcacttttccacaaagaattaaaagaagaagaacaaatacaaaaatcaattaaggtccagggaagggctccattccttctcgaggggctgcttcttatccaaacactggctgattcatgcaggtactgccaggctgcctcagagagggtattttttatttctgcttgactttgtccatagagtgattttcccattttagtttgcaaggaaaggttaagcaggaggagtagaatgttattccacttagaaaagaatccaacccatcccagggcctcaggctcagtgcttccctttggtgaactagttttccaagagccgacaactagctgcttggttgtgagtgacatgaaacactgcccttcctctcctggaggaagaaaccatcagcatccttccaactgctcccactgggaacaaggcagatggaagaagaccagcacgatgcttgatccatagggagcacgaactagatattcactgaaggagtaaggagcaagaaatagatctctgacccaaagtgataaaacaccaaagccaactgctcatttcattagctgcaagagagccatgcagggcagcctttcctcccataagacaactcagcgtggagttgttgaatgaataggaaaaagggagagctttgaaactcacatagaaataaaaacggtcttaggggataaaccatatttatattatactacctacgccatttaaggaatgtggttatacattttctgaaaaataaaatgtcctatcctgtcttaaaaaactgaatttgtataatattgggtttgcctaaagagtaaagcacatatactaattttcttttttgttgttattttttctttttttttttttattttgagacagaatctcgctctggagtgcagtggcatgatcccaggtcactgcaacctctacctcccaggttcaagcaattctcttgtctcagcttcccaagtagctgggaccagaggctcctgccaccatgcccagttaatgtttgtatttttagtagagacaatgtttccccatgttggccaggctggtctcgaactcctgacctcaagtgatctgcccgcctcggcctcccaaagtgctgggattacaggcatgagccactgcgcccagccaatttttttatatttttagtataggtggggtttcaccatgttgtccaggctggtcttgaactcctggcttcaagtgatccacctgcctcggcctcccacagtgctgggattacaggcgtgagtcactgtgcccagccacatatactaattttctttggagtaaaggcacaagtacattcattgtacaagtacagaatccaggaaaatcatcagaagagctttgacgtaaagagtatttgttacccatcagtagttggtagtgtggctgatcatctccttgaaatgtgcaaacgtgtgtggtaaaagtaaagaatcggaggtagggaacttataccaggctcacaactccacctcctgttcagagtaagtgctgggttgctgaccaaattaggtcttcttggacctccggagcagcccttctgcatttccaggaaggaggtggacaagtggctattttggtctgtctgtccatctggcttgtttgtggctggctagttcaccacccagctcatggtcaggctggaggattgggtacctttgctccgaccagtcagacatcccactatgacacaggccactcactgcagactagagggattcaacaggaaagtcccacggggtaagcaaataccaccactacccaaagtaaaattccaggctaggggtcagtggtgtcctcatcataggaaaaagggaaagtacatcagaatttgacagaggaacaagtaccaaactgctgtccccaaataaagaacttacatcaacaaggaatataaaaatgttatttaggacttctgttctcagatgtttaatacaaaggagagattgttgtgccagggaacaaagtgatccaatatccacaaagccagaattctcctactgcacattttgtttccaaaacactaaggaatacagcaagatttcaagttggagtaaagaagctacttctggaaacaagagaggagataactgaagactttcacagaggggctgaaatccttcccggaaaactgtgctcatcagggaacctcagcctagggggcagcgagggtggacggtgagctgacctatccccagacatgtggaataggtattgggtgtgcggggggtgcagtgcagaatgaaggctgggagttgttaaagctacagaatattctagtagcataccacgggaactcaggaacctcaaacgtttttcaaaaattaacgctttgggctcagagtttcaggcagtccagtgtaattttacttccactgggattgttgccagaaagaaacaagcagtgctccttgactacagatttttaaaacctgttttgttacatgcaggtgtgtgagatcctaaggagacttatttaattaagatgggggtgagggagcaggagggctgatgagtggcccttctcccttgaatggccaccacattggactgtattacagaacaaaaacccaaaagccctaaccagaaagacaactcaagggtgtcaatctgtttctcccgtttctagttcattacttttactcttcactggaagcagtcacatcattgcatcatcactctctcctttactggactgagcatttccagagggtaatgcaataggactgaggtgatggggctgggaaaccaggtcccctggatctaatcttggctccactgtacaatgggatcaatgtcaagttactcctcttcaactcagtatcctcacccatacaatcggaataatggggcctaccttctggactgctgcaaattttttttttagacggagtttcactctcatcacccaggctggagtgcaatagtgcaatctcagcttactgcaacctctgcttcccgggtttaagcgaatctcatttttgtatttttagcagagaccgggtttcaccatgttggccaggctggtcacgaacgtctgacctcaggtgatccacctgccttggcctcccaatgtgctgggattacaggcgtgagccaccacgcccagcctgctgcgaatcttaaatggaatagtatagtaaaacgctcagcatgcagatggccccgcctttgaatccgcggactgcaccttacccgtcttcacatcctccttcatatttgctcatagtagggcctcatattaaaattttttaaagaacaacaaaatgttttatttcctctagtttatttttttcctgataacatgctccctgcctgtgccctaaaccctctccctggcactggactggatgcttcagatcagttgtgattaacattttacacaccccctgtaaaactggacactagcactcaagcattattttaattaacggccagagagtggcaaaattaaatatgagatgacctacctcaatgctccactgtgtctcctacccctggaatttcaaggggcctttgttaaaagtgagtgtacaaaggaaacacaaacaggcaaaggagaggagaagggagcagcagagacagataaaagccaggaaatcacagcccgattccctgcactgtctccaaattactggtgtctttgaacagcttgcatgatattaaatatttttaagaagttacaatccatgacaataaaaactgtagtaaatattaacagaaactgacatcgtagaaatttttaaggggatcatccactaaagaaatacatgatttggaataattccttcctgtgtaatcaatgggaacgaagagatagccaagagatttgtggctcttccagtcaatatgacaccccaaacctcttacttctcctaacttctttggtcaaagatatttacagggcacccatgtggggagtacgctgtctcaagtcctctcgggatgaggcctctgtggcaaggggctgcagggggcccaaaggaaagaacacggactctcaccggtgacccatggaaagaaaccaagtgccaagatctggagaggcgccagggtcctcaagggactgggagaacagctgcgtggcaagtggagaagcacctgtggcactccaggtggctccagccagaactccaggcctctctgtcgccaatcaaaataaacagtgaagcaatcaaagtgagcactcgagtcccatcagcagagcaccacgctaaggtcttgctggcagcagagtttgggaaggggaagggccacaatggcaaggggaaagcaaaagaaagagaagaaagggcccttgttcttgtgcaattattattaaacttggagaaaataacacaataaaaacagctatcagtaatttaatacaggacgatttcctatattgtggtatgtgatcttcatagtcacctgtaaccctgggatatagatattactaacccattaaacatttcatccaagattaaagaaatagagatgaaaccagggcagttaggtcagtctgactccacagttggttttctcagcgattacactctatcacttctttctttgaaacaacctcacacacccatgcatgcacatagaagaggattttataatttaggcgtggggaaggtcagtcttaactatgactcaaaccccagaggctataaaagaaaaaaaactgataaatctgatttcatgaaaataaaaattttctgcatggggaaaaaacaccatcaacaaatgacaaaccagggacctatctggaacatagatcacagacaaaggatatatttctttaatatataggaaatgcctataaatcaatatgaaaagagccaacgaatactaaatcagctaataaagaaaatcaagatagttcataaacacattaaaagatgcataacgactcataacaagaaaaaagctggttaaaaatactagaagggtgaacatcaaaacattttattatataggcaagggtgaggctaagaaggaaggggcaatctcataaactactaatgagaaaataaatgagtacatccgttatgagggacaatctggcactatctatcaaaattataaatgcacctgccctttggccgcaaattccaattccaggattttatcctgcagatcaactcgtatgtgtgcaaaatgatgtctgtaggaagctaatctctgcggcactgattgtactagaaaatgtttgagaacaacctaaatatccaaaaaggagactgattaaataaactatggtatatccctacaatgggctattatgtagacacagaagagaagaggaagctcttaatatattgatatggaacaagccccaaggtatactgttaatcaaacaaagcaaattaaaaatctcaagcagaataggctatcataaatataaaagaaaatcacatagtgtctacatatatatttgtaaatatccctggaaagatacacagggcatgggtgacaggagctgcttttggggagaagtgggaggtaaagtgaggagggaggctcctgtcactgtatacactttgtattttttgaattttataatatgtgcttctattgtctattcaaaaaataaattgtatatataatttattatatattaaatatacagatgacaaacccggaaccaatttggaacataaatctctctctctctctctctctctctctctctctcacacacacacacacacacaaaaatatatatatttatactacatacaaatcaaaatcaggagccacacaaaggcagaagtagcttctggcccacaaggctgtgtgaccttgggcaagctgcttcaccactcaagcaaggtctcagcttcctcatccataaaatggggactggaatcctccctttctcctaaagtttggagaagtaaaggaaggaatatatgtaaagcctttaggtcagtgcctggcacacagtaaatttatgcaagtgtttgttaaataagtctactcggttggtcaaggaagacatctctgaaaagtgccctcaaagtcagattagaaagctcagtaggagttaggcaaggaggagagaagcaggggaaacagagagtgctcctcagaaggagtggcttgtgcaaaggtcaggaggtgaggagatgctcgcactgagggaagcctgggtgactggcacagagcctgggagggcaggggacagcacgatgcaaggccgaggaagtgagagcgtggatcagtcacgacagtttctctgggggtgctcagcaacccatggagcatttatacaggggcattccgtgcttgggtaggttttcctagaaaaatttctctggcaagagtcaggaggacaggttggagagaggcaaaaactgggtggcagagaggccagctggagattgttgcagcaactcaaggaggaaatgatgaggctgtgaactaaggcagtggcagcaggcaggggatggagtggggaagacacaaaggaggtgcagtcagctgggctgtttgacctagatggtggctagaggtgggacagaagaaagaattgaggataattaccagagttttgacctcatcagtttggaggactgtgatgcaactcactgagataagaagatcaagcaaaggaagtggcggagggagtaagatgatgggttaagtcccaaatttgttgaggttgaaacatcttataggtgatctgtagctagctacatgtgtctgaatttcagatgaaggacctgcagtaaatatatatccttgagaggtatcagctaagtttttaatactgaaagttctggactgtggttaagggagctgccaccaatggtccctctggtccacaaaggagactttggagaaggtatgctacctgtaatgcaggtaaatccctgctctctccctccttccctctgtctttctcttcctccctctctcccttcttccttccctttccttctctgtttttctcttctgtctttcttccttccttcctaaaaatataataaaagtctttacaagaggtttccttacatgcttcacgtgaagtaacccatctctgatcagtcccagctaatcagcggcgatgcctttattttctctaacattcctgcattccttttgcatctcttttcacgcatggcggaagccactagaaagctgtcactgttgtgtatgtgcgtctgcacaccaccgtgagtagcctgaagaccttatttttccaacaggggagtaatttacagcctaccaatgaaaaagagagggagggaacaccaagtgtatgcctcatgagtgctgtctagatgtttcttagaaagagcattctgtggttttctcttgtgctcactgtcttcagcaaaaccaacccccagttaaggatgacctaccacatggttttactaagagaccttagaactgatttctaaaagggcatacattcttccactacaaaaaaagtgtgtttaggcaagatttctggaacaatttagccaggtgaggtctggggccaagattcaaggatgccagctttgtaactcactcattcactcacttgctaacatgttcctaaccttgccccagcttcagtttttttcacttataaaattgagacgaactgctggaccatctccaaacctccttctggctctaaaattttgtgagtctagttctgagcaagggtttacattggtttcacgacagtgtggaatactttaacaattcaaaattgccattacacacttaaagcaacttcattttggaggtttgttgatttcatgactgggcaacagaaatattattcacaaactttgtggcaatgacaaatatatttatcccaaaggtaaatctctactattataattcagcagatggtcagttttcaaatttcatatttgccagacaagctttctttttatggcctgaaggaaacataggcagggactcacaggggagggaaaacagtacccaatccatgaaagtattaaatattacatattattattattattcggtctttttttctttttccattttttttttaaatacagagtctttctctgttgcccaggctggagtgcagtggtgtcatcatagctcactgcagcctcaaattcctgggctcaaatggtcttcctgagtcagcctcccaagtagctaggactataggtgcatacacaccaccatgatcggtaattttttaaaaaattctatagagatggggtctcactatgctgcccaggctggtctcaaactcctgggctcaattaatcctaccacatcggcctcccaaaatgctgagattataggtgtgacccaccatgctttggcccattggtctttagctatgtaaagtatggacttacagttttaaaatatgacatggaaagttcggtgtgccaagaaatgggcaatttattttcccacttgtagagattcatgagacttttgtgggacccaccaagaaatatggacaaggaaacctaacaaataacagactctcacctttctctgttgagggacgtgggatcatctagatgaattcagttattacattaaagaaatagtcattaaaatttgccacaagggattttcatctaaatctcaacccatagaaaaatatcaaggagaaagtggccatttttatctaaaagaactttgcttttttatcatgtcagtcacttggtgagttctccataatctgtgtgcttttggtaaaaagcaacatacatcagagtttaattgacttaaaatattgtatcttaaaagatatcatgtaatgtgcccttacaaatcaaaacttgatttgattagtttgaaatgtattattttgaaaaataatgtcagtcgaaattggatttcagcaatatgtttttggtaatcacatgaaggagaatgttaggtatcttccaacatttgcagcatatttactgttaataacacaccaatatagaaattagctatctaatttactagaaactaggtataatttcctagtgttttgagggggtagaaaggaaaatgcacaaacaggtttccacctttgaaatgtatatatatacatctaactacaaaaatttatcttttttcctttaaagtgctcattatactcaacatcactcaaaataagtgaaagggcaaattaaaccataagctgggatcattatttcacctactattttcacaagtatgaaaaaagctgacgagtattcatattgctagcagaattgttaactgttaacgtctatggagggcaatttgacaaaatcaatcgaaatgataaatgtacttactttcagctgcaacaattccatttctaggatctttttcctagagatatacaaaataatgtgatacagagctattcactgaatcactgttcatcctgggaaaaactggaaacagcccaaatgtctatcagtcaggaagtagttaataagtcatcatacagtagtataatgtagccttaacaaagaaagaagaagctcttaacctaccgataggcagtacattccaaaatgcatttaaaaggtatatgcagaacagcatatatgtttgccaccctctgcataaaaagagggaaagtatttacatatatatgtacctatgcatatatccatctatacacatatgtgtatacataaatacaaatatatgtacacacaagaccctgacaacatagattctgcggaaaggaaacccttttcccagaatagaagtctggggacaataggaggaggaggaaagaaatcactgcataccttttgggaccttttcaattttgaaccatgataacatgttacttattcagaaataagctaacaaatttgactaataaattgttcactgataagcagtaaatacatactcatatgtattatcatttaataagaacttgaagaattttttttttttgagacagtctggctctgtcgcccaggctggagtacggtggtgcgatctcagctcattttgacctccgcctctcaagagttcaagcaattcttgtgcctcagcctcctgagtagctggaactacaggcatgtggccaccacacctggctaatttttgtgttttttagtagagatggggtttcaccatgttggccagaatggtctcgaactcctggcctcaagtgatccacccacctcggccttccgaagtgctgagattacaagcatgagccactgcgcctggccaaagaaccatacttttaaaacaccaaaatagttaggccaagattgctcttttttaaagcaaaagagatatatagttaaagacatgaagaataaaaattaggcactcttcctctttcccagtctcttggaattcttataaaataataaattaaacctaacagtttggaggaaaaccaattaaagggacataaatcatcattaaccccttctccagatgaatgacaaagagacacgtgttctaattaacaccgagtaacattgtgtaaagagcagtttgcagtggaaatgaacagatggcaaacaagcaaaagaggtattggagagcaagaaagaaaacttgatctgatgctgaaaacttcaagcaactgaaagaaattatatctcaatgaaaatagctctaaaaggatggatgaactcgccgattcaactttagtttttaggtacatccagttttgctgctttcaatattcagcccccacaaggccaatactattccaatccccatcccactttctgtatttgcaaacaaagccacacaccaaccaaccaaccacctctttacaacagaaagattttctatccctaggcaatgaatggctcagttatttcaaaccaagctagcatttcagttcaacaaaaggttttggacatcatcttggggtctaatgtaacaagagctgacctggaggtttatgctttaacaaccatcccctttctttcctttgaaacagagatttatgacaggaggcagagaagggggcaagatcccagggttgatgaacccctggtatgaaccaccgtgcaggtacgtaagaagttcctccttctgcttcccccttgctcaaaggcaaactggagctaaagtcatggggaagcatagcaccacttcctcttgttttcaagttcatcctgtttttaggctctttttggtggaaacaagagtgccacaagcaatcaagtctcattagctgaaccctcagcaaagaaccagtgactgactccatatgcgggagacttcaacccagctgacagatgctatttctctctgtccctgctgacccaggctggggagacagcatatttcagacaggatgccctcccaagagttgtgatgcaaccctggaaaaaatatctgttcaagatcccaagccaggatctggtttctgccaattcagagtgacagggatcagcggctaagacactggccattacaggaggtatgttgaatttacacatatttaacaatagcagacacttaatattctcgtgtcttttattgtttaacctacatagagcattttaaattgtacattctgtagtgcataatggttggataaaaaacaaaaaacttcgggtaaacatccgagacaattcttgctctccatgtaaaaaaaacagaaatgttttttgtttgtttgatttttgaactccaaataaccactcaaagaaaaaagggagataattggccaatcaggttatctttagctatatcaacaacaacatttaaggctgagaattataagtacaaatgatttgtgtaatctgaatgttcagacttagactgacactttaactcatgtgtttagagaggaatatagagatacagatcataaatacacacacagcaggctgccgtatatattttatataaaacaggcagtttctactaaattacttgaggcattaggattcaaactcaattcccttctctatctgagacagcagactcctctggtctgaggatatttttaaatataaaagctaattatcctatctcactgcctataaattcaatttctatttctgaggctgcttctgttgtagatctcttggtagtccattcacattatagcttgtttacaacccagtctaaaatcacagcaaagacagagattgaaaaaaaaaaaaaagctttttaaccttttaggaagatttgataatgcagcaggattttcataatgatacagataatcaagtccattttctatgaaacaagagtttttaagtggcaaattttatagacaaaatgtagaaagtataaagtagactcatgagtggggctaacgccagggtcggaatgctttctcttggttaggtcttccagcaaaaccaatcaaccaatacacatggaaaatgcatcatacaaacttttcagatcagagctggggctttgccttgtgtcagccgacgaagaactcccaaggccgttctggattgaatctcagcgtagagatatgtaatatgccaccaactttcctcccttctaccggctcctttgaaagagagtccttcacaagcagttcaaggaaaaagcacattaacaatgacaatttacacttaccagctggggtggtgaaggttaaaggcaaaccaaagtaaactgacaatgataaagaacttaaaagcctatgctttaaaaaaaaatactcaaatctgtccttcgattgctaggtcggccgattagctgtacaacccttggcagtctcttgaactctttggacctcatttttcgtgtctatgaaatgagagagttgaacctagcgactttgaggttcctcccagttctaaccggtcatggtttatgatcaaaggctgtggctacacccctgaccacccacccctcacaaagcctcacgcctgactcctccctcttaaggctctgtctatactgcgttgtctgaacttcacaggtgatggtggcaaatgaaggtggcatgacatctttttgttgcttggtctttacaagcatctcagatcaaattaatattaaagagggaaatagacaaatgaaataagactactaagatgatattcttcacaaaggaataaaaacacatattcctcaaaaaggaggggaaaaccacttttggaaactctctggacatttttttccaagaagggacccagggagccatttttacattgtacttcctcaatcctcattcttgaagctctaaatcttcttgttttccatctcccttgagattaggaaggagggagagatattttttctctctatcctctgagttggccaaatctggatgactcctacatgcctctacggtaatttcctatgctatgctaatatctgggacttgctggtaaaccttaattaggtccatctaccatgggagtcaagcttttataaagatactctttttttttttttttttttttttgagatggagtcttgctctgtcacccaggctggaatgtagtggtgcaatcttggctcactgcaacctcctcctcttgggttcaagtgattctcctgtgcctcagcctcccgagtagtggggattacaggtgcccgctaccatgcccgggtaatttttgtatttttagtagagacagggtttcaccatgttggccaggctggtctcaaactcctgacttcaagtgatctgcccatcttggactcccaaagtgctgggattacaggcatgagccaccatatgcagccgattttataatgatactctaaataacacttttcctacactggatatgcacaaagatcaattggtgaacccttcccacccttgtttttgaagcaaacggaactgcagggcaacaagctttccttccacctgccgcggaggacctagtaaaaccccgggtgtggagtctgcagggatttctgcctccaaacccaccttcccccaaatgaagaagctttcaagcatttggttgaatccaagtattcggtgacctgatgggtaaatataaataaaagcttaatttttaaaaccaaaaattctgaatccagctatgcacacgctgtagagtatagtgctgctattacatttgggtcctacattcacgggcccaaacacctattgaccaacacatctaaggacagaaatagattctgccttcacagttttgtgtgtggcccctgcagaagtatttatttgaccactatggtatacatattcactcttttgctctaatatccttttatataaaaaaaaatcaaggccaggtgcagtggctcatgtctgtaatccctgtactttgggaggctgaggcaggaggattgcttgaggctgcagggagccagtcacgccactgcaccactccagcctgggtgacagagtcagaccctgtctcaaaaaaaaaaaaaagggaaataattttcgatcaaggtttatgtaacttgaagaccagtgagttactggagatcatgttaaataaggttagatttcatgaaaacacactcagcaacaacaatgcctttcactcctgccccaccttcactcaacaacagcaagttaaagtggctctccccttcctgtcctccccgggaccactaaaccaaacctctcagtggccaaaggatggaagagaacttggaatgggtgtttccattctggtgctaaatactacacagccgtgacccttttcttgagcacattttgagagtgccccgagtgtcacgaataatgagcttcatattgtcgaaaaataaaaataaaaaggacttgcttaagtagtttcatatgtaaactaacagagtagttattgtttgtaatttccagtttagggtttatccaattatctctctactgtctggaaggccaggcatgggggattccagttacaggaaaggcatctgccatggccaacccttgcaggccaagcaaaccctggcgcagactgcagcagatcccactggggtgcccacgtggtggagggggttacctaggaaaggaaggtctcctggcaaaataaccctagtgtgaggcttaacttactaatttcttctaaccactttgcaagaatctgttatttattgcaggaaaaggaatcaaaatgagctgggagtgtgtgtatggtgggaagggagtgatggttgaaacctgcttcaggtgacagccaacacctgttattgtaaagggtttagggcacaaaggacaccatggggtgcccccaccctactcctcattagagggaggcctctgatggatggtctaggtggctctggggtagaaagacagacttctgggtgagtctaagcttgagacagacagaggtcagcctggtacctctgcagctcactcttgggggccgagtccttgctaagtgacacagaaacctcagcctccccttcattatttttatgaatggcagatctctttaaaacctaggttgggtcacttcacttccctgatccaaactgtctgctggcttctcattacatgcaaacaaaacccaaaatgcttgaaaaagcatctggaaatccatgggggctgttctggtagtcacaggacaattgggagtcattagtggcatttaaggggtggggccagacaggctggacaacctgcagtacatgggatggtctagcacaagccacaaatattctatgtcccccaggactttccagtctcccctggaagggctgaaaagcctacgccattttacctgtcaacacaagggtttcctccatgattttcataaatgctggatttcaatagggaatgatgtactttgttttgtttagaactttactaacacgtattcaccatttcagaaatatcacatcactaaagtcaacaccgattatgtcatttgagtggccaatataacacatctgcagccatctggatttatagctgccacgtttgcagtgatcctacaagtgggtgcaaaacatatgaccacaccattatgtcttccagtgtagtcatgaaatacttcttagttcatgatacatttctccccttttgtacttcctttctattacagttaaggcattgtatggatggtttgtaatgatgtgggtagataggttatattttctacaaatttcatcattgaagagtgaaaagggtgttactaaatatctatcataagaagtgaggttttgggtctggccagggctgctttcctccatctcatttcccgccactttccctccctcccactgcaatacctctttctcccctgttggcatgcccagcctttgtcctggaccctccacctgccccctgtctgggagactcttctctcagagatccacagggctccttcgtcacttcccttcctctgtccctgactctcctttttcttcctatagaatttatcagagctcaacattacatcttctatttaataatttctcgactgtctctagtactagaattaagctctatgagagtgaggattttgtctatcttgttccccagcaccaagaacagtgcctgagacataaaaggcacttcttggccgggtgtggcggctcatgtctgtaatcccaatgctttgggagaccaaggaaggaaaatcactcaaggttaggcatttgagaccagcctggcgagaccctgtctctatataaaaaaaaaattgttaatgagccagtgcagggtctcatgactgtaatcccagtgccttgggaggctgaggcaggaggatcacttgcctgggtgacagagggagatcatgtccttttttttttttttttttaaggtatttattaaccttagtagatgactaaaggaagaaacacacatacaaaagtctggtcctaccaatgggcttagcttccccaggaaccaggaaattttactctcccacccctataaccactgttgcaaaatggctttctcttccactgaccaggtttctcatgcccaccctttgctaggtaaagagtagtaaaagagaaaatggccaatgaaaaggagggggaaacactttttaaaaataactatattttcaggacaggctctgtgtgagatacactctaacgtggggacacgccacagtcctcagtggcccctgcccatcctcccaactcactgtacagaaacactctatggaggccaatatttgattctagaagccagtgtccctcaacccaacttctgcaactccatacccaacaaatgatgctcaaaaacaaaagcagctattttaagatcactaaacactggctggtgatggcaaaactgtgtctttccttattcttttcttcatttttgcttttcatcaggccactgcccctcctacttccttaaaatgaattttactcagaaattatcaggaagaaatactattcaaatcaaaatctcagtagctatttttgtagatcttgataaacttactctaaaagtcacctggaagcccaaaaggccaaatacagtccagatacacttgaggaaaagaaaatgaggtgaaggtcatattctacaggatattgacaaagactctcctagatcaaactcaggtcgggctccccggagccttctcttccactagaccctgaccttgggcttccttttctgtcttatagaatccagtttaagcaagaatcctactagttttagtgaaaattctccacccttggtatctgtcctcacccctaactcttgatatcttatcaccctggcctgccttcagcaagaattctgttgagttggtctagcaagaatacccctgtctctgatgtttcctcttccatccactgaccccaccctgctgcttgactataaatcccctcttgtccttgtagaagttggactccagcccaatctctctcctcaccacagcaagacctcgttgcagcagtccctctacctatcacaatgttcccctccttgaataaagtcttctctgccatttttaacaaatgttacaaatatttttccttaacaataccaagacttatagagctataagtaagacagtgtggcattggcacaagtgtaggaaacagaccagtggaaaagaatagacagactcataaacagacccacacatatacagacacctaagttttgaaaaacctaacactacagcgcattagaaaaaaagatgtcttcccccagtaaatgtggctgagttgattggatatccatgtgggaaaaaaaggaaacacgcccctcccaaattcacagcattcatataactcaattccaggtgcattatgtagatataaatataaaagacaaatgatacaacttttagaagttaacataagagaaaatcttcatgactttgggataggcaacattgtcaaacaagacacaacaagtgccaaccatgaaggaaaagagtgataaatgaggttacatcaaaattaagaaattcttttcatcaaaagattctgttttgagactaaaaagacaagtcacaaaatggaagaatatatttgcaacacacaaaattaatgaaggatgcatagccagaagctgcaaagaactcctacaaattcataagaaatagaaaacagttgaaaaatggacaagagacttgcataggcacgttctaaaagaaaataagcatatgaaaagattattagtaataagtaatcagggaaatgcaaattaaacccacaatgtgatactcctgtgaacatgccagaatggctaaaattaaagagactgacagttctaagtttggagagtatacaaaacaacaggaactctcatacatggcattacatctacaacaatttcactatttggtgtgttcccaatagaaatatatgcacaaggcaccaaagaacaggtacaataatgttcacagcagcattatatatcataacaaaaacaacaggatgaataaatacagtgggtgaactttcacaataaaatacaacaaggaaaatgaacaaactttagcttcatgaaatctcacaaacgtaactatgagcaaatgaagcccaaaacacaaactacatacactacaatttcatctacatgaagttaaataacaagcacaactaatttatatcatttagggtgacatacttaggtggtaaatgtgtaaggaaagtaaggaattggctaccataaaacttaacataatttctacctttggtggaagatacagggctatgattgtcaggggacatggccttatgggggctggcaatgccctgtttcttttacctgcatgatggctacaaagtgtttactttaaaatagcccaatgggatatacatttatattttatttacattttggtatatttattatacttctaaataaaagattttttaaatgaaggaaaatcataaatcaaaaagatagaagagtatccatgccaaactgcatgagatcataggctttggagtgagacatacctgtgatccaatcctacccctgccactgactaattgtatgaccttgaatgagttatttaaactttcaaagcctcagtttccgtatctattaaatgaaggtgataatatctatttctcagggttgtaaaatgaattaagatcctatatataaagcacctagtagaacatctggcatactgtaagcctcaagaaatggtagcattgcaaattgtatatctgataacggattaacgtccagaatatgtaaagaacgcctacaactcaataacaacaaaacaacctgattttaaaaaatcaacaaagaacttgaacagacatttctctaaaaacaagataaatgaatggccaatccgcacataagaaagatgctcaacatcattaatcactaggaagatccaaatcaaaaccacaataagttaaccacttcacactcatgaagagggccatcttgaaaaaccagaaaataagaaatatcggtcaggaattagagcagctggaacccttgtacactgctggtagaaatgtaaaatggtgcagcttctatggaaaacagtatgatggttcctcaaaaaattaaaaatagaattacaataggatccagaaatgccacttctggaagtggaatttcaaaagaattgaaagcaggcactcaaacagatatgtgtacataccgttcatagcagcattattcacattagtccaaaaggggaagcagctcaagtatccatcaataaatgaacggagaaacaatatgtagtagatccattcaatggaatatcattcagccttcaaaatgaaggaagctgtgacacaggccaaaacatggatgaaccttgaagacatcatgcttagtgtaacaagccagtcacaagtgtgagtccacttatgcgaggtacctagagtagtcaagttcatagaggcaggcagtagtatggtggttgccaaggctgcaggcgtgggggaacaggcattactgttgaacagatcctgagtttctgtctgagaagaaaaaaataatctggtgataaatggtggtgatggatgcatgacattgtgaagaaacttcatgccactaagctgtacactgaaaaacggttaacatgataaattttatgttacatacattttaccacaatttaaaaaaattattaaaaaatactaacaataggccaagcgtgatggctcacacctgtaatcccagcactttgggaggctgagacaggtggatcaattgagctcaggagtttgagaccagcctgggtaacacagtgagacccctgtctctacaaaaaaatacaaaaattagttgggcatggtggcacgtgcctgtagtctcagctacttgcagggctgaggcaggaggagttcttgagcccagaaggttaaggctgcagtgagccatgttcatgccactgcacttcactctgagtgacaaattgagaccttgtctcagaaagaaagaaagaaagaaagaaagaaagaaagaaagaaagaaagaaagaaagaaagaaagaaagaaagaaaaagagagaggaaagaaagagaaaaagaaaagaaatagtagcaactgttattgtaagacatctccacacaccagagaagttaattttaattttaacatgttaagaacagagagaagccaacatgtccaccttaggctgacggtttgtttatttgtgttgttgctggtagtcgggtttgttatttttaaagtagcttatccaatacttcattaacaatttcagtaagttatttcatctttcaacataaatacgcacaaggatttcttctggtcaagaccaaactaatattagtccatagtaggagctaatactatcacatttactaagtattctatttgcaatttgactgtagcccatagccttttgtcggctaaagtgagcttaatgctgatcaggtaaattaaaaattatagttaattaaaagggcataaatgttacctgactcaataagtcatttcaattaggtctgttatcacaagttcttgacacatgtaattaagaaagctaagctacaggtcactctttgatgatgtttaagctgcagttctgattatcttcaaactgcgattccaatccagagttgtaactagcagttatttctctcatggaccaaaagatcagaattttccctggaagtttatcagaaatgctttcaagtttcaaaatacttgcctgaagtatcctatagtggccttgaaaacgatctgtccaaatacccagtttaacccatggtttaagaaataaagaaagttgacttcatttatttgtcttttttccctcctaaatggcagtttgatttgtaaagcacggcaatggaatgaaaatcttattttcaaggtcagctttaacaagcattcaatatctcaaatgccattacacattttacttactcaaaacaccaaaaagtcatcaacacgaccctcccaaaatctactaatgacttctgtgaaaggcactgaatctttgtaattagacaaagtaagatcatgtatgtcaaaatataggccctggttcacagaaaatgcttaataaatagcagtaaatatatatagatatatatatcataatagcacaagttgaatgtgcagggtccatgtaagctaaatttattatcccattttagctgaacagattttagaacattcagtgattccattccattttgtaaattactgatctgtaccaattcaaaaattcttctgaaactcaattcccaggcatttggcttttgttcctgggatttccactgctttagagaatccagctttaatgggcttctttctgagaaattctccattggttctgagaagtacttctattgaatgctccatttaatttcattttgcaattaatgaaactttcaagacctatttcccctcttttgaaaaatttctagttatttttttcttgccttttgggtaattaggagcagcaaactacttccactaagaactaaaggcagtaagtatggcaacaaaaataccaaatgtcaaaacaaatgtcattttccgagttctgaaacgcccatctctcagaattaaaaacattccatgtcacctctacgggtctttggttgctagctctcaaatggattcacgttctgatttcagtaaaattcaaccaaaagcttttagggtttttaatcttccttgacaaaaatacttaaccttctccagcctgggaggtaccgtcttttcctgcctgtgaaactctaccagtttggtaataaaacaaaccactaatttagttgtttattattcttagcctaaagatgtttgcgtggctagctgagtacaaatgtactgtatctgcgcttcttctttttaaagttttaaacaaataatcactgaacaaaatcagccaggaatgatcttctgctcatgggaaccgtatcccaacccagaaccacacgcagaagagtgcagggcctcgaggtctgttatctcaccaaataactttccctatgtggtgaaaaactggttaaatcacttttccagcgatcccggaattttcagttcaattctatccctcctaagtcaccagggcctctttggtaatggatgaaaccatgaagtttggttcagaggaagcaaagacacattcaaatgtgagactcaactgctccccgaggattcttcctgcttcctagttttaggtagatcaagagcacttttaaaataaacttggcgtttgtttcctattccaatggaaaatctgactggagactccacagcgacagcaaagaacccttacttttctggacaatcaaaatccggcttttgtcactctaactgcagcaggtcagcacacagggtaccagtgtgtccctgagcgcgctgacgaatggatatggtgctggcagccttggcctgggggcacttctgaggagctttaaaaaatactaattcctgggttcccctctccagcccagatatttttattaaattggtctgagatgtggcctgggtggcaggatttataacacttcctggatgatgttaatggaagccctttgaggtagaagaaggtagacaggactgactgggagcgcatcatcaaccacctctgcctccccactaagaagtctaagaataccccaaaataggggtgcagtggttgaggagaaaagagaggaagtcacgtatacttttgcaggctttcatgcaaggacccaagtgtgtgtgctaagcacagtccccaaacaggggaccccagaagtcctattcctaagatctgaattgcaccaaaggtagagagactcttcctggggttatttgaaacaaggcagactttgcctggcatgtatgcgccagacccagcctctgcagtgcttatgtggcaatgcttaagcagctcccagcactcgacagggtactttaaacaacttcattagtttgaaattttaaatccaaaaaaagctaccttcaaatgtatgactcaagagcataaaatttcagagcagagaacaccgccaggctagtaggtgaagcatcttatttttaaatggcaagggggaaccttgagtaaatatttggttgcaatgtattccaggggtggggggtttggacggagaggaaccactggtttttattcaaaatcctcctcccgctgggcccaggtcaggcctacacagctctggctacagactgtgagaatcctggaaggctccaggggctggctcccaccatgctccactccagcaagggcagacgccaggaaaaaaatggaaagggggagtcaggcatggaaggtttcagacttgctgcaggcaaaaggctgcagagcatccccagggagcagagacctcacaaccaggctccctacctcgctgtccttcagggccgcccacagctggctcacctgcagctgcaccacccaagagacagagacaggctcacacgcagcagctggagagaaggggctggaataaggattctttctaaacggaaaaataaagatcactgggggaacttctcgcccatccagcagtttgtgtgtactcagctcccctggcagggaatgagggcccgttgttccctgctgaagaccattgccctggagatgggatgggtgggaagaaaaatgtcagtaggggctctgtccttgctaccttctctctctggctgacctctggaattctctttctggctgacctctgaaactgagttctgggaacggaaggggaccttgtgatgctcccaacatctccccaagaatgcacgcccttagttggagctgtagctaggtaaggagtcagctgcaaactgcaccctccccacaatcttgtgacaggggaacatatgcaaatatgagatgggtcactgccggggaggtactggatgggggatgtgttcaggaggcttctgccagccatggactgaacatatgtcagccatgtggtacggttcttacacaaaaacagaatcctgagtttggtttcacaaacaggctcatctctcatctctgagtgtgtagcgggagagggtgcaccgtttccatgcagggcaaatctgtctgcatggggctgggggttctgcatctcagcatgggtttggaaagtactagaagtgcatctcactcaacttgatttagcaagcatgtctttgtggtccatggcttgtgttggcaacttaaatttgacagcacacaaactatgtgatggtgatggaggggcaggtatagcaacgtccagtttcccacctccaggtagtggcattctccctgtcctttctgcaacagcagcctgggaggttttcaatgcccttacttctcctgggtatatctgaactatgtcctgctcttatacacataaaagggtcacttgaggagctttggccatatggcagctgtttggaaacaggctgcctgatgcattgacaaccacaagaaatctggaagagtaaaacctgccccatagctggcatgctacttgtacattaaaatgagagcataatgtaaaagaaatgccttaacacttccttcactaggttcaaacttgctgtgattatttaggaattcatttcatttaaccaaatatgaattgagcaccttttacacagttgggggcaggggtgtccaaacagacatgaataattatgatacaaaacctattgtatatatacacagaaaatggatgtagacacaaaatgaataaacatgaaatgaatgtagacaaaggataggttaattttcattgaaggggaggcaggagggttcaacaaaggagttgaacgtagctgggacgtaagattagggcaggagtaggggcgaggattgggagcagaaagtaaggaggacagagaactttaatgggaggtagactggaaagtgggctggtgccagccctgaaggtcagctgtacaccaaactctgtagcttggtatacaatgacctctgagccaaccttcagggctggcattctgaaggtcattgaaggggaggtaggaggatttggtttgcggcagtttccaggtgagaggcaagaagtaaggagagaaggcagagatggcacaggatggtgggaagggagtccttggtgcccaatctctgccaggcagggtcctatcttgctaccccatgatccccacatgatgattgcatggagcagatgtcattatccccattgcagatctgggtctcctgggtccctcctcaaaataagacccattcaaaagacacctcctacaacacgggtctgaactacaggtctcccgaggccactatggaaggatactggcactcattcaacagcaaaactgtcccaaaacatcttctgtagacatctgtccctctccagcgttttgcttcttgtggcagttgttctcttttctccgtctctcacttctctctctactacccccttcttggatcccttttctcacaagagctctaggccaccatttcttactcagagtgacttcctgcttctctgatctgcccatcagttgccccagttagcaagatgaagggtcctcctcaggaaccaacctccttagaaagtattagaattctgtatgctccttattttatactctggctgggtcacattctaacaaggaaactgaagcttggagaaactaagtgtttctcaaggtgctcaacagagatgttttaggaagataaatggcattgacgaagaggatggatgggctgggaacaggtgctgaaagagaaggataccaatctatgacattttggaaaatacaaaactctagggatatagaagagaagagaagttgccagggctaagggttagggggtggcgggcagtttgagtacaaactctcatcatgaaatatgtttggggggtgactgacctgttctgtatactgattagagtagtggttacctctctgttcatttatcaaaacccacaaagctacacaaaaatgatgaattttactgtaggtaaacttaagaataatttttgaaatgacaggaagactggctaggaggttacagcatatgcaagaaggaatgagaggttgaattagagcagcagcagcagcaggataaaaaaataataaaataattttaaaaacctaaaaaccagagatctagggaagagagacttttagaagcaggattcagatatgtggggagtatgagtgaagaactcagatatgcagactttcagggctggaaagaatcttaagagatgatccaggaaagctctatctcacagatgagaaaaccaagttgaaaatgatttaagagtttggggctctgtctgggtggacagtgatatcattaagcagacagaacagacatagatgagcaggcgagaggaggaagttgatgagttcattttggacattttgattttggaacatttatgtcaccaagatttctttttttagtttttaggaatttgaaaacaaaattgttgggttttggcattgagtgcaatatctttccacaaatactgtttcattacagctacaatgaaaaagaactttgaatacagatccctacatgaagatgacacattagcttcttctgagttgtttttgttttgtgactttccttcagcatcacaaagagggaatgacactgacccagcaaagattttaggcacattatccattaacatacttgccacgaacactaccatattttcatgtgtttatataacaaagcttttccttccttattaaaaacaatacaaatcaagctttgaaaagcagttgttttccattcttactgatgctaggctataattcactgctgttttgttttcgttttagaatatttagcaagcaaccaagggaagatgggcattgacttgctattagtcagtaggcacagcctagtgaaagtttccatgctgcacatagggctgaaatcaaggagtcttttgtccatatttcagagcaacttggaaaatgatttggttcagcagtcaaggggagaaaagaagtagagttttcaacaccatcacagccattgggatatgcaaccaattttaagaatcagaaactcaagttgcaaactaccaagaaagcataatgttcttggcagcaaagtttaatcacagaagaacaacataaatataaagctaatagtatttacaataactgtctactgtttctttaagagctgagtaaagtgaatgcaaagatggtgagtctaaggaagaatctagaatgctggcacatttaggcagggatcttgttttgcttgctgataaacctacatgcgtagcacagtgcctggcacataataggctctcaatatgtaattgttgaatgaatgaatgaatgaagctaggagagaagtgaacaagtaaagtaagagatagcaaagccaccatacttcattcatccattcagcaaatgttactgagctcttactaatgtgaggcctttttttaaggcatggtggtggatatacacaagcctaaaataacaacttagaaaacagccccgggcctcaacatgtttataacctggaagaggaagaaggaaaagtatagcaaacatttgtatatcaaagtaatatcaaagagcatgtgacaaggcctggaaaaatggcacaaaaaaaaagaaaaaggctgaaaaggtggtaaagatttagaaatcagcggggtcactcccaacagggatactgtcatcctgaaggtgagatcagatctgggccttaagggatggagaattctgatgggaacagaatactctgggatgtaaaaacagcaggaaaaagatccccagaacagagaaggcagggcgggttcagagcatagcaatcttgctaaggagtagcagggaatgatgaagaaaatgtcacataggttgcagtgaaagatggagagaggaatttgaacagctggataaaggaaaatgaagacttacctaggaaaagaggagccttaaaataaaaaaaagggtggctcatgcctataaccccagccctcgaggaggccaaggcaggtggatcacttgaggtcaggagttcaagaccagcctggccaacatggtgaaaccccgcctctactaaaaatacaaaaattagccaggcatggtggtgcatgcctgtaatcctagctacttgaaaggctgaggcaggagaatcacttgagcctgggaggcggaggttgcagtgagccaagatggtcccactgtactccagctgggtgacagagcgagactccacctcaagaagaaaaacaatcagggaagaattttaattaaatcatcacaaagtataagataaactggagtgcggagaaactggagcaggtgaatgaattcccctagggaagagttaagaaggtggtggcagcaagaccagtgagggaggaatggagggcagtgaaggatgctgggctcaaaaacctgagcagaagctggaagaatgcaccctaggttttgagcctgggtgatcggaatagtgatgagagcaggaagagaaactgttgagtccaaggaaggttttggagggatgacgatgagtttagtcttggattaaatattttgattatgtgtttaatttgaactgccaacaggaagtccagatagaaagggtcatcaggaaatagtatataagcagaactggaatttgcagaaatacccatttgagaatcagctgcatacagacgatacggaagctgtggggatgaaaaaggtcccgcacaagagaatcaggaaaaaaaaagtgagacaatgagtcaagacagacagtattaaaggaacttcccaaccatttgctcaatgtaaaaatggaaatgaggcgaggtttgttcccttagaacatgtttttcacagcaaaagagaattcattcctaaaactggtttttatctcgagctaaagaaaacaccttaacactccattcatagtaaggaccatcacagtaatcctgtgtgacaaagctcaggataaatgccatggcaggaatttcacttgaatgagatagcaggatggaaggaaggaaacaggagcccttgctttggagagatcacctttcatgggctcagttcaggcttcactcagcaggaaaaaaatctgcaaggcttaaataagtacttctatttggtagaaggcaatggaaaagaataacctaattcatttaatctgcagttgccacagatacaaaaacaagagaagatatgaacactgtgtgggccgaatgtttctttcctactcccaccctcatcccactcggccctctttcccaggtcattatcaacatatttcaaaagcctccgagatggtgataaagcggctcaccatctgtgaactcctcctccacagaagagtgataggtctcaagaacaaaccttcctaccttagcatggaacaaaagcctgacttcaacacccggcacccacagctgttttccacgaatagaaagaacacagccaacccaactggctctttgaaggtacgccatccttttcctgtggcctaatttatgctgcagattgaaaagtgcaaaaaagcaaaaaatggataaggttttcacaagagttacttagtagatgctgattttcttccaatatcaaatgcttgaggcgcatatgattggcttccatttctctgtatttgtcgaaagaatctctaaattgttccccaaatgaattattattttgactggggacactgaagttcacggttatttttaaaaactacattttgcaaaaagttatcactcttcttaccaaagattcacaatacagtgttgatgggaacgtgacctagttggacagctaccttcagatatgcctgatgcccttcaacaggtcatcatttgcactagaaaccaatactcatcaagtgtcaacaggtccacagccccgtcctgaatcattcagaggaagttaaatacaagagtttgcaatttaaaccaaagtgtaccatcccaatctgtaaaagactcgggaacacatgaaagagtacaaagataaagcaaatagccttgagttacttagtttagttggaactatttttgtcacactatcaaccgaggccctggagtactcatgagtatttctttttttttttttctcaataaagcgggaaaaaatgctgaaagaattttttagatgtattcctttcttgtgttggaaagataatcttactgaaacaggaatggaatctagcttatgtctctctttcctattcttagaatcctaaacaaagaaatgaatgtctacaaggtggtttggggaaacagttagaagattcccatgggaagcaagttaaattgagagtccaagaagactagaaaccactttatatcagtgctgggctcacaggagagctaggtgataggagaaagggccagtgatgtggacagatcatgatagtgacagtgaagagagtccaggtaagacctaacgaatgacttaatagatcaactggagtggttttagtggataggtttgcatgtttctaacgacacagaaacctacaaaatagttcactggttttcagaaaaatactggaaggattcatcacaaactcctagccccagccaaccccagtgcaaaaaaaaaaaaaaaaaaaaatcatgcccaatccttcaaaagattcatatgtgcagggttattactctagacatcagcttgcctgggaccatcctggcctaccctattgtcccagaataatgattaataacaagtgtctcagcttggatgagacatgttatgatcatcttagatatgaaagaatggcaatctaataggttaatgaatatcaagacaaaatacctttagaaaggctttcctttctaattgtggttccagactttatacagcgcactcacacgtaccatgctagctgggatctgcactctggtaatagaaagggggggcttgcgcacagaaggaaatgggttcatgttggcaccacccaggtgctcagcaaatggacagcaaataaaccgtcgttgaagaaaggcaatgaaagaaccctcttcaccaatgtcttgaatgaatggttcttcagccatgacacatcgtactgaggaatggcttaacagttctccttgattctgggagtgaaataagtatgggggtaaagagcatcaggaagactcccactgcaggaaaccctgtgaagaaagtgctgaagaaagcgctctcccaccacgcattagggaaggagctcaggagctctctgccaactgcagtaggcacgggcccagagacagaagatttctgtggtctgggcacccttcctgctgctgcaggtgatgagtaataatagcgacggctctcatgtcacaacctggtggccgctggaccctcactttggttggagggtgtgtccccacaggggaagttcacaagagccaagctgggctctgagcttcatgcaacgtgcaagatgtgcaccaagacgacctcacccctggctggactcagccccgggacaacactcccaccccgcagagcccagccaggttctcagtggccccaagatagcacacaagcagctgggatgggaaaacaaggtttagtaatatgaaaccaaaatactcctccagcctgactgcactgcccaggatgaaattctctctaattccactgaacatcttaaaccaaaacatattcaaaccctgaacatcagcagcactcgtacttctcttttttggggctgtgaagggagggtggagtgctgcaacagaataacaattttcagcataggaaaatccccaatatgcaggttgtcacctgcttgatctattttcctcccaaccaagttaagcaatcaccaacagttctctatgagatatcttccactgagattaaaggaacgaccagcaagaaacagtgtatgtgttgtggtagtgtgagtgtgggttttcaaatgggtacattcctagaagacgggacagcaggctctgaggaggcagctttgtggaagagactggggtgtccagaggaccttggatatctggaatactcacatatggtgcttgttctggggctggggggagacaagtacatatagaaatatcataaccagttttctccagtaaatacaccaaaacaaaggaaaatgggatcaaagtatagccagcaacgtgaaaagtcccatttcaaaatctaaagtaagattccaaaatagaacatgttttaacagagtatgtaaatttatggaaacacttcctcacccggctcctgatcttttataggtacctctcatgcaacagttcagctttaaatcttttttaggaagcagctggctaccagagatcttcactcctgtgctttttttctctttttttttttgcaaatctagcatctcctttccatgtgatgcactatgcttggagctggcagagcaaaagcctgtcattcttaaaacatgaagagaataattcagcgccttattttgtgatcacagagaatgcaattaatactttggctgccttggtatgtagaccaaaccttctgccacagtgttttgcagtgctgttgtccagggcagctctgccaatcttttcattccaacagaaacgatgccagacttctcggtgctaagcaaagtataatgaggcggaagaggtggctggaaccctcagtgagggaatgtgctcctgggatgattctctacaaaatacaaagctatctcaagatccaatagcttttgtatccctgcatttacgaaacccaattaaaataaattctttaaaaagaaaaagtaggctgggcagggtggctcacacctgtaatccctgcactttgggaggccgaggccggtagatcatttgcggtcaggaattcaagactagcctgaccaacatggtgaaaccctgtctctactaaaaatacaaaaaattagctgggtgtggtggcacacacctgtagttccagctactcaggaggctgaggcaggagaatcacttgaacccgggaggctgaggttgcagtgagccaagatcacaccactgcactccagcctgggcgacagagtgagaatccgcctcaaaagaaaagaaaaaaaaaagtagttaaattcttatgtcattcatccatggtccaaaagctttttaattcatagaaggtataagacagggaaaatccttctaaaccgagaacatgcagtgatttactaaatcatatgagcaatgttggagaattactatctgtgtaacactagactctgaagataggagataagaaataattataatttggctgagttcggtggcttacacctgtaatcccagaactttgggaggccaaggtgggtggatcacgaggtcaagaccagcctggccaagacggtgaaacccccatctctactgaaaataccaaaaaaaaaaaaaaaaattagccaggcatggtggcgagtgcctatagtcccagctactcaggaggctggggcagagaactgcttgaacctgggaggcagaggttgcagtgagccgagattgtgccactgcattccagcctgggagacagagcgagactccatctcaaaaaaagataataatagtaataattattattattattataattcatagaaagtgtagggacaaggagaacagagagaaccaagaaagacaagtaggtataaatgtttttagatattatactacaatatgtatgtattggctatagttgcaaagaaatcctagacccaacttgtgtctgtcaagggccaagtgaatggtccaggccaatgatctcatttgccatagacctcagtgcccccagcacatcagacagcagaaagagcagcagtgagaagcaaaacctttataccatcattgatagcttattaatacaattcttgctgattctctggccttcgaaactcatagaatcacaaaatgttagtgagggaccctgtaactcaacttccccatttgcagatgaagaaatgaaagctcagaagagtatatgacatgcccaaacagcaagtgcctggcgggtcagaagaatacaacccaaggcccgttgccctaaatgtcctcaacaactacacagctctcacccatatccacctcctcttcttgatcaattctctcttcttccttagaactgcacctccccaacctttttcctaagccatccccaatgctgggtgactacctgggttggatcccttgcctctttggtccagggtacctgccttgtccttccatccctcaaggactaaacccagtctcaggattttctgacaggtgggatccaccaaccttgctccacgctgccaggaattttccctaacagtagttgactcccaacagaagaaaacgccccctggttgtgaccacatgcttgtctcaccctgaccctgcccttccccaatgggcctcaaaattcagcaagtcttacctttacactgaatatccactataggctttgattactgtgttttattagccagctgcagagcatgtttgtgtgtatttacatacacatgcacacagaaatacttctaagtgggctgtgttctatcatctttggtacagaaataaaagtaaatatttccatgcataaattttagtgtatttttaatagacactagaatagaagtcgaaagttctatttccaaccttcccaacccagctgtaatggtccagcctggcaagagttagaaactactgaagtccttttttttgagacaaggtctcactctgtcatccaggctggagtggagtggcacaatcatggctcactgcagcctcaacctcccatctcagcctcaagggatcctcccatctcagcctcccaagcagctgaaactacaggcacacgccaccatgattggcttaattgttttgtgttttgtagaggcagggttttgctaagttgctcaagctagtcttgaacacctgggctcaagtgatcctccagcctcggtctcccacagtgcggggattacaggcatgagccaccacgtccacccagaaactactgaagttttattcttggcttaactcttagggcaggctggcaacagtgacctcttacacttcagtatgctcacctgtaaaagtatggtgaggccttccctgcccagctcagcagactgacaatgggagccacaagaacatgaatatgaatgaactttaaaaagggctacacaactgtagctcattgaagaaaaaaggaaaggtctttctatcctcctatatagtaatatccaactatgggaataaaaaggtgaccacattgtgcaataaatggttagcagtctagaccagtgctgtccaatagaaatataatgggaaccggccccgcacggtggctcacgcctgtaatcccagcactttgggaggccgaggcgggcggaccacgagttcaggagattgagaccatcttggttaacacggtgaaaccctgtctctactaaaaatacaaaaaatttagctggggatggtggcgggcgcctgtagtcccagctgcttgggaggctgaggcaggagaatggcatgaaccctggaggcggaggttgcagtgagccaagatcacgccactgcactccagcctgggcgacacagcgaaactctgtctcaaaaaaaaaagaaagaaagaaatataatgggaaccacatatgtaattttaaatttttagtggtcacgtttagtatattttattaaactaatacatccaaaatactatcacttcaacacaaaattcttataaaaattattgataaaatattttgcattcatttattcatactacatctttgaaatccagtaaacctggtgtgtattttacactccaatcgcatctcaattcagattggccacattacgtgagcctggtagccacagccacggcactggagagggcaggagtagattttagacacaatgttatggtgtcacaccttggtggcacagagcagccttttctcagtgcctagcacagtgccttttagtgactaaatgcccaatcaagatgtgtaggatgagtaaatgtttggatatatactgtgatcgcagaaaatctgtagaataagaggaagaataaaggactttttgaaaaagcattagtctgtgttgaccttttcctgttcccaaaacacagaagtcttggctcgcagactgccaaagggaaagccgctgctcataatgaaattccaggcgtggcatcggctgatggggtgagccattccttcgcaagccacctttaacctgcctctctgtggacttgcctggcctctcaagtggctgcttctaaaagcccaggaacactgctgaaaacagatgagcacgtgtccctgggatccgtattcctgtgaaatcatttgcattctattaggcaaatttgcataaaattggagccaagagagcttggctgggtttccaggccggcactctctctctgtgctgctatggccaccagtatttatcaccatttaccagggtggtcgagcaagacagacccccaattagaatcggcagacaaatggaatctcttccctatgctgacatgaaaatcagtgtcctctggggtaaatgagtgaaggaactccgagctgcaatctggctgccgcatcctttgttatgacaagagtttattttacacgactctgacctatggcttgaaaacacagctcagtcgtggttgtaatgatccagaacggcacacacacctgaatgccaaggagctcagattctggcccatgggccatctgggaaaccaaactcaccacccttcattccagaaagccaagggcttcgactcctaaagcaaggtttaccctcaagggcctctcctccttttagctagctatgttgatggcaagctccaggcaaggtgcaaatagctacctctaaatgcacacactcatccctttctttgggacaaaggacaaaagtcaaatcacagtgatgcccaacctacccatggccaagggaacaaggtaaattacacaacagagaaggacaaaggtggaaggaaaaatacacagaaaacaatgcaatgctattttatattttgttatttttatctcaactacctatctctttctaggactattccccagagaaattccattttcattacaaaactagtttcttatgccagggaaaaggctgcggagctgttatcattgccattgttatttctactaaggtcatctcagatggcatgtctacgtgagataaatggtttcctaaacaggcttctctgcatcctgccaccacttaggtttgccccgagtcatcacttctggggccttgaaagcagcagcttcctggaaggctcaaaagctgggcggcagcagagcaacagaattaagggctccaagtactccaaaaccgcctgggttcaaattccagcccagccacccaaacagctgtaatgggtccccctctgcaagcctcagtgttctcatctgcaagacaaggataaaaacaccaccacctcccagtactgttgtaagaaagaaatacacgaatagtgatagaacgtttagaaagagttgggcaaagtacaggccatgtgaacctctgctttatcactgttgtgagtatagctggggtgtcactttaacacttgcttgtactgcttgtcatgtgtacccagctgcctgtgcattcattcatttagtcaatattactgagcatctattatgtgcttgccttgcgctaagcactgagtgttcagcgatgatcaactgtgcacaatcttgttgattctaccttagaacaccttttcaggtagtcccatcctgggagttcctactgcccatgccttggggcagctgcccagcaccttcacttgggcacctgaccccaccttcccatctggcctccttgctgccctcagtgccaccaacacactgctaccagcagtattttcatcaacaaaaaaatccagccatgtcacttagtatcctgctagaaaccttttactggcattccactgcaggaaaggtctaatcaaactccttagtggggcacatagagccttggagagcgagcctccactatcttcccgcttcatccccttccattccatccccaactgcctctcttctggtcactctggcctttttgccattcccaagcttggcaggcccttcaattactctgcttatttgcatatggtaccctttcacattctccagagagcaagatctcttgctttttttttttctttttctttttttttttgaacaaactcttatgtatccttcaagcccaggccaaacggcaccttctctgtgaaaccatccttaactttcccaggaaaaaactcactggactgtaatagatctgtttgtgtgtctgtttccccaggagactgtcccccccaaggccagagatcatgtccagaaacccagtaggcacaaagaatgtggaacaaacaaatgaccacgttttattgtacagtggtttcaaaatgaagtcaggaggcagagttgaggctgcaaagcagctcctcacaaaaaccactctatgcatcctgcagtgggggaggtggctcttctaaatatgtgtacaacttaatttatgcacagacagaataatttagatgcagtaagacagcaaaaactccccctagaaattacatccccgtccacttgagtcaagttcctactaattctctactctagaaagggaggtaggagatgaaaaagaatgaaagaagtcagcaaacgcccctgaaggtctctctgcctatttaacacacacacattcacagagaaggtgccatttggcctgggcttgaaggatatgtaagagtttgttcaaaaaaaaagagaaaaaaacaaaaaagaaagagatcttgtgctccttctctctctctctctgtgtgtgtgtgtgtgtgtgtgtgtgtattttactttgatattgctgggattcctctctttcactacagtctggactgaatcatttcacacaagtaaatttttcagatgactgaagcctaaacttttaaaaaattttaaccatttggaatggagatatttctgtaacttactactcactttccctgaactctttgactcttcctacagaaaataactctgtcttgatgactcagtggcatcattaggaatcactaagattgtcctgtgctacgatccagcgagaactccaggagccgtagagatctttgtgactgcctgccccacgcagaagagcctcagagactcctgagctggttttaagagcatttttgtcttcttccttgctgtcagactctaaaataattctttgaataatttacaggcctccattacctcctctgtcaggtcaattctaatttaatatatttgctgtttctattggctgggtggggagtggaaatgacaaccaattttttgagaaaatggacttttaaaaaagcaaatggtatggaatattattcagccttaaaaaggaatgaaattctgatgcatgccatgacatgggtgaactctgaaaatatgttagataaaacaagctagacacaaaaggacaaatattgtctgattccacttatgggaagaatcaaattcttcctcgaagagtcaaatttatagagacagaaaatagaatagtggctacctaggactggggagaaaaagaaacagggagttatagtttaatgggtagagtttccatttggaatgatgaacaagttctggaaacagatgtcagtaatggcttacataataatggtttatgtaacaaagtaaatgtgctgaaagccactgaactatacatttaaaattggtggaaaacgtaaattttatgtatatcttaactcacacacacaccacatacatacatacgtatgcatatttatacagatatatttttacatgaactggttgagaaggttggctgagctcttatgagcaatgggtatgaactttagcatatgtacttcatgacatccctctgcacagaaggggctgaaatgacttcctagttcctagttgtgattcacaccgtcatcaagaaacaatgatctccgaaggcgctaatgtattttgcaatcataaagatcttttactcacaaattacagtactggcgacaaacaggcactccgagcttcttggagaacattatgaataatcccaaagagaactgagctccagaaggggcggggctttgtccttttcacacgggaaaccagtgcgcctgtccacggcacagaatccaaatctactcttcccttctcctgagatcaaactctagaactaagaggtcacatgtaaagctgttaaaagaacaaaaatactgattatctgaattcattaggatcttaaggatatgtaaaaactacataatgcagtcttttaaatattacaatgttgggttatgtcttataaatgaaatattttaggtaatattggacgaatatttttaaagtagtctggtctataaaagagaggaggccaggtgtggtggctcacgcctgtaatcccagcactttgggagggaggccgaggcaggtggatcatctgaggtcaggagttcgagaccagcctggccaacatgatgaaaaccagtctctactaaaaaaaatacaaaaaaatgagctaggcgtgctggcaggcgcctgtaatcccagctactcgggaggctgaggttgcagtgagccgggactgcaccactgcactccagcctgggcaacaagagcaaaactccttctcaaaaaaaaaaaaaagagagagaaagagagaaagagagagaggaaatagttggtggcttgttcagttcaactaacacagagcctggggtttggggagcctgatggtgaactctgtcttgcttaatgaaaggtcactattgtccctctgcccgaataataatttcccttcctttttggcttccttatgaaataccacgaagctctactctaaaaagtcataacatgttgtgcccagggaagatgttgaattgaaattttttaatatgtgctttattaaacaaaccacttaaaacattatttttgtccttctgaagagtgacttattctgcacatgaattcagagtgagttaaatattcaacctatatatgtttcataacacaagagatatataaataaatgagaaagtaggggggaaaaagaggtttagtaaggatgcagtaagagtttcctatcttgtcagaatttcgcgtttaagtttcttttaagaaagtagtttcctggcccatgctgaaactcccttagccctgcaaataacacaagggcatcctgttcaaatgttattatggaaacactgtgctgttctgggccaaatgtatccaaattaaactgagggggatggaaataactctcccttgatacgccctggttgctgaaggtgggtttgtttttaagtagaataaaatgtacagctgaatataaaaacagatacatcctcatcttgtaaacctgagtgacatgtcattccacctctggactctagaagaaaaaaaacactaaggtcatgcctaaaataaaaagagtgaagggaaaaggatcataccagaggtaaaaccgcagactttccccacctttttattaaggtattaggcaggttacaatttgacagtgagatcatttctctggaaccaggaaggcactgtgggtttgtttttccaacgcacactctgacccctgtaagagcttctgaatcaggtgtctggtcttggtaggaaccagtgattagtacttatttttcaaaggctatttaaacagactctaggagtcaaaagggagacagaaaaaaaaagttgtttcatttattttttaactatgagagaacttaaaattacatgttgtaggaaagatttcaccttctagttattaaaataaagatgactaactggcttcctaaagaacccaaaaggtcacatgcataaagttgttcttttgtaatatgtttctgtttaaatttttgttttaaaaatttaagttccagaggacatgaacatcacttggattgcctaaataaaggatgctggttttgcctcttaccaggcaaagtcaattgactttgcagaacctctgtttccgcatctataaatccacttcctgccctcagggagaggttattgaggttaaataatctcctatccctaaaagtgttaaatccagggtctggcacatattggggttcaataaatattcatttccttccttcctcctgactttcggtgactgaggccaatgaccaatgttgtcataaatggaaatggggaaatgagaaggatgagtaggtaaggaaaagattgcgctaaacattttagccaaaaatagtaaaagtctctttaagttcatattgttcatggtaactcattttaaactgatgtaagggctatattatactaatacatttattatttttaaggtacaacactgttttcaactattaatgaagaaaaacccattaaatctcctctgtgtaaacttgtagtactgcttgaaaaatctcaaagaccaaggaagaagttaatattgtcccatcagcacccttgcactgcattgccctgttttcattactttgtggcccttatgttatattgttaatttttaagttgtttacttttctgacttcctcacaatgtgggattcacaagagatgggagagttcttaacctgtcatgttttctgttatagctccagcccctagaacaatgattggcccagagtaggctctttacagtaaacaaatatttataaatatttgttgattgaatgaacttgcagtaacatgccctttactactgcggaaaccctactgatgaaggctccaccattttcaacattcaaaaaacatgtaccaaatatttttggtcacctaaaaagaggagcccagtgttatttttttaattttatttagttactaaaggagatagtgtctcagtcaatgctctatgagcaaatttaaagactctgaaggacttcttcatatttattagtgtttgttcttttaatttttttgtttcacatcctttttaaattttttaaacttttaagttcaggggcacatgtacaggtttgtcacataggtaaacttgttggatgttgttatacagattatttcatccacccacgtatcaagcctagtacccattagttatttttcctgatggtccaatgcggcattttcttgggaaaagaaaaaagaaagatggaagagcaacatttacaggactacacttacgggcacttccgattaaagctaattacaacctttgaaaataataaataaggactctgaggaattcaaagaaataaaggcagcaaacagcatgctaacataacaccgttgctagtcaggtgtcaacaagcaaaaacagtcacacatgttcatctaattccaattggcccctgttgaaaggggctgttttacagggccttcaagtgttagagacctcgcacgtcaatcctactactgtcccttcagctcatgtccaagcccgcctggctcataagcgcatcctcacagggtcttgagctgatggtaggcaccaaatggaagcagctagatccccctctgctgcaagcatgagaaacgctgcaaaggctgaatcgaagaagggaaagtaaccagaaacaaaagactgcattccaatttccctgaacatttttgacacagaaagcagtagagtatactagttttcaaaatgcaatatatttcagtctctactaagcaatcttgtgtctttatgaacacatatccagagaagcagcacaggataaagaaatatctacgggattcccaacccagggaatgaatatcagctcttcctgtgcttattggctcgtacacacctttgttgggcgaactttcttctttacatgggcataaacaaataactaacagtgtgtgtggggaggaaagtagggagaagttggaatacaatatctgccttgcttagggttgttgtgaagatcaaatgggccaacagatatggaatttttttttagaaactttaaaatcctacgtaaaggcaagaaaccactgtcatttttttcacccggaaaaaaattctatgaaaactgcctttcataattgaattctttcctcaaatatacttttattaactgatagttaataaagatttatcacacggtgaattctaacaaaaatagtttttaaccagacaattttttaaaagtgaaataagaaaaaatatatatttgtataaggtcaggtgaggtgacccatgcctgtaatcccagtactttgggaggcggaggcaggaggattgcttgaagccaggagtttgtgaccagcctgggcaacaaagtgagatcctgtcgcaaaaaaagataagacagacattatctaggtgtggtggcatgcacctgtagtcccagctactcaggagactgaggtgggaggatcacttgagccccggagttcgaggcagcagtgaaccgatatggtgccactgcactccagcctgggcaacagagcaagaccttatctccaaaaacaaacaaataaacaaacaaacaaaaaacacaaaaaagcatttatatataaccagaacaatgaccacattctttccaagttgtacagaaagaccagcaaagctgaggaagaactgagccatgttctaaagcattcagtcaatcattacctcttccaaaaaatctctccactctagtcctaatcattgtgcaaagctagcaatttcttgccgttcccactaccattcctctaggtcaggcacttgatctcttgcccgtttgctgaaagagccttctatctggtcactgatttctcccccgtctcattaacggtctggagtggagtcagggtgacgtatctgaaacaaactcttccagggtgggccacctctagcatcatctttctgacccacccacttgcactctccactccagccaggctgaactcctcagctcctgcagtccaccatgtggccgcttgcctctggcctttgttcctgaagttctgcctggggccacacttggttcctcccacccacttcactacattgattcctgctcatccttcaggcttcagtccccttcctgggaagacttccttgactccaataaatgccaccactattgctgcatctcttctcatagctttaaacatgctctcctgcagctgatgttgaatggtcttcactcccccagaccaagcttgtccaatccatggcaggctttgaatacagcccaacacacatttgtaaactttcttaaaatattatgaggtttttttgtgctttttttttttttttagctcatcagctatcattcgtgttagcgtattttacgtgtggcccaagacaattcttcttcttccaatgtggcccagggaagccaaaagattggatagcactgccctagactatcagccacgccgctctggctctcacttcccacttccccagggcctggctcaatatttttttaaaagtatggtataaatgaataactgatctcttgttctgtctgctttaatcatgtgactgagtgcaaaaaaacaattacccacttaaaaacacagagatgcaagtgaatcctttgccataacaatgagcccactctttatcaataccctgttgtgccaaacaggtagagaggttttaaaaaagagtcaagtatcccaactcatattaaatttccccatattctccatattttaaaagcactggtttagtcatgggtgatgccctttaagtattccgtacaaaaggtattttcaaattccaatgacatgtactttcatcggttaatttttaattgagccaaatattaaatgttcacattaaccagacaaagcatttttagctactgatttgcagtgacagcttgtgttattctcacacacaggccaagcatgaaatagaaaactaataaccccttaactgtattctcaaagtatcatttatgggaaagaaaactacattcaaaggaaacttgtgcaatggctgtcatttttttccctgagccacaagctgttacaaagcaggagagctcattttctcacagatacggacaagctcaagaatcccactgtcactggatgtattcattaagaaggaatctggcagcagcacaggggacagatactttggagaacaggccaattatctgggtgtcctttataatttgaagtttctgaattcactcatagataagctgcttgaagagggcctggcaatgggaacataatgcacagatggccactgaagaaacaagagggaggaagggaggctggaagagagaagagaatttgcttgtggtttcattcatggggacaaatctacaagctgacacattcatctttttaaaaagcccctggagaagtatggtcaagcttcactacaagtaaacaaatcaaaatctttctcaaacagatgacaactgatgagcaacaatgctttgagtttgcttcatgctaacggatgagggttctcaaaatacaaattccatcagttgttaaaaccacagataggctgtgatgctggcttgaaccagaatagagaactcagccaaaagctgccaggccaatggttttatgtaagacatcccaggtggtcttcttgttgagcagtgtctttagaaatggaatcttaggttctgtcgcctctgggaatgccgcactgtactgacttccaccttcaattggctgcttatttttatgggagaagaacgaggggatcatttatccttgtgacttttgtgctgcagttctttttatatttgagctacaacactgatcagagttaaaatccaccttgctcccactgtgagaaccttgggccagccctgctttctataatgatggggtgatgaataatctcagccttcaaaaccttttcagtctgggttaggcttgagatgtgaaacaaaaggaatgagagcaactaggcatatgtacatacactgtgtgtctacaaccttcgtataaacagatagaatgtgacaaccagcaggctggtatctatattagcattaaggaccaataaatgtcaaatgtttaatatagagcaaaatctagatttctcttcaggaataaatgatatactttttcaattcaatgaaaaggatgaaatcaaaacacttaataggtatttttcttctttcatttctattaaatattaatgaacctgtaggatgggacatttcagacacacacacacacacacacaaacacacactataataaaagaagtaggagaaaattagctgcttaggatgaattgctcagaatgccctaacataatcattttattcattcattcaataaacagtcattgtgtgtgcctattacctactatgcttggtgccaggttgaatttaatagaagaaatattttattaataaggaagtctcaatgagaaaggacaccttgattttgtaagacctagagtcacacatagaggatactattaggatatttggaacaatactaatttgactcaagttgaagtactcattaagttggcaaactggtagtgggaagccaagctttgaacagcaaagctgcaggttaaccaccttaacccaatccatgcaagtctacagattacctttgggaaaaggtggggtgcaaacaacagtcgcaaactaagacagcatcagcagtagcatttaggaccacttagggcaatgaaagaaggcaaaagagaaacctacatgattcgaggggaaagacatattatggttcaacctcaatttttctcttgagatccagatccttatgtctaaggcttactgggcatttccacttggatatcctactggaatgtccaaaatgaaattcatcacatgtacgccacaaagcagtaactgttgttatctttcctttccctctggaagacagtatcattttttgaggcagccaggatggcacttgagtcctgattctttccctccctcattcctcacattcgacctgctgtcagtcctttgattctacacgtgcagtgtgcccacatctgtcctgtcctttctgttccaggtgcttcagacctcatacctggtctcccccgtccaggctcagtcactgtcaatcttcctcccacgcacacatcctgccttgtctgagaacctttgcaacatcctttcaacatccctggtacagttaaacgcagccatccttcagtaacctcaggggattggctctaggaacccccagtggataccaaaatctgaagatgctcaagtccctgatattaaatgagtagtacttgcatatgcacatcctcctatatactttattttatttatttgtttgtttatttatttattttttgagacagagtctcgctctgtcccctaggctggagtgcagtgacacgatctcggctcactgcaacctccgcctcctgggttcaagcaattctcctgcctcagcctcccgagtagctgggattacaggcgcccaccaccacacctggctaatttttctatttttagtagagaaagggtttcaccatgttggccaggctggacttgaactcctgacttcaagtgatccacccaccttgagctcccacagtgctgggattacaggcctaagccactgtgcctgccctaccccatatatttttgatccaaagttggttgaatccatggatgtggaacccaaagatagggagggctgtctatacaagtttcacaacttagtatgcagtggtaagttctcaaaactatggatttatctcaggagagttctccatgccccagtcaaatcagactctccacaattccccaaacacacctcccgcattcatgcctgctttgacgcctccagtttccactacctgaaagaccctctccccgtatcgcctgcctgttctctaaaacttgtctcaacattatctccggcatgaaactcttcagataccactgtagctgggttgggcctctctgtctactacacattgtccaggattacagtgatttgtatccttgtcttggtctcctactgattggtaagttccttgaaggcaaaagttatcttagacattttttcgcttaactaaaacacctagcatagagctttgcatggtgtagggcctcaataaatgtttttttcaatgaaacaagttagtgtgcatgttttcctaaataaccagattctaaaacccctctccatgaccatcactaccccggttcctgggaacccagggttaagttttgtggacaattgctcatttccctcaattaggacttcttcaaatcattttcttcttatactatcactttaatgtttagtaagtggctttgtctccctgttcttataattttgttataaaatacctcaaaacctctctgtgtgtcttcagtgtgtgtgtttttaaagatgctggcaggaatccataaaggatatggctaggagatagccctgaaattttacatccagaaatgccaatgctgccatcctttatggactcgctttttttttttcaagaagataaatcaatatttaaagctgatgatataatttgtacttaattttattcctattttaattgtaaatcagatatcaatatatctgagatatagcattgaactaagaagactaagtttatgtgtctcatgttcttttagaaaattctaatgcagctgagaggaatatttggctgcaattcaatttcagagttaatatagagatatagcattcatcatgttgtaaagcagaaaaaatatcatcctggttatctgctaaggagagctggaaaaagtcaagaagagacagcctgcaacactgatcctttgtttggtgcttcaagtattaaaattggtaaactcaccatactctgttgcagcttaactgtcttttcgacagttaaaaataaggaaatatggtaactggatctgtcacaagaaaagatgtattggtctcaatggagaaaacctcccctgaaaaattaaagcttcacttgacacagtgggttctcgggttgtttttgggagacatgataatgagcagagtggagtcagtcatcagtttctgactcattacatggaagccccagagagctgattattaactaaaaatggaatacgcttctatccctgaagttgtgaaggcaaaacaagaagcagaatggaaacacaaatttccccattgacgcatgtggcccaaacgcgatgctcaagggcaggtgtcttccacagttaacctgctcatggaatgtggttgatcgccccagaaaatcacccaagtcactctcagtatattgctacaaatggccataccagtatgtcagggagattccctttctcacatgtttaaaagggcgtttggggaagtagtccttaccctaagctattttagtttagttagtcaaacatttattgaagtctcaggtataaccccactataatcttgcactagaggaatcaaagtaagtacaaattttgccagcagatactatcttttctctgcacaggttaaagtttataatcactagaggaaaaggatagtgtctggtcacagaattttgacctgcccagctgcctgcagcaagtttggggtgagggttatcctctcactttgattagactccccacttctgctcccttttgctagtatctaagcgcattacggttttcttcaggtaaatcctacccatcactaattggaagttaacaaggagctacacctgagaggtccctcaccggtggaatgataaggcaggtaggggatggtcacaggggtggtggcacctatgagaaagtcccatggcttggaagagagaggaataatcattcaatccttattcacactgaaggacagatgggtgtatcttttgtctggcaaatggagggcagagaaatagtgctatagcatatacagaattgggcatatataagaacaacaagtgacaatctataaaaatatgtttttaagtgaaaacagctttgttggcattttgaaagttttacagtctccatttaaacgaacagaccacaagcccaaaaaagtccgaaggcaaatgccagtgttacaatggactgtgaatttctgtaactagcatcgtagaagtgtcttgataaatagaacagtaatataacctcaaaccaaaacaaaacagaagcttttttttcccctgctcaaaggaagagcccccgctctggttcaaaacctacttgtattttttggcatacaagagttatttaagaaagatagttcttcaaattaccctgttccagtcagtctaatcggagccttgattgtcttttacttaaaaagaattaatgaaatgctttagaaattgtagactggtgtttattaagtcttcttagtatgcataaatagtgcttagtgggttaatatttaacaagggaactccccctgcctttcagttctcttaagcatatgtctacgttacacagtattttttaaagtatctacattttggccctgtttaaattaggcctaatgcacacatgaacagccatatggtcagaaataacgttcttagaccaaggctgaagtacatgcaaaataacttatagttatttgcttttttcctctaagtctctgagtctaggatcatgcttatcaggctgtatgataactacgagtttattaagatgcctgcaacactagcctgtgagtttatccagggcagaagcaaagctctccttgccgtgcctccaacctaacccaaggcaggactcatgtaagactggcaatcacatctgtggaataactgtcagtccttggatgattttcatcattaatcctgcttagacatcaaacattaaggttgattaagccaaaccaagagggatgaaagagaaaattcacagtggagtaaattcactgagtggtctcctacatgtggttgacagaaaggatgaccagattgacaagttactgttatacctgaataaggtgatattagattaccttaaaaaggttgaacagaacctttgaatctcaaatacaatatatctctgggggaaaaagaaaacgttctacttgtacactacaaagacagtgttgttttctagcacaaatgcacttctgctgagatactgctttgctaaactactgctaagacacaatgagtgaccttagaaaagggtgcggaggtatgttgggtgggaagaaccactgttaacatgcagcacccacacactcgctcatgagtgggcgtatcatccctccaaatagcgcaataggactgggaacagagataagaaaaaacaacaagaattttgcttgccttttttttatttttaatttatggctttctgttacctggtatgctgtgtggcctgatgacatttaagtaatctgaaatgtaccagttcaatcaaagattgctaaaaagggcaatccattcttattagaaagtacagctgaaagtaacagaatgcgcaaaagaaagccatgttttcaatggacgttaaatagcaacaaaacagaaaagagaattcagttaactataaaattttatgaatgtccagaaacaatcacaccacagcacatgactgaaaactctatgagaaatagtgtgtttttctctactacataaattattgaaaggggtcatgtgattcttgtaggcagaaagatgcactttcccaaggaaagttcatcatgaaatatattatttaagactagatcatcttcaagctatttttaatcctatcgtcttgctgccaaaattggccataagcagccaatcctcagacactagaaaaatgatgctctttcatgtaatttgtacactggcatgagaatggtattgctttccagttaatcaaatgttttgctggatgtggactgccttgagaaaggaaaaactgcttgctgactaatgaaaaggcagctgaactctaccgggtgtggagaagttcctgtcttcctaaaccaccaacaccaaaaaaccaaaaaataagtcggattaccatcttgtcaacagaataaagccaatctcctacaatctcttgtctgaatcatctcattcttctagtggctcctatctcactctctcctaagacatgaagctgaatgtcgtcacagttcccagtttagagggtcactctccatcacctgcccaaaactcaatcccttgcctgcaagagtccctttgtcttaaagaagctgcaaggtcactaaagtcatttacagaatttaaactgtgttatgaggggataaaataataactaacagagctattaaaagagctaattctcttgcctttaattgaagaaaagctatcttactttttaatgggaccagtgatgccaatataaactatataactactacgaaaaatattcatgagaagactgggcttatagttgatctacctgcttgctatctctccttcatccaatttatgtcttcctaaagtcagatcacaatagtggacacctgggaaatactcggtattccaagtaacactatagatctttaaggccactggaaggggacaatgcagaatccatcccaggtagcaactcttcctaaaagatgccaccaggaaccaaggatggtagccagcatcgctaactttaacgtgcacacaaaccacatattctgactcagtagctctggggtgggagctgagctttagcatctctacaaagctccgggggatgcatgtgctactgtctataagccacactgagcagcaaggtatccacattttctagaattgcttctctctcactgcttcctctgtcctgcctctctctggatgccacacaatgccttattcagacctaggaataaatccacactccactctacagccaattacttctttagtctttatttaatttgtagtcttctgggacaatctatcagaggctgatcattccaaggacctgatttatccatgttatggaacacaaaagtcaaacagatttcctcagcctcacaaggttccaattttctacgagcagcagcaaagaaaaagaaatgacttgcagtctaaagcctggagtattcagtgtagtattcaggagatgggctaatccacggagccctggggacagtgcagattattgtcacatgccaagaaaatatgctagctctcttctgaagctttaccattaagactaccttacactataaaatacaacatattattagagatgtaaccccaattggtgtaaatgtgaagaaaatctgtctgtatgccaaatgcctaaaatgacttttagattaataatgcacatttgaaatgataggcaaatcattcatcattctcaaacactaccacttttattccaaagtgtcctatgagtgcatttcctggtatatatatatattttttctctaaattcctttgttttcctatatagtcaccatctatgcattgttctgaaagctattacatattttaccatcaaccatctgtgcttctacatgatttatttttactagaagcagttttgtcaaaaaatttttatcatgttctatggtatgtcattgtggtttggcatcataaaatgtagcctctacatttatcaacctcagatacctgttgaccacaaagataggtctactatgaaaactctgtttcacaaaaagaaaaaagtgagcctttacttaaaaagaaacttcagttacatgagagggtaacacactgaaattcagcaacaaatatcaaggttgtatcttaatttctgtcataaacatgtgtctctgtttcccacatttttattaacttatttgatagacagataccagttaccaccttggatttatttcaagtagaaagaaaatttgtaagtgtgaatttttcacaaaaatgtgaaatagtaaaactattaaatcagttttactttggtttaaaaggatcctttgggaatctggaagtcccaacccctttagttatagtgattaaaaatcaaaccacctacttaaccaaatatttaacaaaaatattcttttcaccctttagcaaattcttccagaattactaaagatctgataatgtgagatctcaacaaacaaacaattcaagaagaggatttaaattttagaaatttaaattggggcattttagttaatcttacttttaaacaccaaacagtggcatcaatattttgtcaactttggtcaaataagatcagatgttcacatcaatcatctacttttcttggccttttctctatttggcctcctagtatgagcacactttgtaaaatgtaataaaaacatgtggtgtgcttcttgacatctaatccacttgcagtaatttctaggctttttgctcctgttaggtcctataaaataatgacattagtcattctcccaagaggctataaaaggaagcactgaattgcatcctgtttttcaaagataactcttcagattaaaacaaaaagtgtaaaaaaaaaaaaaacttcacacaagaattactttttcataaattcatcattttagatatgagatatagatctccattacaatccttgactcttaggaactaaaccccctccaacaaagaatctcagaaaagtacaattgtatggtataatgatgaaagctctatctagcacagtacgagaaaaagatcatctcacaaatgttcttcaaagccacaggtatcaatcacttcaactaaagtaagggtaagataatccacagctaagaatcaattcttctacactttacatagatacctagatgcaaatttttttcagccgaccacaaaattaggtccactctgagtggtgaaaaacaaaagattctaacattctagcaaactggtaaaccatacacaaattatagaatacaaagaatgcagccgatgcaaattctgtcactgacaaggtagcaaagccatagcctgatactcctcaggacacctcatcacgcccactgggaacatggcacacactggagattccagtccaaggactttggaatgtcaacttagctctttacaaacacaactaagtttttcagggaaaaagacttacattggttttcctcttttggaaaattttaccgattgatgatgcccttggtcttctgtggagtctattcttctaatcgggttgttctccaattttagtgtacaacgggcttgtttcaggggagcttgtttgggatgcagactgtcaagacccaacctggtatctggttcataagcagtccctgaaacctccctccggttccaacaagctgctcaagccaggaaacggtggtcctggggactcctggaccttcagcttgagaaacactgaaggggtaccatttaccaccacatcctactggattacaaacgctagatctttggatctccacgactagcaagcaagttaaagacttttagatggcaggcgttatcggtcaggttgggagtgaacgctttgtccagaggaggaggtagggacgccgggaagcaacaactctgattttatttcgccggctccacagcctcccattgccccaggagcccacccgcactccaacccccgcatctcggacctgtggcctcagcccagactcacatcaccaagtgcacctacccagcctccgttatcctggatccaggtgtgcaggtgccggttcaggtactcagtcatccacagggcgatgttgtccaccaggggcgacatctcccggttgacgctctccacacacatgaccccaccgaactcaaagaaggccacaatcctcccccagttcaccccgtccctgaagagctcctccaccaccgtggcaaagcgtccccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaagaagaggagttataatccagctattttattggatgtgctttgcattcttggacgagggggtgtcttcaatcacgcggaacacttgattctggtgtttcccccttggcatgagatgcaggaaatttttattccaattcctttcggatctttatttcatgaggcacgttattattagtaagtattgttaatatcagtctacttcctctgtgatgctgaaaggttaaagaaaaaacaaactaataagtaaaaaatcaggtgcgtttccctgtacacactgagtgaaagcagggcatacacactacaagtaacacggctaaaaagaatgtattaagctgcctggaaattaaatttactcgaatgcactttaagtaaaaaatctcaaaggtttccattgaaagttacattaaaccaatttcctgtgcagagaacttacttgtattttttaagtacagcatgatcctctgtcaagtttcctttttgtaaaaccaaaacaaatgcataaggcaacgatcccatcaatcttcagcactctccagttatagctgatttgaaacttcccaatgaatcaggagtcgcggggagagggagtaaaaattaggaggatttccagatcgattcccagacttctgcttcacagaaa

SEQ ID NO: 2345 - DNA, 1427 bp, Homo sapiens
  source 1..1427: mol_type = genomic DNA
agcaacaactctgattttatttcgccggctccacagcctcccattgccccaggagcccacccgcactccaacccccgcatctcggacctgtggcctcagcccagactcacatcaccaagtgcacctacccagcctccgttatcctggatccaggtgtgcaggtgccggttcaggtactcagtcatccacagggcgatgttgtccaccaggggcgacatctcccggttgacgctctccacacacatgaccccaccgaactcaaagaaggccacaatcctcccccagttcaccccgtccctgaagagctcctccaccaccgtggcaaagcgtccccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaagaagaggagttataatccagctattttattggatgtgctttgcattcttggacgagggggtgtcttcaatcacgcggaacacttgattctggtgtttcccccttggcatgagatgcaggaaatttttattccaattcctttcggatctttatttcatgaggcacgttattattagtaagtattgttaatatcagtctacttcctctgtgatgctgaaaggttaaagaaaaaacaaactaataagtaaaaaatcaggtgcgtttccctgtacacactgagtgaaagcagggcatacacactacaagtaacacggctaaaaagaatgtattaagctgcctggaaattaaatttactcgaatgcactttaagtaaaaaatctcaaaggtttccattgaaagttacattaaaccaatttcctgtgcagagaacttacttgtattttttaagtacagcatgatcctctgtcaagtttcctttttgtaaaaccaaaacaaatgcataaggcaacgatcccatcaatcttcagcactctccagttatagctgatttgaaacttcccaatgaatcaggagtcgcggggagagggagtaaaaattaggaggatttccagatcgattcccagacttctgcttcacagaaa

SEQ ID NO: 2346 - DNA, 70588 bp, Homo sapiens
  source 1..70588: mol_type = genomic DNA
cacacagatggcacatggcagagcccaagccctctccatgagatctgcagcgtttgtccacacggcagggcaaattaccttgtagagtcagcatggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcaggatctgaagagctatggtgaaacaccactgaagcattgccaaggtgaggccctgcgtcttccgggttctttatcgtcttcctttaaattgtgcaaatggtgctgtaaggcctgtagtggggcaagcaagcaaggacattgctgtgggtgccacagacggaggaagaggcatgaatggatcgctgcctcagctatgaatagattgctccatggtttgtgcatttccagttttgagaatttttaatttataaaaggtcatccatccagggtagattctgctttttggaaaaggcagtgaatgtgccacagaggagagaagggacgtgggatgtagagagggggttgagcgggcacacacaggccactgctgcgctcccggcgagtcactcggcctcttgataggaggtgatattgactgtgcagagctgacagaggttagtggtcacaggcggggagcatctggctcaaggcaaatgactgttgctttcgttttatttgtttgtttctgaatgaagttgttccatttttcaggcattcaggaatggggtaactgaatagatgtaatgatgatcttcttgtttaagagatctatttcaccaggaaacaccaactgtgaaaaggaaagcatagttgatcacatattttgaaaggatttgtgtaaattgtaaggttttgacaacgtttccatttatctggtaatgcgggtggatgaagttcaccctcatccacccacattaccaaggaactaaggaattgtgcgtttgcagtaacagaagaaattgctgtgatatgtgcatatcctcctccctcgggagagtgggacttaattcccctcaccttgagtgaggtttggactaagagtatggaaagggagaaatagtagctctgtagaggagaaacctgcagatgccagcttcaccaagggaccaagcttagcatcaccgggaataagctgggctgctattgtgaactgccacgacagtgcggttcttcccaccaactcataaccccagtcaaatcatgagaaaacatcagacaaatccaaactggggaagattccacaacatatttcaccttcaaaaatgtcaaggtcatgaaaaacaaagaaagacaggcaaagcgtcacagatcagaggagacatgatggtcaggacacccaaacccagaattcgcatcctgtattggatcctaaagcaacaccgcaaaggtcattagtggaaaaataggtgaaattttaacaagacctggggtctcgctaatattgtggtaacaattactgcttagttctggcaaatgtaccatggttacgtaaggtgttcacattagaagaacctggtgaaggaaatatggaaattctctgtgctatcccttgtaatttttctccaaatctaaaattactgcaaaataaagagttaaaaaaaattagactcattcttcctcagagcaggagtagccaaatcctgagcattcttgggaaaactggcgttcatggcctggtgatcacaccttctctttgaacattctggaatatagcaggccttttgaatttttgaccatccatcattctctctcccaacccctacctgattccagaatagctctgtatttgcctctcttcatagtatttctcatggatgattatattgttgttgttggtgtccaatgggttttgtgggggttgtttttcgtttatgttttttgtttttcagagatggggtcttgctctgttgcccaggctggagtgcagtggcaagagatcatcgctcactgcagcactgacctcctgggctcaagcgatcctcccaactcagcctcctgagtagctgggaccacaggtacgccactgtatctggctaattttttaatcttattttttgaagagatggggtctcgctttgttgcctgggctgatctccaacccctggcttcaagccatcctcccactttggcctcccacagtgctgggattgcaggcatgagtcactgtgactggcccagcatgcatttttgagcctttgctctgtggcaggggctgcaggacggaatacactctcatctgcccagcgaagctcactgcactggtgcaggctcctggcaccccaagcacaggcccagctacccagacctgactcctctccaggaaggaagcagaaagccaggaatggagagaatgaggacccaggcccctgggggagtacagaattccagccaggaatctgccgtcctctgggctcaaccaccccacagaatctggtcagccaagtggctgtgagctgggctcgacagcccttcctcgagagtaaactgtggcctctaggatgtagagaggggactcaaagggccagatcccatttgagtgaggattctgaccttgtgagcccacctgcagcctggggtctgcagccttggggactggccaccggtggccagcatcctggcttgcagggttcacgtgtatagagaggtaacagcaagacagagaaacctggcccctcttgcaggcccagcagagcgggtgagccctactcaaaggtgatgctgcgcctgattagagaaaagcttccaaagcaggtgaggaggaagaaaaaatgatgaagccgcaggaagacagcacgtagatggaaatctcaacatactgagatggaaatcaatcacaaaactcttacaggaaaatcacagctaaaagttggtgattacatgtgggcctgcagtgcctttcctgtcacatctgctaccccactgccagcctgctgctaccccacagcagccctcccatttgtggaatgttccctggcgtgctcctgcttgcctgaatcccttccccaccttcccacctaggcaacttgcatttgctctgacgtccagggcaggtgcgaatgtctcctcccagtcacagtgcccaagcccatttgtgtgtccccagcaaccaccagcacacacccagggctctggtttgcaggcctgccaggttctctggaccaaagctcctgaggacaaggacatgccctacatgtgcctccaggtcccagcacccagcgcagtgcctggcccaccaggggtatctggtaaagtggttcttgagttaaagacacaagggcaaaaccttaaatgaaaatcaaggttaagacatgaggatgaaagcttgaaagaggaaaagcaaagataattgaatgatcatccctaatcgtggtgcaccccagtgccatcagcatgctggggttttgacaggacccttggaagaaagagaagaggcatctgaggcctctggcacattccacttcctgtaagacagtgtggtatagatgaaagcattggggcttcctgccagccaggtcagtctggctctgcacctgccagctgggagtgtgaagtgggagcagttgcacccactctcaagcacagacatgagaactgaacagaaccacggaatgggggtccagagcccaagacatagacgaggctcctccttgtccactgtggggcttgtgcaaccccttcatcaaagcgctggtgctttccacattgtaatcaaggaagttttctcacgttccttctcatcacaactagctgctggcctttttgcacactttggcacctaggatgctgaacctggaccagtgggaggcaaacaagacacacctgggatgcaaaatgtaaggaggctcccatgctcaggtcgttcaagtgcaggaaaagtttgtgtatgtgtgaaacgcacaatgccatgtggtgtctataagggcatttgaggttctgtgcttaatagatgaagtgggttctgagcattgagtctgtggattcctgatgagtttcctggtgctctgagctccgtgaacttgtaaacaagcttttgtgtaggtgggtacttacagtttttgtcagattcccaaaggggtctgtgaaccccaaaatatttggaatcacacagtcaaatatctaggaagactactttaattttctctctcagcgtgttgtggatatgaggaagtggaaaggacttggacatagaagtcagacaaagcagccacatctgagtggtctcgtcctgcagtgtagtggttagacggctggccttgtcaaccagagggctccagtgcaaggttcagccctggcaatgtgagcaagtcactgtgtgccttcctgagatgataatagtttgaccccactgtatacgagcagccttacctgtctcgggtaggttaattatatcctctcagtcttatttcttcattcattgataatagcacatcacaggattaacagaattaaattacaaagccctaatttttaggtgagttgaagctgaggagcacacaacttttcttacagggtgcactcaattctcaatgtcagaaccaccagggggtccttgtacttcaaaaagacacatcttacatgacaacttctttgatttacttttatgcccaatattcattttgaaacctcacaaaggagagcatggtgttgttgtttctcaaaagagaaagtaaatttagtaagattgagagccatgaacctagacacagtcacagggcacataagatttcggtcaatcacagactacatatatgatggtggtctcataagatgaagacactgtattttgcctgtacctgttctatgtttagagacacaaatattcaccactgtgttactactgcctgcagtatttagtacagtcgcaggctgtgtaggtgtgtagcctagaagcaaccggctatgccacagagcctaggggtggagtaggctctaccatctaagttttgtatacgatgttcgcagaacaacaaaatcacctaatgacacatttttcagaacagatccctgtagtgaagcaatacgtaactatattttgggaacttcccctgtatccagatagtcagtccaagagctgtgtgtttggatctcacagtgcttgagatcctgagagaatctcatttcctgagtcagatgtgggcattctttcttggcatgggtacactgccgtggcttgtgctgaaggctgcataagaaacagaggttggaaactcacagtggaatttattgctgagatgacgttaagctgttcgcattccacccaggacctccacaggagaagcccagagaggatgactctcagactccagatccaggaaatccatgcctctctggagcaatggatgtcttacagacactgtgactcttcaaactgattattttcttctttgtgcttggactccaggacacttagaacccaatttgcatctaaccactagcagtttggtgacagcatgtcacagtttgtatttctgtgcaccagctttatacacatttttttttctgccctaacttaccctttggtctaatttctttatctgtttttctatcctgttgtattgtatgtatttttataagcggtctcaaatcttttctggaaacactaggaaatgaatatataaacaaatacaagcaggacagcatttctgaaagagcctgatatacagtgagggtgctcactaaggattagttccctatctgtgtacaaaacagaaaaattcactgagggagccaacctgcagtcaaatgtccagctgtgagtttattacagttatagaaatagcttatttttacacatattccaccttagattgatttggggggtgtttgtttttgttgttgttgtttgagacaaggtctcactctgttgcccaggctggagtgcaatggtttgatctcagctcactacatcctccgcctcccgggttcaagcaactctcccacctcagcctcccgagtagctaggactacaggtgtgcaccaccacgccctgctaatttttgtatttttttgatagagacagggtttcatcatgttggccaggctggtctcaaactctggacctcaagtgatctgcctgccttggcctcccaaagtgttgggattacaagcataaaccactgcacctggcctgtttttttgttttgttttattttgtttttgtttgtttgagatagggtctcgctctgcctcccaggctggagtgcagtggtgtaatcatggctcactgcagcctccacttccccagctcaggcaatcctcccacctcagcctcccaagtagttgggaccacaggtgtgcaccaccacgcctggctaattttggtttttgtagagatgggtttttaccatgttgtctaggctggtctcaacctcctgagctcaagcaatctgcctgcctcagcctcccaaagtgctgggattacaggcatgagtgaccatgcctggctctaccttttatgttaaagtttatataaattatttcattttaagattcttttattcctgccatttctgtggtgcaattggatttttacataaagttaaataatactttttattttggccaggcgtggtggctcacacctgtaatcccagcactttgggaggccaaggtgggaggattgcttgaggtcaggggttcgagaccagcctggccaacatggtgaaaccccatctctaccaaaaatacaaaaattagctgggcatggtggcaggcacctgtaatcccagctactcagaaggctgaggcaggagaattgcttgaacccaggagatctcagcagtgagctgagactgccgctgcactccagcttggacgacagagtgaaaaaaattaaaaattaaatgatacttttaattttatttactattttatttgaataaataaaaggatcctttaaaaagtattacacacgaaaatagggtcaaaagtcatagcccattttcttgattttatttggtgctttatgggaaaggctaaactctctctcttttttttttttttaacacattagcatggaaaggaatcatttctactttgtggtgtctgtctgtctgtctatctgatgggctctctggcacctgccagcacactgggggaagtgtgaggtcaagataggcatcttgtagatgaagagcatggcgtcctggtaaacgtttaacaaccagctttccaggaaacaaatgtattgtatacatacataagtttatagtaacatgtactgatataaaggatgcgtagcacttaatttacaaataataacaaaatatgcaatagtctctgtcctaaataccgcagaggtgattgagtctcatagaaagctctcgtgactttgcactgtcatatccgtagccaagcattggttgcagcagatgagcaagtgtggtgttggcacaaacactgaaatgttcattcatgttaaggagcagatcaaagtgaaacaacaaagagttggggcaggctgcagccttagtgccatgagcggcttctttgttgaactgggtagtagtttttcaatattcagaaaagtttcctcaatgttttgtgctactcacagtgttctagctacagacaagatgctcttttaagcatagaaaatccatgaaacaaatcactgccgacctgtagcatttgcctgttcctgttgtataaatactcccaccagggccaatttcaagttgctaacatgacttgcgtgaacatgggttcgagatgcgcagcagcacagcacgatagagtacttccgccttatagacacagtcagttaaagaacctcaaagcatagctattattaagatgcagtaaaaataatcaggaagtgatgaggtttaagtatttataacctttgttttaatagaatccatttagttgtatcttgtataattcaactttaattttttatcattttaattttatatagtttttttttctttttctttcttttttatttttctttgagaaggagtcttactctgttgcccaggctgcagtgcagtggcacgatctctggtcactgcaacttccacctcctgggtttaagggattctcctgcctcatcctcccaattagctgggattacaggcacccgccaccatgcctggctaatttttgtattttaagtagagttagccaggctggtcttgaactcctgacctcaagtgatctgcccagttcggcctcccaaactgctgggattacagacatgagccaccacgcccggcccgtatagtttttataccttaatcttgcataatgatttgaataattcagctcacaaaattcctgagaatttaacaaccggctctagcataccggcacaagctggcccccagtgcatcactgacggggaggccgagtgtcttgaggccacactgcagatcagggtcctgcctgcagccaagtggggacaagtggagaataacttgcctcctgggctctcctgagtcccgagcctgacagcggaggcccaggtgggtgaccctgctttgtgctcggtggcaggggaaggggggtgggcctgtgggcctggatggagaacctgtccccatggctgtcatgtccctacaccagctgctgccagccactgtggggttcgcaagtccccactcgcaaaacggctactgttttccacaaccatgggatacaaggatgtccccttgggctccttctcatctctactctctgctggcctctttgcacagattgatacctgggatgctgagccaggaccagagggaggtaaagacacacctggggtgcaaaactgaaggaggccctgatgcttgaggttgttcaagtgcagagaatgtttgtgtatgtgtgaagcacacaaccacacgtagcatctaaaaggacatttgatgttctgcacttaatagattaagctggttctgaccttctagcccctgggcttctgatgagtctcctggtagcctgtcagctcctgatcttggatgggagcttgtgtgtaggtgggcactcttctgcaaagtgcgtttatggcttttatctggtttcctctgatcagaaagatctgggggtgctggcacacccagacgactagtaactcccaaagggagaggtgcagctttgtcacctgcccctgtgtcaggtgggacgtgagatgctctatttttttctgctccatcctgtgcccaagccttatacagggtgacccttttcagagaggcctttgccaccaggtcagtgtgagcatgtggctgggtgatttcctgccgtggaccagggatctgtgtgctgtctgaagtaagcaagggtgctctttcttggcaaggtctgagggctgagacttgcaaggagacacctgctctcttggtcaccagactggaggttcctatgtgcaggtgtggaggatggaagaggtcactctgtcctctttcttgcctgggcctcacctctgctgaggctgctggctgccctgggctcgcagtgaaaggggccatcttccaccctcccctgctggtcaagtgcatctttccaggttccggcactccacgttgccacccagacaagtgtcctgtgggaactagcaagtgggaatcaaaactacccccagagaggctcctggccgggagatgaagggatctaccctggggctaaagtctccccagcctttcttggagcttaggtcctggctttagaaagatcccattcacatccaggcacagtggcacacacctgtaatctcagtactttgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaaggaagaaagaaaagaaaagaaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccccctgttcccacccttgagatgaggcctgataagggtgctggcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacagacacatacatgcacacagacacatagatacagacacatacacataagaatacacacagaaacacacagacacccacacatatacacacatgcacagacatgtagaaatacctagacacagaggaacacacaaagatacacaggcacacatacaggtacatctacatgcttatcaaaaacaacagcaaaaccacctaccatgacaaatactattgcagcaaaactgaacaaataaattctgtgccataaagtttcctaaacctcatctattttgtagaaatctagtcacttgagtatcatccttcacaaagttctttctattctttctactgtacaaagttttctgttgtcaaatagcaagagatctctgttttctacttggaatgggcctggagaagggagacagcacccgctccctccaccccttgtccctgagcacagcatggtgacctgccaagccagagggtgacctggacactcataactcaatgcagggccaactgtagcctctggccggtgtccctgagtgagggcaaagttgtaataacacttgttctctcctttctccaatttgctcccaagctccattgctttcgttcaggccctcccccttctagactgggcagttccgcatccttggagctcatttctctgtcttcagaatctgatgctccaattcatcccatgtgtggctgccaaggtctttctaaaactcaaatgtggccctatcaccgcacagggtaaagccaccataaactcctctgtgtttgagaacaagggccaagtctcccattgaggcctccagggagtggacagtctgggtctcctttcttctccaagcacgctgggcccatctgtcctgtccctgaggactccctggcacacatgacacttcagagcttttgccaactccactccctgcctgaaatgcccatctccttcagagagcttctatgtatccttggaggtccagtcctaatgtccctgcctccgataagacctctccccatcttcctctcgccctgctcctgtccccgccaggcatgacaaatctcttcccacagtgggcccaacagggaggcagatggtagaacaggttttgggccaggtgccaggtgcacgtggctcttcatcctggttccccaccgcacacctggagagctgagtgcttttcctgaggtcacgcagaaggttaccagcctggctctggagctgtctctttgccacatcgtggggtgtctttaaggtgaccttgaatgtgcttgaagctgttttatgtcctatttgcagacctaggggaggacaatgccagggctttttgccttcccaaggtcacagcctgaagacactcagaaagatgtagttggctcatttatcattttttagaaaaaaagaaaacaacagaatgtgctgaatccttgtaactgttggccatggcactagtttcatggaaggtggaagggcaggttaggcttcttatgagggcgttcctggcctctggaggggtgtgggtgggctcaggtgaatgactgacagactggatttacgtatgttgagtgtgaatctcagtccacagcttggtgtgcaaaaacagaaaagctatctggtaatagctacatctctgttggggagaggaaactgacctctcaattcagggtcttcatacctttctccagggtggggtctaagttctgggagcctcatgagtctcaggaattctggggtggcctatttggtctttgtcatcagtccatgcagggggctgctagaatgtcatgtcagcctctgaccctggccaagccccctctcagagattccaggccacatcccaggttgagggatgcatcctcccactctggggccccccaggtgggactctcagggaggccacttgagacgcggttgcccaaactgactcaacaagatctctcagtcacgggctgaaagatctgcatcacgggctgaaagcaggaaagttcttttgtctctctttctgctttcctgtgacaatgggtgcagaaccatcgtgaatggttcaggtgcgggtagggaaaataacaaataggaggaagaacaatctcagaaaggcaggtagcctgtcccatctgctgacagagcagtgtgtaagcatcactgagcttgtgacattgatgttttttccaacatgcagtataaatgtacactgtgattttacaaggccaggagccaagtaacaacacccttggcagaggaagagtgaagtggggaaggaaactgaagcgggctagggaggaaggacagcttgacaactagttagaattggaaggacgatggactaggattgtaaaagaataaggcagaatgtcctaccttcccaccttggcaaaccctgcccctgggagtggtcctggatttgcagtggccctggcctggaccaccatgtagatgtcactaatggatcctcccaggggacgggcctgtcatggccctcaagaaaggcagggatgaccaccccaactgcaggggaagacaccacccaccctgagggcttttgggagcttttaaaagaaggcaagtcacgctttaaaagaactttgaagagacaggagcttagtggacccagtggagataaaaggtccaggtaaggagtggccaagcacttggaatttagaagaggcgaatcagaaagtcccaatggaccagcttgggggtttgggggttactgggtccatgtcaacatacagctcagtgggtgccaaagatcagccaggcctagggtgcagatgacagtgaggcaggatggtgacctggattaggactggagggggaacctgaggccaggagagcagggaagagattgctaaagacagtcaccccatggcaagctagttttctccccgagccagcatttctacacgtgagcactggccttgctgtctggctgggtgacttcctctctctggggttcagggcccagcactgctaatcgggggtagagtcaacggccttccagtgcaccctttggtggctctgtgtggcacatcaggcacactggtcaagtagggggtcatcaccaggccttgggtgcttctcaaacctaaagtcatgtggtcctcacaacagccccgtgatgtcatcaggaacctgcccactggcccagggctgggaaggactagagccaaagtgcaggctcaggactgtttgaccccaaagccagtgctctgaaccctccatctgtcttcattaaccaccgcctctgccactactgtaaggcaagagaagcgtgtcacggcgcgaaggctaagcacatgctgggaaatcacccgtggcttgcagacacatgcacagctactgggggtagatcaagagccaagaacgggtgagctcaagctgtgctcacatggggcgcgtgctaggtgactgtaggcctcagaaaacctgggatccagaacagctttcctccgctagggggctctggcacaagtttgcctgaagacatggccccatggcgaagccatcatgtgtgggaccttccttggccccctcttggtgagccacattcctgtccacgcagtagctccagcccccacccgtggcttttcacttcttccttgctttccacttctgaccaccctataccagaaggtacttcatgtcagtcctctcccgcattccctctgccttcgggtctcctggaattggaactgtcactagtcaatcattacttacggggatgtgcagaaagccagacactgtgctgggcctcgggcggcagaaataagacagccactgtagtgtcagctgtgtgcacccatctctccttctgacccaaacgcaactgtgatgggggccggtcctgccctttggggccatcagacaagggagcaactgacatttgcagaggccagaggagccgtggtggaggggttttctcagggctcgagggaggtgcctgcccatccactgagagctttgggaaggaaatgctgggcgccttttgtgcctcctactcatcaattccccccagctgcaggcaagggaggtcgttagcagcccagcctgtggggagcaagcaggccatgagctgcatgcagctggcactgctattacttaggaggcatcacaacaatgactcaggtgctgaccataacccttaaccaggtcacagtggctgcctaactgttgaagctgctacccctcctttaggttacaccgcacgaaaagttggcaatcctctctctcggtggctgctgtgggagcagctaacctcacagcacccgaagggatgtcatcgggaccccagctcggtttccagcatcagctgatgccagcaagaagccagccaggcctggggcttggcagcccagggactttaccatccaccatccacagggctgttgccctggacaggtcattgatatctgactcacagccaattcatggatgacgtgaatccaaaaatcagaggcccacgtggatttagacatggaaatgcctcaccagcttccatgagccagtctctgtgcggcagacttgaactgcacgggggctgataggaagcagggtgggcgctgggatgtgactgcgcccttgccagtgtttccagtctcccagctcgggttctgtggttgtctaagcctgggggtgctctgccgggtctgtggcgacccggctgccttttcagcctaatcaccagagaagccacagaaagagctggaccacttagaggggcagtctggccacagccacttggaagaacaggctgattttgtacagatgtgtcattttctcctgacttttaaactgtaaacattatataataccctagaaaattttgaaaatagatataaaccatcaataacactggcaacctaacacttttacctaagagctacccattttgatttatctgatgcgcagttttcattgctggaatcataaagacatagcaccttagattcttctcttttctttttctttctttttattataacataagcatctttcccactgctacttttgatcacttttgaggactcaaaatgatcatttttgggcctgcataatatttcactgtgtgaactctatcaccatttcaatcaggtgtttcgtttgcttccatatttttgtatcaccatagcaggtgatgattgaaaaaataaatgcagcttgcaaagtcattctgaattacatcgtggagctggagagtgttctttcctaatcccttcaaggaattacgatgatatggggagatgaaacattcatttgggggctggcgtggggtaagctttaaattgcgtttaaagtcagtgtgatagtgacttgagtttttcatctcttttctccagctccttgacggccatatttgctggccagggttactggtgtggtctttggccagagagcagactttcctctctgtgaaatgaaatgactcataaggaaacaaaccccaaggctttgggtacatttgtcccatcatctaaaccagggtttctaatcagaagtccatgaatgattgtggggctttgtcgggggagaggtcctgaagctgagcacaaaatttggcatgtttgtgataagtgtattttatagggatagtgtctgtagttccatcaggttctcaacgggggctgtggccccaaaaatgttttttaaaaaacccagctttctctctctgtctctttccccctttctgggaatccgagattgaaatgaaagaaatcgaaagatctttgcctacatacagaggtccagtaatgggatagggaatatattatccccgggatagcgccactgtactccagccaggatgacagagactccatctcaaataaataaataaataaataaataaataaataaataaataaatacataaataaagtgcctctttgttaaggcagttgcttctatttctacttttttaaccaaagctaattgctaatgtgttaaagtacgagattctgccttgattatggccgtccgtggttcttaactaaaggaaatgctttggcattttaaaacacatggatccccgtaagctttgcatttctcaccagggagtcagactgacacacaaatatttgtggttagttaattgttctttcctgctacaaacactcaccataggaggtgagctgtgtttaccaaactgaaatgttactatttgaggctgaaggagccaaagaaaccttgaaattcaagagaccaaacccaaaagttccacccaacggagtgggagacttcagctcattgaattcctgaatacagctcggtcttttgtcttcacacagcaatgagaacacatggacacaggaaggggaacatcacacaccggggcctgttgtggggtggggagagcggggagggatagcattaggagatatacctaatgctaaatgaccagttaatgggtgcagcacaccaacatggcacatgtatacatatgtaacaaacctgtatgttgtgcacatgtaccctaaaacttaaagtattaaaaaaaaaatcagtttctgttaacaacaaactctggcaccagtcagcgggtttgacttcctaaaaaagtttgatttgctttctctcttagaaattctgtcttaaatttccttaaacacaagtgtgtatacctggagcaaagaacatggggtgtaattcaatttctcttctcctttcttcctctgggaatctctgctaggtttcccacttattattgttgaaaactagcagtctttaaaggggatggacttcctgaaatacggcaaacagtcatgcaacaaaaaggagaaaattatattttcattttgggcgtcttagatgtagtgcaacattcaacatgagatcaatgtgccctcttgaccccaaagtattggctaatgatccataatcaatatttaggataacactggttgggagtatgaatgacatctttccaccattgtcttggtaaatgaaactatttactctttctggcagtggatgctgtcgggaggtggaaaagtaagcattttcttacgtttgggttttctgtgattgtttgattatttaatttattcgttcaaagaagagaaagatttactgcatgtctacaatgtatcaagtggtaagatggggcctgaaaatacaaagataaacaaccaaacaaacaaaatggcttttccttgaagagctcaggaggagtctggtttagaaggcagacacgcaagttctatgctactggtctgtaagaagcgctgtgggatcagaagaagggatgacttaatgggtacagagttggtgatgtgtggatgacctcgtgaacgaagactagttcttcaagcagacctgtggaggacaccacagaaaactgtgttgtttgtttagctcttttccagaacttgttatgatctcttaacaaggtctagccaatatcattataagcacgtaaaattcctcatcctaaaccccaccctgaaatcactctgacgacatgtcagccatctgacacagatgtggatagtctgaaagcccaacagttctaatcatttaggttcaattgggtctcaacagagatttttacatgggacttcatgttttacaaattattttagtattatcaatttgatcctttaaggcaggcagaaaacatatttccaccctctactttatagataaagccattgaggctcagagagattttaaaattttactgcaaattacacaggcttctggttttgtttgtttgtttgtttgtttgtttgagacagagtcttgctctgtcacccaggctggagtgcagtggcacaatctcggctcaccgcaacctccccctcctgggttcaagtgattctgctgtctcagcctcttgagtagctgggactacaggcgccacccaccaccatgcccagctaattattgtatttttagtagagatggggtttcactgtgttggccaggctggactcaaactcctgacctcaagtgatctgcccgcttcggcctcccagactgctgggattacaggcgtgagccaccgcggctggtcagattattcaattttaaggtcttacgggccacataacatgattgcctttctaaaagaattatttattcatggaagtctgaagcaagagtctcttgaagttcttttttgtccttgataaaatatttacttttcttgttttatcctcctacgagatccctactgtccatgcccacggcctagattggtctctggccttgagccttacagagcatgctgggtcccagggcttgtcctcaatgcaccacacgcagttggctgatgaactaggacctctgtgtcttgaagtgggagtggatggtaggaagggggagatggaaaagcaggggtacaaggctgatgctggcagcaatgaagaccttggtgattcgtggaccatagtggagactgagagggagtggagagacgaagagaaaccagagcatcattcctgatggagccctgtgttacccccaggctcctttagggcatgagagtgccagggctggaccatctccaggctgcacactttttctctgcagctgtgagcagagcccaggctgtctgtccctcagcatcccctaaatctgcgatgcaatcatagcccctgaatgttagggctggaggcaactcagagatcatccacccacagccctcgctgcacagagacagaagcaatgagatgaagtgactcgtacaagattgcaccttgggctgcaaaattcataccaagtgatccagggaggcctttgaggcattgcattcccaaagtgccttctaaatagttagccagagttatagagtggtgctcagaacaggttgtggacgtttattgaattccatgtgatttaagtgtggttggcgggcagtccacaccaccgccgcgcactgcatgagaaccctgtgtgaagggggcttggggtaatggagcagctgggcccgacccaggtggattcagagtctcccatcactcggagaagcctgcaccttggaaataattcaactccttggtctgacttttgcaagggaaatgtttggggcattttataggtctccatggctgtggtgttttatgacattgaacccaataaaactcgtaatgacacaggatctgccaaggggatcggaccttcccttctggcacaaggaaccattctgttttggtatcccaggaaatgagtggaggaaaatccttgttatttcaagtgaacagggtctgggcaaggtctctgtccctggtcaccttgaccatgtgctacctgtcactgagtctaacggttgctccaattcagctgaaagacaggactcagcaaatagagccttgatctgtccacagggtactcctgtccactgttccagcaaatgtgagaaaacccacttgtcctttgcgagagagaggcaatgctgtcttagtcccatcctaaaggcagaaggacgctaaacaagggtgtttgcgggctacaggcaagagccccgcaatggcctccccgagggatctgaggcccagcaggccatcccaggtctcagaagccttgtaagagcacagtggaggacccttcttgcacgctgagctctgagcagtgaggggaacagctgggagagaggctggggtacaagtgacacagtgcagagatgctgctcccagccgaagctgccactgtgggccttctccatccacccagcccctgtgattgcactgcccccacctctgggctcgagtagcccgtgagcctgctttctggacccatcctggcaagttgctggtggatatacctatgcagcagggcaactacaggcttaggagggctccattccagccctggctgagcatcagaatgggggtgagaggtaaaaaatacagattcctggccctgtttcatactttctgtatcatatgcaggagcccaagaagctattacagtcccagatcatttctgatccaacccaccagtcagcaatacctgctcaaatctaggagtcactgacctcagccccctccccttcctggggagctcccactccagggttgaggcacgcacatgactttcacctcttctggagtcctcccctccacattccccgacaagctgctgctctgagattcttcccctagtctctccacacaggccagcagtcactgcaaacgcccagttgcaatgcaccaagaactttcagggttttgccctgttttgctggttggtgccaggagatggaagctctcgagtggggtgtgctgtcccctgggctgggtggaggtggccacagcagagaaggaagatgggtcctggaagtacaggcggtctgggcttacatcctccctgtgccactcccggctgagggacctcgagcaagcttgacctccgtcagtcttcatttctttacctgtagagtggaggtctggaagccggcctcctgggatgctttgaggatgaccaggagctgagaggtagtgccaggggtcagccatgtcagtggctccacctgagtcctcagggcctgggggagtgtctgggacgaagtaagcagccggcgcacaggggtcctccctgctcccctttaattgcttgcgtctctctggggcattcttttactgtctttggcttcttcctttgctgcagccctcatctggatgcctgcctctatttcccccttccttccattttctttaactgcattatttttctgtctttagaggccagtcacttacctccttaattttcaaagttttgtcttttctaatattgtatcagtgcttaaaatgcaattttccccgccactgtagtgcctcatgtcatatgtgctgcgctgcatgcggggatggcccagaacagcttcctgcagtctgtgttcttcagaacagtggcttcaaacaggaaatcaaacagggaattgctttagttgttcatgaaatcaagtgggctcctgctggcattttaaaaacaaaatcatatagaatagagaatacccaggggcattgcctgtaggaaaggctttgggaggcttttgtatcctggtgtggggatgggtgtgcactcgcgtgcctgggatgtcaggcactgtagatggaacaaaagttcatgcccagatgaactgataagcagatcgtggcctgtacattccatggaataccactcagcctttgaaaggaaggaaattccttcacatactgctacatggatgaaccacgaagacatgacgctaagaggagagagtcagacacaaaggagaaacactgcaattccatttaaatgagtccctggagtagtcccattcagagaacagaaagtagaacgggggtgcgagagcctgacgtctttctcactgacagccacagtaacaaagaacagaaagcccgacagacactgtcgtggatgctcttagaccacaccgcacagtggagacttcacagaccccgagtcctgcacttggtgggtgggtctcacgaccgcccttcccccttgcggtgcaaagaaagttcaccgccctattgctgtctctcccagaggatctttctgacctactcaaggaacatttattaataatctattgagagaaagacaatctagtaggtcttatgcattttctatcttctcccatttttccatgaacgatatctgttatagcagccctgttaaactaactccccgacccagcccccagcccctgacacctgttactctaccatctgtgtcgatgaattgggctactttagggacttcatttaggtggaatcatacagtgtttgtccttttgtgtctggccaatttcacttagcacaatgccttcaaggctcacccatgttgtagcatgtgccagaatttccttcctttgtaagactggattccattgtacatatagcccacactgggcttatccatccatctgtccatggacactggctgctgccacattttagccactgagcaacactgctgtggacacaagtgtacaaatacctgctcaagtccctgctttctgtcattctggatacacacccagaactggcattgctggatcatatggtaattctatgtttaatttgtcgaggagactccatacaggactttgaattttactctgaatgagagggtgacactggggagttctgagtagggaagcgatgtgatgggacctaacatttttatagggtcacagtgggctgcctttgggaataggcaggtgggaggacagggaagaggagagcagggaggagttgctgtgtgtatcctggaaagaatgaaggtggcttagacccggctctcggccaaggcagagagatgtccattcctggctgcctgtggacgggagagccaacagaaatcggggttgcatgtggatttgtatgtgcagaatacgagagaaagagcatgaggaagagaagatggagctgccattcacagcgatggaaattgaccaggaactcacctctggccattttaagtctgagacatttactagaagtccaagtggccacagcacttggtgacattgtcagctggtcctctgacttctaccagccactttccctggcccctttttggcttgagcctcccagctgccaagcacgcctggatgttccagatgttttcaggttcccagagcccttgctgtagcagctcaagccttcctccccggcctcatctgctttccccgtgatgtttgagagcttttctcaggtgtgtgggaggaaacagcatgttgggggccaggagacagccacccagaccttgacaaggcaggggacggcttcagctcccgaagaccctcttgcgttcccagccaagccagaggcttacaggctgctgaacgcacctgaggcagcacccatggtgcagccctggtgctgcaggccaagctcttggtcctgtcacagggagaaagtctatgccccgacagcttgaacctgagtcaagggtcacctttcagagctgaaattgacttcttggaaagccagagaaatgcattttcccatagcattgagggcaccccagccctgtgcccactgagggagggaagggggcttctagaggcatcatcagagcaagatgtgagctggctttgctttgacctcactgtcagggcctgccccagatgccagcactcagagctcactctgcagaagagggaaccgaggctgggaggggcgagagagtgtgcagggtacgcagtgggtgaataagtgagtcaggtagagagcccagttctcctgggccccaggtgtgccagcagcctgcacagagtggccttggcttggcggtctttccccacaaagcatggactctcagaatcagaccccagctgagacgaagcaccagatggattgctttttagacggtgcatcctgttagagcttaggcttcccagagtgaatacgcactttcgtgtgagtttttgcaatgcattcacttttttagaaaacttccctgtagatgcccgctagatactgggttctgattctgaacacagacaccccactgtaggtggattggtggggggcagaagattttaatctttgggaggattgaggggtgtctctctcccttgcacctctgaaggtcactgtcacgctgttgctggcatctcagcatttccatccacttctctatttccactaacaatgccctagctctgccatggccacctctcaccgatctcctgcggtggcctcccatctagtgtcctgcttcacccgcaccccacaatctcctccacacaacagctgcagtgatccctttaaaggtaagtcagctcctccttaaaaccatacaatggtccaacacggcatttggaaagaaatcccaacccttccccagctggtctctgggccctgccctcctctcaccatccctggctgctctgctccaagtgcagggagcctctttctgctctgggaatctgccaagcctgtgcacttttagagccgtctctctgctctgccctctgtgctttgcaaagcctctccttgccactgaagactccagcatacgtcgcactttctgggagaggtctttctcttatctaaatacccctgggcctgtgcgatgattctgtcccgtcatcctgtttgaatttctttgtggcacttacctctcctagaaatcagtggccgtttactttgctagtctgccatctgccttcccctctgctctcctccctgcatcaactagaatatgggctccacggagcaggagctgccagctgtggcctccagcatgttgcaagatctgtctcaaaagttcttgttcaggggataatggattcctcaaaggaaggaatcagaccctctctgggactcccctgggtgctagaggacctcgctaccttcatgtggggctgctaggagccaacactgtcacagcgtttctggacagcaatttggctgtctagaccagaagctccgaaacagttccacggtattgaaccaaagcaatttttcttctgagagcctaaactgagggaaaaattctaaaatgtaggcaataattcatacacaaatattagatgaagctatatacatacatccacatgtagtagggaaatgtcaaaagtggtatttactattagcttgaatgacattaaaaaggtttatggtacagtattaagtaatatgaaacatacaaaagtttatgtacagcatcgtaacagttcatgcttatttagaggacttgtgccagtcaccacatcgagaactttatttacattttctaattctctgaacaaccgtgtgaggtagttattatctcaattgtattgactgagaaaatgagacatgaacagatcaaggaagctgacaaatatggcgtagtttgtaaactgtaatgtgaggatttgaatccagagcctctcactccaagcactccatttaaactctactgtatgctgatttgagtttcataaacaacttgaaaatgtgcatatcccttgccgcccccactatcagaaagactaagaagaaatacaccaaaatattcacagagattgcctctgggtattggggttctgggaaacgttttctttataatttcctgtatttaaatatttttctgtaaagagcacacatcattttcatgtaaagttttgaattttatcaaaagattagtagtcacacacaaaccacagataactttggctaattaatatagagtcaaaaatacttctataaaacaagctatttcaatcaaacatgatgtttaatatgattaaggagggctcattccactgtgaaaagacaacttagcattaagaaccacatagccaggcacggtggctcacaagtgtaatcccagcactttgggaggctaaggtaggaggatcgcttgagcccaggacttcgagaccagtgtggtcaacatggtgaaaacctccctctataaaatttacaagaactagccaggtgtggtggtgcatgcctgtagtcccagctacttgggaggttgaggtgggaggatcacttgtgcccagaagattgaggctgcagtgagccgtgatcatgccacacacttccagcctgggcaatggagcaagaccttgtttcaaaaaaaaaaaaaaaaaaaaaaaaaaggaagaaagaaaaagaaagaaaagaaaaggaaaagaaaaaagaaaaaaggaaacataatcaaaggcatccctgtaaaagcttgttgtaacctaaagaaaaaggaaacttcctagatatcttctgcaagcctatagccagattcagaagtgagagacgcctgctaacattgagataatttaactttgttttgggaattcttgccagtgtaatacaacaagaaaaggtaatacaacatctacacatttcgaaaaaaggcataacagatgatctgtttgtctttcagggaaatctaagacaagtaattgaaaagctattagagctaataagagaactgaaatagacaaaaatcaatagctttctttttttcaacaataacattagcaatgccaattctccaaaaattgtatataaatttaaatttaatgccaataaaaatgaatgcaggaattcatagcttgtcaaaattatagccttaagttaaatcagaaaaatgaatgagaaagaataatgaagaaaatcttttaaaaaagaactgaaactgtatcattaaactggagtaattaatttatgtggttctatgcaggaaaagacagagtccagaaataggcccatgattatgtgggaattgagtaagtgataaggaaggcaattcaaatcagtaagaaaaatggcttttaaaaaatttattatctaatatttgatttgtcaagtcattaaataattatctataccctaaagatatcctgtattttttctaaaagatttaattttcacctttgatttacaattaataaaattttttcttgagacagagcctcactctgtcaccaaggctggagtgcaatggcaccattatggctcactgcagccttgacttcccaggctcaagcaatcctcccatctaagcctcccgagtagctgggactacaggcgtacatcaccatatccagctaattcttctaatttttgtagaggtgaggtcccactctgttgctcaggctggtctcgaattcctgggcttaagtggtacgcccaccttagcctcccaaagtgctgggattgcaggtgtgagccactgtacctggaccatatttatgtctttaatcaatttggattcaatagtcaagaatggttgagcagtaaggccacagttttatgtgaagaaaaaagttttctcagcctcatttatcgagtagctcataccgccctggagacgcacagtgcctccccggcatgtgcatgagggtccgtctgagactctccgttcacttcctgttctatttttacactccctggtccgttccatcttcattactgcagcttttagtaagtgtggacatctaggaggggactcctctctatcttggttttttttctcttcatagatatcttttctatttttgagccttttcttatgcataaaattttgaaaaccagcttgtaaagttcctcaaaaacaccctttggaatatagattggaaacacatttgatttttaagtaatttggagagaatatgcctcttaatgatgagtcctcctaatcatggtaaatccatctttccttctgtttaagcccttctttaacatcgttcagtaaagtttacgtctccatacaagtttgcacatattttattaggtccatttctaggtaaattatgtgtttagttggcattggaaatgagctataaaaaaaaactacatttttctaaatggtcaaaatatatgaataggccgtatacagaggcaaagaatccatataacccatgagcatctcaaatataatcaagggaaacaaattaaaacaaaaagatttaatttattacctattccactagtaaaactaatgtttgacaatacgagttttggtgagaatatggggaaaatgaaaactctcaggtattgctggtgggatgataaatgggttcgatcgctttggggagtgttttgggaacccatagtgccactgagggaacatagcccactgccctgtaagtccataggtaaattaaatatctaaattccctgtgttgttcagagaaactctcacatatgtgcaaaacagggaatgtatgaggttgcccatcccaatgcatttcatcattttgaaacagtgtcccttagaaaatgaatgaataaaaggaagtttattcacttaatagaaaaggatacagtaaaaaaaaaaaaagcactgggaatctgtgtattacaacaaacaaatctcaaaaacacatatttctgaaaaaaaaagcaagttgcaaaaaggttacatacattatgaagccatttttaaaagtctaaaacatacagagtagcaatatatattgtttataattgcttatacatgtcgtaaatgtccaaaatcatacatggttaacacctactaactccatgatcattattaattttggagagaaagagaggagaaaataatgaccaatctttagttgtatcttcatatctggaacataaaaagagagaggaaaaaaagagaaggaagaaagtgtaccaaaatatgaatatctgtttgatcttagcagtgtcacattattttctgtttttttatacatttaaaatattcatagctagtggtgaaaaaatttcttaaatagttgtatatttctatcatctaggagtgaggaagacatttgcaagtgtgaacgacacaggaaagattaataggaaagattaataaattgactaggtagaaatgatagcttttactgcataatacataccatgctgtaatacataatacaaacacaaagttcagttgggcatggtggctcacacctgtaatcccagcactttgagagaccaaggcaggaggatcacttgaagtcaggtgtttgagtacagcatggcgaacatggagataccccgtctctactaaaaagacaaaaattagcgagcatggtggtgggcgcctgtagtcccagttactagggaggctgaggcaggagaatcacttgaaccccggagaaggagattgcagtgagctgcgatggcgccactatacaccagcctggatggcagagcaagactccatctcaaaacaaacaaaaaaaattagtaagttaaaaagcataacctaaattaagaaaaatatttacatttatgacattaatgtaaaaattacacatatttatcacataaagaggtcttccatatcattgacaaaatgataaataccttaatgtaaaaagtggtagaagacgtggatgatcaaatcataataagagaaacacaagtggctaataagtacatgataaaatcaatagaaaagtaaattaatactatgttgttcatcacttttcactgagcagattgacagagttgttttttttttttttaatttgttataaaccattgtccagggactggagaaatggcttccttcatcacggtgagaatgtaaaccagtcttacctttataaacattaatttagcttcatagatcaagatctttaaaaatgtgcatattcttaaacaccataattccggttatggaaacatagcttaaaaatattggacaattgaatatttaccttacaacaatgtttactgtgggtttatttataacagccaaaagttgaaaataacttatttgaccattagtgattaaataaattaatggtaaatttgtacaatagcatgcagttattcatatggttcaaaattacatttatttatatataatttatactgtactgttcacagaaataaccaagttatgacacaatataaacagtttggcccatttttcaagactatatgtatatgtaacacctttgaaaatgcatacactgaacattcacaacgattttccattggtggtagggttgtaactgattttttttcctttgcgtagatgagaattttctaattttctacatgtgcagtacttgcttaataaaaaatgagattgaaaagtaaaagaccacttttttgtaagccagctcagaaaggatgaaaagaataataacccttgtttaagaaagtacagggaactacatacttccatactgctgtacgaaatgtctgaaggacaatttgccaaaatatatcggaagacttagaaaggttatgtatgctcttgagcgtgggaatcccacttgtgggatttttaacctcaacaaaaattaagggaagatatgaggaaagagaaagggcatgagcaaaggacatttttgcagcatgtttatgatcttgagaaaatggaaacagctggggtgtgcggcagaagaagtggggaaaatgacaacggttcattaaacctcacgatcagatgctgacagcccctcacaggttgctgcagacaaaacagggaacgacaggaaaaagatgaccgtgatacgctctgctaaaagcaggtcgcaaaacaggatgtagataatgatcccattttgcttttttacaaaaaaaaaaaaaggccatggaaaattacatatcacgaatgttcagagtggctgtctctggatgatggcattggagttaattttatctttcactctattttctgaatttcctatatcaaaagcaaattgatggtgtgaaggggaaagcatatttaatgtgattcctaaaaggctcagccctccctgcatggattgagcactgaaagaagagggttctgtcacctctttcgtgctgacccttgccttttctaatgttgctcagaggcacacagacgtatttgctttaagtaattgcttgtctgtttttaatatcacattttgaaaaggtatttagacaacatgagtttattactttctgtttaacccaaatccttcagaggtacttaaagcaaaatgtaaagtcctcttatccctttgtgaatttcagtccccagaagtctcactgttagtagtttgatttttaccaaaaatgtccaggtattttcttttcatctgcaaatgtgttaatagactcctttttttaaatttcacacaagcaggattatatcatacaaaacattctgcaatttactcttttcatgtaacaataatgtatcctgggtatttttctttgccagttcagatctcttttatccttttactaatttatttacctatctattcatttgcttaacttgattttattattatacaagttatccatgaatattgttttcaaaaatttaaacagtcagaaaaggtataaactgaaaactcaaaagttcgccttccctgccaccactcatgtgccctcctcagaagcaaggaatggagcagcttttgtggggttttttgttttttctctgagacagagtctcattctgccgcccaggctggagtgcagtggcatgatctcggctcactgtaatctctgcctccctggttcaagcgattctcctgccttagcctcctgagtagctggaattacaggcacccaccaccatgtccggctgatttttgtatttttagcagagacagggtttcaccgtgttttcattagagacagggtttcaccatgttgcccaggctggtctcgaactcctatcctcaggtgatctgcccgcctcggcctcccaaagtgctgggattacaggtgtgagccaccgcacccagctgcagcttttgtttttaaacattcttttcattacagttacaacttcaagaaatactaatgccaatatctctgagctaaatacactgacagatgcagaatgcacttcatcatgctgtctcttttcttacctggctttcacctgcacactcccctctccatttcctagatttttatcagctgttttgtatcctagtgattggctttatgactttaaataatatatttaaatgtttacgtctcaattcattagctttaggcagtatctgaagttaacacctgctcacaaacactgctttcaaattcacatcctacttttttgttatactgttatttttacatattaaggcttatcatatatatattctggctggacttggtggctcatacttgtaatcccagcactttgggaggccaaggcgggtgggtcacctgaggtcaggagtttgagaccagcctgggcaaaatgatgaaaccccatctctaatacaaatacaaaaattagctgggcgttgtggcacatgcctgtcgtcccagctacttgggaggctaaggcaggaggatcacgtgaacctgggaggtggaggttgcagtgagctgagactgtgccagtgcactccagcctgggggacagagcaagactctgtctcaaaaaaacaaaaaattatattctgttgtgttcagtgcttatataattttactgtgtttcatcagtaggttagtactcaaaactttttcagttgaaaatcaggcactacaataatataactatgtaaattttgttctgtagaattaagtgggataattgaatacatagagaaggccatctgatactatgtcattaaaatttgccatttgagggagaatttcccaaatatcaaggttttatgaagcctctttcgttttcttttatgtgcttgggggtcacactcggctatccttatttcttataactcatgtcattcttatttgcagtttcgttagaggacgtcctagtgtcgcttattctttcctgtacgtgcatgctcgcaaggggtctttcactgtccttaaggcttaatgtggacgtctagacagcaataagctttttctaccagcttacaaaactcaacacaccaaagactatacaaaactccatacccttcaatggcttgcaatgctctttttaaaagtcacctctaagggggtgtaaataacattccacaaaattcacccatttggggcacaattatgcatttttgcaaatatatactcttgtataaagtccaccacaatcaaaatggacaacattttcaccaccccaataagtttcctttagccctttctgttcataccccttatgctacctccaaccactgatctactttctagaaccatagctttgccttatctagaatttttctttctttttttttttttagtggggaaggagtttaattgacataagcctagcccacacaggagaactgagttgtcactgaaattagtctccccaaaggtgtgaaggtcaggacttttatggacaatttggtgggcagggtaatagataatgggtgttgctgattgcttgtaaaagaaatcgtaggggtgtggaaaattgcccttgtgagtgagtactcctttgggtggggccacaggacaagttgagtcatgagttttgagtttgggtggggtccattggttgccagaatgcacaagtctgggtgtaaaaaaaaaaaaaaatctcaaaagaccaatcttaggttctgcaatagtgatgttatctacaggaccaaatgggggagtcagaaatcttgtgacctctggccacatgactcctgagcagtaagggattacagaaattatgcctacattttagcagaattcaggtccccccataatcctgttcttgtgggctttcttagtcttacaagggtgatttttgctccctgagcaaggagggggttagttttggggagggactattatcatccttgctttttctttgagacagagtctcactctgtcaccgaggctggagttcaatggcgtgatctcagctcactgcaatctctgcctcccaggctcaggtgatcctcccacctcagcctcccaagtcattggcactacaagcacatgcctccatgcctggctaatttttgtattttttgtagagatggagtcttgctgtgttgtccaggctggtctagaactcctgagctcaagtgatctcccaccttggcctcccaaagtgctggaattacaggcatgagccactgcacttgatgatcattcttgcttttaagttaaactataaactaaatttcttccaaagttactttggtttatggccagcaatgaccaaggagagcttggaggtcagaagcaagatggagtcagccatgtcagatttctcttactgtcataattttgcaaaggtagtttcaatccccctcacacacacttgggcttcagcacccctcaatcctgaggtgttagctacggagatgagaaaaggctaatgattgctctaacttcttcctgctgacagggggcatatttgggggaggggttgaccccagggtaaaaggagtggaagtgtcttgcagttgcctgtatgtattcaagtgcaacttgttggggtccaacatgtgtataacgaaaacattggtgctcttatccacagatttagtacagcatttaagaagaaaaataatgagccgtaaaaaggaacgagattatgtcctttgcatggaagtggatggaggtggaaggcattatcctcagcaaactaacgcaggaacataaaaccaaacactgtatgttctcaattataagtgggagctgaacggtgagaacatatggacacacagaggggaataacacacactggggcctattggggagcgggaaggagagcatcaggaaaaatagctaatggatgctggaccgaatacttaggtgatgggttgataggtgcagcaaaccaccatagcacacgtttacatatgtaacaaacctgcacattctgcacacgtaccccataacttaaaatttaaaataatagtaataataataattagccctaatataaggagtgaaagtgtaaatcgcccagtgggttcaccttgcccgctgcctagacaaagccaatttatcaagacagaggaattgcaaaagagaaagagtaattcacacagagccagctgtgtggaagaccggagtcttattattactcaaatcagcctccttgagcattcggcgatcagagtttttaagaataatttggtgggtggaggaagccagtgagtcgagagtgctgattggttgggtcagagatgaaatcacagggagtcaaagctgtcttcctgcgctgagtcaattcctgggtgggagccacagatcagatgagctggtttcttgatctgggtggtgccagctgatccatcaagtgccaggtctgcaaaatatctcaagcgctgatcttaggagcagtttggggggtgggagatcagaatcttgtagcctccagctgcatgactcctaaatcataatttctaatcctgtggctaatttgttagtcctacaaaggcatctagttcccaggaaagaaggagggttcttctggaatgcgctgttattgtcttcatttttaactacaaactataaattaacttcttcccaaaattagttcagcctatgcccaggaatgaccaaggacagcttggaggttagaagcaagatgcagttggttaggttagatctctttcactgtctcagttgtaattttgcagcggcagtttcaaaagtcctagcttcaggagtccctgtagaactgacctgaagcctcaaggaatccaggtgaataaccccaaaaatcaaccaaatatggggtcatcagcagaagctcaagaacaatggatgaggctggaatctaataacaggtgtgctgtagctgttttgaaacataatttttctctctccagtttatttttactaaagacaagaccaatttatttgcaaaataagcttgccttattatactttgcctaattatttacataaagtgcagcaagaataattattggccatataggctctttttttctaactggctttgctggaatttttttcataaggaatctcagattagaccttttaaaagtctcttgagcccagccaaggatttatttgtgcctgcagatacttgtatgaattgggtgaattcctttcttcttgaggtcccaacaaagcttggagttcctgggcctgtcagaaagtgacattctttatttgccacaggtcgggaatcctgtacaggacaaggtaggaggtcagttcctccaaggggctttcatcatctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatactcacaaataatttccaaattctggagaaggcaggtaaagagaaagaaatatgctctaaattttgtttacaggagtatattttgctcaattgttaaaagttgtaaatagctcagtagaagttttctttactctgaaaaacaaaacaaaaagaatcagcaacaattttaagtgaaaagtcgaaaagatttttccagttactgaatgttttggttgtttccagctgggagctaattaatatgagtaacaatgctaagaacatatatgtcaagtctttctgtggtcatatgtttttatttctctttgataagcaacaagaagtgaaatatctgggtcacaggttaagaagctcccaaattgtttcctaaagttgtttcgtttcaccttaccatcagcctcaggtgagcattctagtttctccatatgcttgccaacacttggtatgatcggtcatctaattttagcatctgggtggttgtgtggtggcatttcactgtggttttagttgccattcccctaatgactgacgacaccgaacacctgttcatgggtttgtgtgctgctcagctgtcttctctgttcaactgtttgttaaattgaatttttggcttcttttatagagtttaaaagttaattatatattctcatatagatacatgtttttcaaaaatgtcctgcctgtctctgatttagctatttcttttcttaatggtgtttttaaagtgcagaagttcttaattttgaaaagtctaatttatcaatttttcttgtatactttatgatcttctattctaagggaataatctattctaagggaatagaaggtcacgtttgtatgcttctgactcatattctttatatcctttgtgacaccaaggtcacaaagatttccttctaggttttcttctaagaatataatgtacctctttaaagcagcttttaagattgtttttatttatcattggttttcaacaatacgattataatgtaccttggtgtggttttcttcatacttggggttgatattcttgagtcttcgggtctatagcttctatcaaatttggaatttccatttttggtttctttaagtttcatagtctttctggtagcccagttacgtgtcttctgactgcgtgctaatttctccccagtcactgatgctctgttgtttatgttcacctttttctccctgtgcttcactgtgggtactttcaattgcagtgtctccaagccctctgaccttccttctgcagcacccaatgtactattcatcccatctagagttttggttgtttgtttgtttgtttttgagacagagtctcgccctgttgcccaggctggagtgcagtggcaccatctcggctcactgcaaccacagcctctcgagttcaagtgattcttctgcatcagcctcccaagtagctgtgattacaggcacctgccaccaaacccagctagtttttgcatttttagtagagatggggtttcaccatgttggccaggctggtctcaaacccctgacctcaagtaattcacctgcttcggcctcccaaagtgctgggattacaggcatgagccaatgtacctggtcatgtttttttttccttttataaaaaaattttaatatttatttatttatttatttatttgagacaaaatctcgctctgttgcccaggctagagtgcagtggtgtgatcttggctcaaagcaacctctgcctcccaggctcaagcaattctcctgcctcaggctcccaagtagctaggattacaggcacgcagcaccatgcccagctcatttttttttttttttttgtatttttagcagagacagggtttcaccatgttggccaggctggtctcgaactcctgagctcaaatgatcctcctgccttggcctcctaaagtgctgggattacaggcatgagccgccacttctggcctctcttttttcttaatttcagatattgtattttttttaatctctaggagacccatttaatttttttatgtcttcattttctctcttcattgtcttattgctttcagttatatatttgaaccagtttatatatttttgtcatttctgttttaaggcactagtctactaatatcaaaatgtgtgcaatttctgctcatgttcctctcaattaacttttctcctagttgagagtcatgtttttctgtttctttgcatgcctggcaattgttactggatgacaggcactatgagtgctgaatatgattagtgagcgctgaatattatcgtgtttctttagagagtgtcacacttgcatgtggcacactgttaagttacctgtggataaaattggtttttgaataacagttctgtgacttactgtaccttcagcaagaccttaagcctcaaggagcctgagtttcttcatctgtaaaatgggaaggtatatgtctgctgtcagggctacatataatacatgaaaagcatgcagtaaaatgcccagccttgagtcagaaggtgtactaggcactgtgccagcatcattagtattcatgttttatgtgataggcaaatcctgcaaccgttttatgagttaattttaaatctctgcctctctagcaggacatctgtgtctctagatccactcagtaattacaatcaacccaagcatgttaaaggcctgagaccttttcttttctttttctttctttaacattttccaatctcatgtttgaaagcataaaagagaacctttcagtctaaatgttctcctgcaccctcaaacccgatggaggtgcttctcactgcacgctcccttcttacacattccacctctgggttctgccaaggaaacattggagaaacagctccaaaggattgaatgatgtccagggccttttaagagaggttcaagtcgtgaccagatgtgtatctgggtaagatacgtgtgaacctccgtgggaaagaccaagggtttgaagtcagagatgtggctcaaatctctcttctgtgcttcagtttcttccctgtctgccggaggaggaggaggaggaggagaaggaggaggagaggagtaggaggagggggaaggggaggtggaggagacggagggggagagggagggagatggggagggggaggatctatctagtttacagggtcctcatgaggctcatgtgggaaaatgctttgcaggctggaaagtaccacagaggtgtgagttattataaaaagggaagttatttccctctgtcaaaaagctatgcagaaatatactaatatgtaagaaatgtttgtatggaggacagaaataattcatttcatggagagacaagaggatcactggcagtaaaactgcaggcattatttatgggagactcaaaggagggaatgccccgtgttggcgggcctgcctttcaatccttgtcacaagtcatgatccagaagctcggccaattgaagaaagggtctccatgaagtggagctcatgacctgcctgcatcagcatcactgggggcattttttaaaaatgcagataccagcactgctggggctggggttgggagtctgcaaactcccctgctggttaaaatacaaactgaggtttcagaactattgtgccaaagaatcataactgactccattgggaagtaatgacccatgatttgatttctcatttaatttttcaaaatgcaaacaatgcaaaaagttaaaaattgaaaaataggttaaggcccatagtctcatcaatacaagacacaactgtagttggattaacattttggcatattgctaacatattttaataatcactactgtgagagttttttaaaacataaatttacatggtgttccccccccaaaaaaattcactcacataaaggaattttatccgtccccagaattacctaatgaatttcaagcttctctgttagcagaatcaaatgtaggtgactcgataaacaagtgtctgtctttgacttaacacagctttataaaaatgccttcttccttccttcctgaaggtctgctcagcaccctcaaactttttaccacctgaaaatcttttctatcaattttaccacaatggggggaggtgaatttccacaaaagatcttttcactttaaaaaattgaaatggccacataatttctcctcctaactgtgccgaagtacctaaaagtcacaggttggcattgctaggtcagccttttgcaggggccacacgtgcccaaggcccttacacacccagccaggtgttacagagcagcctctcaccatcaggctctgtgctagtgctgggaaaagattctgctggcatttaaaagtattgcacaaggaggccagatgcagcggctcatgcctgtatccaacccagaactttgggaggctgaagtgggaggattgcttgagtccaggcattcaagaccagcctgggcaacatgatgaaatcccacctctacataaaattgtttaaaaaattagccaggcatggcagcacgtgcctgtggtcctagctactcgggaggttgaggtgggaggatcacttgagcccaggagttcaaggctgcagtgagccatgatcacgcctctgcactccagtctgggtgacaagagacagacagatgaatgaaagaaagaaagaaagaaggaaagaaagaaagaaagagagagaaagaaagaaaaagaaaagaaggaaaggaaagaaagaaagaagaaagaaagaaagaaagaaagaaagaaagaaagaaagaaagaaagaaagaaagaaagaaagagaaggaaaagggaagggaaggaaggaaaggaaaggaagggatatattgcacaaagcattagctgtgaatgactgtagcacacactctacaatccagcaatggaaaagctttgttttctgaacgtgttttctatcttcatgtgtttggaaaaacacctatttctgaaatactacccaaccctgttgggagtgtgcctggtatttttttctagtgttcccagtttctcatcctttgctctttcaactcccaactaacaagtgtggaaggactgatggaatcagagcacgcccattttgtaaccactaatgggacttttaaatgtcggtgaggaacttgtcaatggaggaatagggatgcctgagcctcgacctatcttagcatcactaaaatggtgcaggtaaacactgtgagcctcctggtaggatgcaacatggagcacagatcacctcctcgacagcatctctaccaagaggggctgagcttgaatctaatggagcctacagaggtaactctatgtgtaagaaggacgagagggaagagcaagtgatgaaccatcacaaggacgcaaaatccaaaatggagaacattctataggactggcctttacaaatcaaaggcttgaaactaaccaaagtcagagcagaagggactcctgtttaaaggaaacctaagacgttgagttatatacgaaccttgtttgaatcctgagtaggacaaactaagcaagaagctatttttaagtcaattgttaaaatgtgattatgaattgggttcaatggctggatggttagatgataccatggaaatattgctagttttgttagatgtgatgaagtaacattggggttatgtgagcaaatgtctccatgctttagaaacaaatgcaaaatatggggtggtgaaatgacttgcttcactacattgatttcatgttgtttccaagtttcattcatttagaggaaataaaacgatatgatgtaaaatactgcaacccagaaaacaattttaaagataattattgaatgtgggtgatgagtgtagaagagttctattattattaatattattattttatttatttttttgagacagtctcactctgtcaactaggctggagtgcagtggcaggatcttggctcactgcaacctccacctcctggtttcaagcgattctcccacctcaacctcccaagtagctgggattacaggcatgcgcctggctaatttttataggcacgtgcctggctaatttttgtatttgtggtagagacggggtttcaccatgttggccaggttggtctcaaacccctgacctcaaatgatctcccacctcaacctcgcaagtgctgggattacaggcatgaaccactgtgcctggccaatattcttgactttagtatattttggaaggtttcataaaaaatagttttcatctaaaaaaatctgttgtagccatccttctcaggtctggctagcgttttctcccaggtggaagtaatttctttttgctgagctcacaaaacactttacccaggcctctctttggtacagaatcatgcccactctgaactgatggaatcgggtgcatgcctttcctccttattttcctgtgagagtgggctccatccttgtttcatgcctgtaccttccgctatgcctgacatagttcatggttgacagcaactgaatgtctgtggctgaatgaatagaagaacctcgttgctaggaactgttatcggggctgtttcaggttcacatgtggagaggtcagtattagggcaaaggtgaggaagcctcatttcagtggtgttgtcctgagttgagacatgaaacatgaattttaactcaaattctttggccccttctttaattcagagccataggccaatcaccgtactttcttcatttacaagatgagtatagcattggtggtttgtactgggagaatttggaattctggatgttggtgagatgctccatatgggatctcatgccggcagctagcatggcattgtgatcgcgacacccagggtgagtcccagctttgccagtaggtacccctgttctacctggatgctacccacctatgtctggcaggtcaaatcagaaaggcaaagcctccagcacataacatggcaaggcttccagatacaaaatagcaaaactattttgccacaggggagatgatagggaatctgaactgtcccctccaagggacacagagcctcaggcagggccacaggtgcacctgttttgtgcagagggctcaagcagccctggagacagtaacaccctccagctgccagctctgccaccttcagcatgaccttaccaagccacctcgcctcgccttcttcagtggtaaaatgaggataactgtaaccaatttatcaaggctaacatgtattagaaaaaaagaaaaactcgttatccgtcaagtgcttttcaaccatgtcatgctagccaagtgcaaataaggggtttctagtttctctatttttagttgatgcctccaccacaccccttgtttgactgaagctgtgtttcaggctttgagcatctcccaaagcaaacattgactgccctgctctggtgaaagtctgcattagagggcctagctggtttcaaataaacaaacaactcccctttcccacttcccctcctcttgctgactcccccgactagacacacatgcacacggtgcacatgcatgctctctcacacatgcatatacacgtgcacacatagacacacacacacatatatacacacacatattcaagcacatacacacatgtgtattcacacgcatgctctcgctctcacacacacacaagtgcacataagtgtgtatgcttcctctcccactctctcacaaacatacacagactcacacccttcccacaatgcagcaaagccatctggagccccagccagtgtgtgatgcgttttgcctctgtctggacttctgcacttcctggcttcacccaacctgaaactgctgggtgcagcccgagcaccagtgacagccctggttgtcccatggcctcttgaggaacccaggtctccagtcaaagccactggagtagggggacccatagagacctgaggtactcatgagacccatggaaaatcatctgcacacacactgctaaggagtcaaaggacagaagtgtaagtagtgggtcatttaatcttaggaattttactttctgtccggttctttgttcaataaattgaacaaccaatgttcaattatgttgtctcagtggacacaggtgtttgccaggaagcttaaagtcaatggcaatatggctggccagactaagaaagacaagagggctggtcacctgggcagatgcggaagtatgagtccaagtctggggaatatactaggagctgctgaccactggcccttcgttgagtcagggaggctgagagaggccacgaaaggcctgaggttcaggcagccctggctggccacttaacggtcattgtcaagaactgcaggctggccctggctccaggccttatgctcctctgttgctgggcaaatcactcaaatcctccttttatttttctgcttgtatcaataatatatgcttagtattaaagaatttaagaaatatatacaattaaaagaaagaaagtcaaagtcacatgaagtcttataatccaaaatccatttagaaaatactttggtgggacctgctttgcattagcacacacaccgttttttaagtccgctggttttttttttgttttgttttgccttacaccacacctctgttttgtactctcccttcctctaacaataaccacagtaaacaacttggtgttcatcctccccagcctctttctgtgtaatatgcaaacatatctacacgcctgaatagaggtttcttttcatttggtgtttgcaaatatgggattccctcatgcacctctttgggtcttacttttctcgtgtaacaacatggtaccgaaattcctcttgacctcactggtgaagatccagcacattttttttagtagttgtatgagagatttatagagtgtagatttattcaacaagtcttcaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaaatcaaaaggtatgtgtgcttttttattttaacagaatttaaaagattgccctttaaaagaatttaaaagattgcttcttccaataatatttcatgttttgtctaataaatatttattaagcccacactctgtgccagacattggtttagcaatttggattcagcaatgaataaaacaaagattccagctctcacagaagattaatcctagaaatggagcgtgaaggaacaaatgaaacaataattataacaaacattttactatttgggtttgtgttgcactaacttcctatttcttatctttacacatttttctattgaatgaattatatgctgcaatatacttcctgtcaaaagtttatgagctttgtatatattatgaatacacatttatctgatgctttgcaatctcttacccaatctattgcttatctacgaacttcatgagtagtttcttataccatctaatatttttaatgtttatgaatttgtactttttttgttctctcttcgcttctgggtattttatctttgttagtagttgtctccaaactctgggttatatacacagtttcttacatttcttttaattacatttttgttttttatttttttcagtcatacacctagaatttattttttaatatcatgtgaggtaggggttcaattgtattttccttaaggtaaatagtcattttcctaataccatttattaaaataaactatccactttctactgaattaaaatgctatctttttcacatacgcgattcctgtatttaccaaaatctgtttgtatgttttttattctgctctgatgattgttgtctacttttattattccaatttcatgcggttttgattacaatcttctatttcataattataaagctaggttaagacttaatttagtcatgtaaagcttcagatgattttatgcaattacaaattataattttaattaaaagaacattccatttatattaggaacaagaaaaacatcacaatcaaaaaagagaacagagtataataattacaagacaatgctacataaaactatggcaacagattggaaaatgtagatgaaattaaagatctataaaccatataaatcatcaaaatggcacaaagaggagaaaaaatgggaatagatcattcctatagaagaaattggaaatgtctttaaagatttactatttgaaagggccccagacacagatggcttcacaactgagttctatttagcctgtgaggaacagataaccccactgttatgaaaccactcaagaagatagaaaaaaaaaaaaaagagagctcctcaatatctgttacaaagccagcgcaccttaatgctaatgcctcatagacaaatctcccttgggaatacagattctcattctaaataaaatattagcaaatagggccgagtgtgatggctgacacctgcaatcccagtactttgggaggctgagatgggcaggtcacttgagctctggagtttgagaccagcctgcatgacatggcaaaaccctgtctctaccaaaaaataaaaaatttagtagggcatggtagcacatgcctgtcatcccagctactcgagaggctgaggtgggaggatcaccttagccttgggaggcagaggttgcagtgagccaagattaggtcgtgggactccagcgtaggcaacagagtgagacactgtctcaaaacaaaataattagcaaataagaatccatccatgtgccaaatagactaatatgctgtaatcaaatagtatttttccaggaatgtacagatgtttcaataacagaaaatttaccaacataatttattacattgacaaattaaaggtgaacatacatcatattgatcgatattgtataggcacctgctaaaattcagtagccagccgcaatacaaacccatcgtctctctctcttttttttttttttcgagatggagtctcactctgttgcccaggctggagtgcaatggcatgatcttggctcactacaacctccgcctcctgggttcaagtgattcttttgcctcagcctcctgagtagctgggattacaggcctgcaccaccacacctggctaatttttgtatttttactagagatggagattcactgtgttagccaggctggtctcgaactcctgacctcaagggatctgcccgcctcggccttccaaagtgctgggattacaggtgtgagccaccgtgcccagccaaacccataatctcttatccaaacttctgaaaccctaaatctctgaaaactgaagtgatacttgtaaccctggcactataattcacttagtggtaaagctgatctgagctcacataaagaaatacttagatataaaaagtgttggtctttaaaactgtgaattattatgtgttctgtatgtaaggcatacttgaaaaaacatacttgtgaatttttcgcttctgtggcttgctgtcctatatcgaaatttgttatagtgttttctttttcaaggtgggtttgaggagcaatgacatgaggaatgtgctttcagctctctggaagaaatgcatgactgtgtttcacttaatcgaagacgccactgataggaaggctagcatttaattatgtatcactaaaagagaaaaaaaatgctgctactagttatactgcaaagcatcctccattgtgagacacctcccagttcagagatattgaaaagtgaaaaaaggtccatcttagaattgatgaaatatggtgtgtacatccaaaggaaatcaccactaacaacacgcccttctgacacgcgtggggacttgggtgcttcctctctatgatgtctgcatctcaaggaagagcccgatgtaagtgcaggagtgcagtggtctcaggtcagactggactccagagctggctctcacgggccagttgtttgaccctgagcaaactccttaacatataaatagcagcccctggaatgaggatggtgacaacatggtggtgttgatggtgtcaaaagggcctgtcccacatctgccatcctaaaattctttaccaaagaaaaaaacctgaccacatcttcccccctttaaggagacccctgatattactgtgaggccacagctaggcctcgatgcctgtgctatcaatctgtcctaaatgtatatagtgtctcacccaaaaatctgagagggagagaacgttagtcatcttctaacaaagcccctgctgtttaccaaagagctaatgggtcggagagaaaatgtcactttcccaagtgacacagccagagacaaaatgaaaactaaacccagagccccagacacattggtgggctctttctagaacaccacgtggcctcccgctcaggctcctgtcacctgaggacctggatccaccccagtggtttccagcggttatctccagccagaggatttctgtgtcctaaatgcagtgctttctgctgtatgggcccccgaaaaaagatggacacccatttagctcacccacccgcttctacccacgttctgactttgaggtctttgctgcacccacttccaccccacctttctaaccagcctcccggaaggggccagggatcccctctgtgcagaggatctgaggccccgctctctcatgtcctctgtctgctgtgtgtctccgacaggatggggctggtaagtagcaaaaagccggacaaggaaaagccgatcaaagagaaggacaagggccaatggagccccctgaaggtcagcgcccaagacaaggacgccccgccactgccgcccctggtgagtgattgcccacccccaccaagagcagattacttacttctcctatgccttaatgtccaagtttgtaaaatgggtatagcaaaagtgccttcctgatagggatgtaacgatctgcaatgtataagcaggtgtgccatgcaatataacacgcacaggacccggcctggttagctcccaataattcttagccagagctcatttctcgagggcagccttgaaaagaaaaagaaatgtaaaaaggtcagcttggggagagggtgtcgtaaggaaggatccgggtatctagctgcagctactacctctcttctccccagcagctcctggagacccttgtcccctatgtggcattgctgctggcattccaaagagcctgctttcctgggataagcatcatgaaacaggagggtgcctgtcctcacctcccgagcaggctcttaagttttcctggaatcccatgggcattttaaatgaggaaaactttccaaaggaaaaaaaaagtgaaatttcaagtgaaaaggtcttattgctggggaatgcattttcctagtcatgcagtttgatttgtttataaaacacttagctccttttgatggctacagcatgtctgaagatgcatttttttttttttttgagacagagtctcgctctgctgcccaggctggagtgcagtggtgggaccttggctcactgcaacctctgcctcctggattcaagtgattctcgtacctcagccttctgagtagctggaatcacaggcacacatgccaccacacctggctaatttttacatttttagtagagacagagtttcaccatgttggctagattggtcttgaactcctgacctcaggtgatccacctgccttggcctcccaaagtggtgggattacaggtttgagcatccgtgccgggcctgaagatacatttttagatgattctttgtgctctctccactccctgaccagtgacccccttttggtttggggcagttgggagccttgccgcgaccccctctcctgtgctgtccacatgtccacgtggtcatctctttatcctaacagggacctgatggggagacggggattactaatcccacttcctagatgaacccaggcatcttacctatctgtgtcccagtttagcgccagtctcagcgcacaaccacaagatgtttattgaataaataattgatcaaatggggaaacttggacttagactgattgagtaatttccccaaaattatatgataataagtagtagcacctggaatttttttcacttaaaagagtcacataatatgtatatggaaaaaattataattactcattattccactatgtagagtcaccagagttgcctcgagacccttcttccgtgtgttcatttcatgtgttcctatttttaagagaaacatacatgcacatcattttgcaaaatgctacttcaaaattgtgttcaataaatatggaattaagaaaagaatatttgtaacatatgtcaggttgaaagaatacaccaaaacgcacacttgtatagccacctcccaacttcagacaagaaagagactcgttcctttgaatctccctcctccctcccctgtttgtacccttcaccccaggccccaatacccagaatctgtttatcattccttagctttgctttttaatattatcacatatgtattacccctaaacgatatttagtttcattattcatgttgtaaactttaaatcaactacatcaaacagcgcatatgcttctgagactggggttgtggctccgtgttacgcatgtgaaacatatcgacgttgatgcacgtggctgttgctcattaattttattgcctgagtatactgtaatttgtttattcttctgtcatgagggttagttccacgttttaaaattgtttatgtatcggtcgggcatgatggctcacgcctgtaatcccagcactttgggaggccgaggtgggaggatcacttgaggccaggagttcaagatcagcctggccaacatggcgaaaacctgtatctactaaaaatacaaaaattagctgggcgtgatggcgggcacctgtaatctcagctacttgggaggctgaggcacgagaattgcttgaactgaggaggcggaggttgcagtgatccgagattacgccactgcactccagcctgggcaacagagcgagactccatctcaaaaaaaaattgtttatgtattatgatttttgctaggagccctcttgtacacattcccttgtacactcttgtacacatacacagaagtttctctacaggatatatacctacaaatatgtttgtcgagttttggggaaatatgctttttaaatattttttcttgtcaacaaatacccgtttgcagtttgatcttgtaatggtagagccaggatgttaagcccaagtggttgggctttccctcattgtccacagctgtctcatatccacattggggcatcccccagcgcggtcagggcaaaggcagcagagggcgggggtctgtctgagggtagtgctggtccctgggtacagaatgtccctgagcagcccccacaggcagctgcctctcctccttcagtaggtccctggagataccctggctgcccggctcagcagtctcaacccccaggccccacccacgcagcagggactgaaataactcaagtgtgtgttttctacccaaggttgtcttcaaccaccttactcctccaccgcccgatgaacacctggatgaaggtaagaagggtggtttgggaagctgaggctccacagccctctcccctaggtggcagctttgtggagttggaaaaaggttgagtcaggagcagcttgagggctggagaagagaaaacggggaagctgagagaggccccggctctgtgcctcttggggcgtctcttcaggaaccaagaacaagtttcttcagtatgcctgagcctgggtgggacttttaaaacatgaaagactttacaaactgtaaacaagaacaaaaacaagagtcccagggaagacacacagcatcatcaaacccaagttttaaaatatgctaactctcaaacgcaaagggctgggccagtggctccaggcccttgcctccagcccctgtccgctctatgtggagggcaccttcttgtttcccgctcccagtcacttcgagagtcccgctgctgaccacctaaccacccacgcccctacctggtccccagactccacttggttttttttgagacagagtctcgctcttgtcacccaggctgcagtgcagtgacccaacctcagctcactgcaacctccacctcccgggttcaagagattctcctgcctcagcctcccaagtagctgggattacaggtgcacacaaccacaccgggctaatttttatgtttttactagtgagggggtttcaccatgttggccagattggtcttaaactcctgacctcaggtgatctgcccgcctcagcctctcaaagtgctgggattacaggcgtgagccactgtgcgtggcccctagactccacttctgctctggtgggctggcctgctgggtactgtagggaatgagctcagcctttctgggccagaggctccacccctggggactcccaagagggtggcctccttcaaagtgacttcccgcagcctcctcatcatccatgtccacacagcatggggaagggatgcctcggccagccgggccccacccattaacctgctcatatgatgtgtactgggcattcagcacacagagcccagctctgtcccaggaatggcgaaggggtgacaacaggtagatgcgaccccttccctggaaaagctcagaatctgtcacacttgtgagcagaacctgaatcttaaaacttcagggaaccactgtcacccattctgaccctcgctttcctgctgagaagaggtgaccagcccgaggtcacaacactcagctcagtgacagagcggagccaccccacccggggaagctaagtgctctccaggtgaccttcatcaggtgggtcctgtggctcccagagctgtgcagagagcctgcgtcacagcagggctcacttgaagatggtgctccaagctcctgagccctcttcctgccttccatccagggcccgccagcaaggtggggggcccggcagggtcactggcagccatagacagtgtggctggggctctgggcacagacagtggagaggccagggctccagctgccacgtggcaagaccacccctactggggatagaggcaggcggggcagaggaggaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtccacaacggaggacaggatgggctctggggggcagcccatccctggtggggtcacagggctgggggtgggggcctgtgctgggtgagaacatcatttccatcgtgggcaagcagaagcctgtcctccttggtagccaggctcaccccagccccaccttcccgcttgtgggcctgagtggtggtcatctctcccttgttcattttagacaagcatttcgtggtggctctgtatgactacaccgctatgaatgatcgggacctgcagatgctgaagggggagaagctacaggtcctgaaggggtgaggttccaggacaccatcccctgtccctgcaggacccccctcccccacatctctcctttctccacccaccacatcctccatggctgaccctggaagtcttctccatcgccctgcccccagccctggccccagcattttcttgaacttggcccttttgtcttcctctccaaaatctttccggtgaagtaatttccattcacaacctcctgctcatccttcaaagtccacgttccatgccaccgcctccatgcagccctcctgactcttttgggcatgtggaccttgtcctttatgcaggctggtctggctgttccgtgaaagccttgcatttaagccagttgtgtccatatttgtctccttttcaagacaggagcccacactgatgacacacaccaatcccgctttagctcatttcccatgtccttctcagaaactccttctaggtcagctctctctcagtggccaggcttgtcctgtggagctctgagggtctgatttggttcttgaagttctccaaaggccctgagccaagctcacgaaggtcctgactgctgattctatacagtccacgccaaccgtgtttttctcaagcctgtccccagtccctcaccaagctctgaacacgtcccattcatcaagaggaaggctgctggctggatccttgtgccctcttggctggtcaggctgtgtagataagctcttccccctagaacttgcccggatagccactgtaccactgagcagtgggcacaagccccttcctgcctgccgtactctctacccctgcggattctctgccctccagggagagatgactttgaggaggcctgagagctgcccagtgacgggcctacaggggccatgatctcatctctgtttcccctgctcccattagaactggagactggtggctggccaggtcactcgtcacaggaagagaaggctatgtgcccagtaactttgtggcccgagtggagagcctggaaatggaaaggtaggtgggcacgggaacccccctcgagccaagatgcagtcactgtttctgctccctgggctgttaggcagggcagggccagagtgggactgaccagggagcctgcaggcactagcaaagaggggacaggaaatgagctctgctgggaaaggcctctctgctggctccagacgacattcagactgctgtgtgacactgagcaagccgctcttcccagctaaacaagagcggtccttctcctggctcccctggatggaaccggccccagtgtctgatggcctcgaaggctaccagggaggcactatgaccagcatcccctcccctacagcctccatgggcaggactcagggctcagccctcgggggctcccaggagggtggcgttgttcagaactgattaatactcccaatcttctaatcccccagcccccatcttctcccatgtccccatggcactgggaatttcggactcggccagccagagcccccacgaatctgctcacagggactagctctgcctgaggactgaggcccagcaacgagtcttctctggacactgtgggccccgcttctttccctggaacagtgtggggaaccgtggggctgtcctgcacagaacaaccccataccgaaggggacatactggggtccctgctcagagagtctcggcagtttgcctaattcagatctcagactgcaaggaggaggcacgtgcctgtgatacgcagctgtgctttggagagagtgatcaggggcatttttccaaagcaaaattaacaaaggtcaaccaactagtgttcttgtttcgttctaggaaaacagtgagtccagggctgacaggaagcggaactggaagggcagcggggcagagggcactgactccatcacggtgtgaggagcagcagctcagggccgactgggaccagaaatgctagatttttatttcttggggacaggcagtgcaggagggaggctgtgtgggaatactccgaggagcagggtcgctctgagtttcacctgttcctgccgttttccaggtggttctttagatcacagggtcggaaggaggctgagaggcagcttcttgctccaatcaacaaggccggctcctttcttatcagagagagtgaaaccaacaaaggtaggcttggtggctttgcctgccttccttgccctgctcctcccgggaaggcgcctccagaggcctggccctggagtgagaggggaaggggtgactgccaggagaaccagcagcttccgggcttgtgtccctcccaattcaggccctgcccgggagttgacatgggggctgtccacacagtcctccctgtcccggctggaaaccacctgggcacaggaagccgggtggacaggggtggtcccacgccagactggccctgctgcccagtcagcaggaacaccgaggccagtgggggccagggaagggggaaccctgagcccttaaccaccagcctctttggaatcaaggattagggggagctcaaagaatccttcaagatcatctcagccagaggctgcaggtagcatatgttaggaagtggcctgtgccgtgatgtaagagaagagggtggtaattgaggggagcccatgccagtctagacactcatgagttcaaatccactgactgagcaaaacagctgccatcaccctcaggggttttctctctttctctgtcatttggctttctttccttcttaatttttttggtgtaaaatataaaacacatataaagcttgcatgaagtatgaatgtgtaattctaaatcatatagggtaataataaacaaatccctgtgtaatgacagccaagagaaagagcatcccagaccaccaggagccccctcactcccccacttgggctccttcctgattcaacccccaccctcaagagctacctgctgtcctgacttggatggaaatccttccttgctcttctctgtggtttcgccaccatgtcttgtctgttttttcagcttgatgtagatagaatcactgtttttgtttctgtgtgtcttgcttctgtcactcagcagtgtttgtgggattctatgttagtttcctgggctgccgtaacaaagtggcacagactgggtggcttccaccacagaagcttattatctcacagctctggaggctggaagtccacgaccaaagtgtcagcagcgttggctcctcccgggagctctctccttggcttgccgatggccgtcttctctgtgtcctcacgtggccgtccctccatgcatgtctgtgtcctaatctcttcttgtaaggacacctgtcaatttggattagggcccacccatatgacctcattttaacttaatcacccctttaaaggctctgtctccacatatagccacattctcaggaccgagggttaggactttaacatatgaattgggagcgcacatgattcaaccagtaacagattcattcatgtggttgaggatggtgagcctgttcatgttcattgctatacagaatcccgggtgtgaccattccagagtcaagttagccattctcatgttgtgggcattgagttgtttccagtttggggctgttaatgcatgtgttgcaccgaaccctattatggtccctggtgctcactggccactagcttttcgtctgtaagatactaatccacttgacagatgaggaaagggagtccctgaaacaggaagtgacttgctgggggccaacagtaagcatcagagcccaaagcaccagtgaccacatcatctaagaggctgagaggcttcccaagctctacaacgtggcaagctagggtgacccaggggcttcccaggcagtatgaagaatgctttgctcatcaggaagctgtccacagggaccaggtacagccttgtagccaattttaactggagaggagatggtgacagtgacatcagaggaggaaagggagagagagtgtctggaatatgagtctggttccctgtggttggggcgatgagaatggacagagttgtcacctggtgggagcacccttgggctgtccattggttccatctgtggctcaagaacagcagccagagtggaaacccagagtatgaaaagctgtcatagcaccctgtgattctctggggacatcatgaggccttggtgccccacaaaggggcaggaccaggttggggagcaggaagggtgcattggaaagctggggtgctctgtgcaggatttcttggaatatgccaatgaatgcatatacatacatatacatacacatagatatatgcattttatatttatattcatattggatattgtcactatttcatttttgtggcagagcacctctgtacaagaaataatttgggaatcactggagatgacataagtgttttattgttgttccaggacatttcaaacatacacagaagtagagaaaatagtttagtggaacccctggtacccaacagccagcttcaacaattatcaactgagccagtcttgtttcatctgtatctcccgctccacccctgttctttcgaagtaaatcccaaacatcatgtcatgtcaccctggaaatgatatttcaaccattgcctattgctaaggtgaaagcctccccaccccctgcccaatctggtgtggaggaagaaggggttctctatgagtctggcatcttttcctgtccatgtccaccccaggaagccagtccaagctgggaataggccatatgggaccagggctgcaggactgttcaaccatcatcaccaccacacgcacatacacatgcacacatgaacacacatgcacatatgcacaaatgcacacatatacacacatgtgcatacacaggcatgtgtgcacacatacacatgcaaacacatacacatgtccacgcatgcacatatacacacacacgcacacatatacatgtgcacatatgcacagatgcaatgaacacgtgtgcaacacatgtacacaccttacacgtacatatgcacacacacacacaactccaaagcaagacccctctgcttctccgagccacagcagtgaatgcaagacagggatggaagcaggggagtgagttctacccttcgtggcctccggggtgtccttgagcctctcaagcctcagtttactggtgtctatgtgaggatagactagtttcacagctcaaaggcaggcggtccttcagtgctgagaaatcttcatctcagagccaggccctgcctgcccagggcagtccagacataccacagaggcaggggatccaggttttgtgaaactgaagctgataggatctgaggtcgtctttacaaaggacaccaaattgtcagaagccatcagggacggggcctcagagcagccaggcaagtgaggggtctaaagcaccagcttgggaagcgtcactgcgtggagagcgggctcctgggctcatcgcccgaggcacccgacacaagtgcagcctacaaaatggagagaaaagcccttgatgaatgaactccctaaggccaggctcgggttccttagagactgggggcacagctgcacccgggcagggtcggggagacagtttgcagcctctgggctgaggctggggtgggggtgtggaggggctgtggcaacagcatggcgtacgcctctgggtgtccttttgcaagtaggtgatgagagaggcacattggctgagggaaactggaggatggaagggggttgaggcaggggaactgacaggagaggaaagagccttaagtcaaacaggaccgcggaaaaccaagcgtccacaacgagaacgaggggtccgtgcctgacccctggcggggaggcgtggtactgctcgaggtaggcgcggactcggggaaccgggagccccccagcctgccgcgaactctgctgggccccagcgtcctcatctcccaaataatgggtaaggggcggggtaaggtcatggtacccaagtagctggacagacgcattttataaaaacatcaagttcatggaaaagcgtttcttacctggaaattcttacctcctaaattgtccttaacccttgacatctgctaccacttgcctgcgggaaaacattaacctagaagacaaaataacaggtgtatgtaacaggcagcaaatgactttgaacagagcccctgggcatagcttattacggtgtccgccatggacatgggtacttgcagctgtgaatggctatctgcttgtaggagtaagagataccctctttagccagaaaataaagcccctagtcactccaacgagactagatttctcaatagtccatgacaaagggtccccgagtgaccagatgcccaagtggggacctacatgattgctgagaaactgtgctgcctgccgcagggctctgtgattccctggctgagttttgcaggatagtggggggatgccaaggtcagagtcagatggaacttacaggggaggcttccaaaagcatggaggttgagatgcagggaaaggaaacttgtggagggagtgctgataatgaagaacagaattggggaacttttttcaaagctttaaaatgaggcccaaatcccagtcccgttttttgtctttgtgccttacttctcgtgtgtgtcttcatgaaccctccaggtgccttctccctgtctgtgaaggatgtcaccacccagggggagctgatcaagcactataagatccgctgcctggatgaagggggctactacatctccccccggatcaccttcccctcgctccaggccctggtgcagcactattctagtaagagggggcgtgcaatgggggcagggacttgtgccaagagcccctggatctctcgctaagattcccaattgtgtgagtcattggtgccaccttgggggatggaaagattatcccaaagttaggcctaaggaggtagcaactctgagcaccgggaattggtggccctaattccctctcctggctcagcagggaaccccttagagagtagcaagcattttcagtcttagagtgagcaggtcgattttagagatagcatgccctgctttgcgcaaacgaagagaaagagttgagtgtgtgtgcatgtgcaggcgtgtgcacacacccatgcagggggtggggtggctggggagtggagggccagctaggaatgatacagctcccaaggtagagcctggctgctctggtaacccccagccctgtcttttcttccctaatgcagagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggtgagtgtgtgcacacgtgggagcatttctccccccattccacctgcgccgcatcctgagtccaggttcagcattttcatagcgtgtcatccctcccccagaagtcttgagagggagcgaggacagaggcgaggacactcattttacagaggaggaagtggaggtgcagagccgcgttgtaacagctgggaccgcttatggtggtggcagagcaggaacagaatccagctcacccagccccgaagtcgctccctccttcgttctctgcctgaagctggctttgacaatgagctgcagcggcgcgttaactccccttagcttttcatcacccagatggaaacaggaggttaaacgtgatgagccatgatgttccagagcctgagtgcacaccgagggcagccgtgggactttggccaagtcactgaagctccaggcctggtgtcctcacatttccatcgctgctgacacctgcccccttcccccccccgcccaccaggatataaaactcgtgttccgttttatccctggattggtccatgagtcctcccttacctggggctggtccatgagtgctcccttacctggggctgatgcccacggtgcttttggcaggagctgtacccaggtccctgccaaggcccatgtcctctagaaaagcaagtagagttgtcttttgcccttcaggggacttcatggagtacagggagagtgtggagatacagatagtttaaggagtgggacaggatcgccatggggcttcagaaggagggaaggagacccccatgcgtcatcctcctgcccagtgtaccccaggctgtgtgcttatttccaccaaggagttattgtgtgatagaagagactcattatgtaggggaggggtgggggaaggacacaggttccgtgcaggacagaaggacacaggcccagggtgtggggcaaataggtgaaatgccccccaggcagggtacattcctccactgcctgaggccccatatagaagggacctggaacgcaaggtaggcaccacacaaccatggcctccggaactgcatgttccagctctggcacctggaatggggtggcacctgggcacttaccccgattttggttaagggatcacctccgagcaagctctctgtcttctgattggcttcttcactcccccgggctcaggttactacaaaaacaacatgaaggtggccattaagacgctgaaggagggaaccatgtctccagaagcctttctgggtgaggccaacgtgatgaaggctctgcagcacgagcggctggtccgactctacgcagtggtcaccaaggagcccatctacattgtcaccgagtacatggccagaggtggtgccccccgcagagccgcatcctcagagcgaggcgggagggccgggcttagcaggaggaggagggtccgctgcggtgggttcaccaggccagggggtcctgcagatctagggcatggcacggtgtggggacagggagggatggagggagggggagggacagagggagggtgagaaacaggagggtgaagtggttctgacagagccatgttctcagcccaggagcagttcagacagcatttctggagtgcatcttctgtgcctagcactctttgatgcctgctgggagggacagagcattgcaaagtcagacgaacaccaggccaggcatgcagggacagtactagatccaggtctcctgcctcctggtcatgcaaccatttacaactgtgtgaatattttacaaggatggccagagaggttgggcttgatggcctctgaggtccacggcgtggccaagttctcatgccactttctcaccctcctatgaccctgaccgcacactgctcctataggatcctaacatgcccatgttgatatagctccctaacaactgtcaccaaggggcccccggtcggaggctgtgctgggggtgcctctagcctgcccctagggcaagcatccatccctcccagctttctgattccagggggagctgcatttgtcccctgcaccaaacctgggggacagttctctccattctggtgctttcttgctgatgcctggtcctcagaggcagagggtgtctgccagcagggatcaagggagcgaggccaacacggggggaaagacaagaaggggcatgaaacttcgagtcagaactggggtcccactcccagctcccggctgggtgacttcagacaggtccctgcacctggctgaaacctaacttctgggcaactgctggtatattggctgcctcccggggtgctgagactggcattttgtaaagtggaaggcactcggcagcagtaggtagatccttcctgatgcaccgagagatctgagggtgcaaactcccacttcccgcgcccatggggagccactcacaccagagagaggctggcaccaccaggggcgggtcactttgcagaagggcacttgcaacttctcttttcttaggatgcctgctggatttcctgaagacagatgaagggagcagattgtcactcccaaggctgattgacatgtcggcgcaggttggtgaagtaccaggtgcagagaaagggcggcatgtgccacctgctgcccacaatggctgctcgtgccttaccaccccatcctctcagccagcaggagaagtcagggggtactgaaggccaccttcctctaggcagatatccccaaggtcacccactgcacttggacttgcaaaccctggccactgtgcctcctgccccacgcagctgtgagggagcccagggaatggagccttagacccgggctgctgtgttggaatgaggctattctgttccgaaggaagagagggcgaatgaatgtcatgggaaacacacagagttagcaagagttccattgaacccggcaggcaagtgtgttctgttgtgacctcatctcttccttagatggtgcccacaaacatctcctgtaggacttcccatcccaggggccctcagcctttgcacagccctggcgtcgaccccaggctgatgggcaggcctgagctacacacagatgccagggacatgacttctctgagccctggaggacagccccaccttctgccaccagggaattgcgagtgctggacctccttggctacccaggactggtcctcagtgtccctcacgttcacatgcagaactttctggactccatggggtgaagagcagagtggagaggagggttttagccgagagctctagctggcaggaagcacatctggtggccctgttaaaactggaactctcagcagaaaagttttggtctgtggtcagcctgtgaggcacacacgtgcgtacacatacacacacacatacagctgccaccgagaggaaacgctcccacccaccgcccacatcagccctcccacctcgcccctcgcccagccttacccagtagcgccgctgcaggaactgatgccacaacgcctttttccgctgaggtgggcagacagccatctgggcaggctggttttggaaaatgagtgctggtaaccggcttcaaaccccagggcagtgataagcctgcccactgctgctgcttcctttccccttccttctctcaccctccgctgtctcctattcaatccccactacacccccttgggaaatctcgtgtgacccaggggcaaaggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacacgcaaactcacacacagacagacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatctgggccctactcaacattttttaaaatatatttctggtactgttcaataaatattagttatcagaacgagtactgttagatgctgcccagatatatttagtactcagttttatattccccacagtcccatattagtaaatgagtattgattgcatggtgtagcaaggggatggatggatgcatggatgggtggatgcgtgggtgggtgggtgggtgggtgggtgggtggatggatggatgcatggatggatggatggatggatggatggatggatgcatgcatggatggatgaatgggtggatggatggatgggtgggtgggtgggtggatggatggatggatccatggatggatggatacatggaaggatgcatagatggatggatggatggatacatggatggatgcatggatgtgttgatggatggatgggtgggtggatggatggatgcatggatggatggatgcatggatagatggatggattcatagataaaccaacaaaatgcaagcataaggagaagtggaatcaattctagtgctggcttcttgaagtcgcatgtctgaagaggtaaatggggtctctgctttctgcctcagtttcttcgtccattgattgggtgaataaagccttagtttcctcagctaaaaggtgccaagtagcaccagctgctatccctggcccaggctggtgatcaggggaggagagacaagtctcttcttcttcacagcctctgtccacctggatctgccagtgctccctgggtgcccccacggggcaggcgctgggtgaggttcttggtcacaaatcaacctcgtctaatgcttgcctcaaccccctgccctggagaccacatccctcatgttccatgtcaggactgtggcccctcggggaggttaagcagcttgctagaggtcagcgacttcccgagggcctccagctccaggagctgtgcttccagccagccagtgagagctgcctgtccttgcctcctgctccccctccccctccttccttaccatttcttctcttctccctccctctccttttctcctgcctgtgttcttctatcttccatctctgcagacccttggacacagctgtgtggagcgagaacgaggagggggaggggcacaggtagcccctgtgtctctgatgcccacgttgctgcgttgctgttctgggcttctaggagaggagtttattcggctgaggagcaacacagtcacctttctactccatccaagaaacagctccttccccagcagcccacaggggctgtgcgggggacacagtgtgggctcggtcttggcgtggaggcccccaggctgtccttcaccatgtgcctgttccctcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggtaagcacagcccctaaccacaagggaaacctagggccttatctttcccagctcctcaaagccgcctttaacttctcccagcacagccctgagggaagacacctgagggctatacggtttctacagctctagatcagcatttccttcatttacccaaatgtgttcagcagaatggtagtgccctgagacctcccatggaggaacagctttaggataaggtaggtttggagaaacagcagtccaccctactccctgtcttggagattcccagtgcacatcaacatattaaaggcactgagaagtcctgcagcaaagaaacagtttatgtttgcctcacctagtgcctcccaaactaatttgagctccaaatactattttttttttttttgagatggagtctctgtcacccaggctggagtgcagtggcacaatcttggctcactgcaacctccgcctcctgggttcaagcaattcttctgcctcagcctcccaagtagttgggattacaggcgtgtgccactacacctggctaatttttgtatgtttagtagagatggggtttcaccatgttggccaggctggtctcgaactcctgaatttaggtgatctgcctgccttgacctcccaaagcgctgggatgacaggtgtaagccatgcccaaatactatttttatatagtccctattaaccttccatggaattaggctttcacagagcacactgtgggaaacacagctctcatgtgcgatcagcaaaccaacctgtattagggtgtccacggagcactgttttactctgtgcatataactgaggtggaaatctacgtcacaagagaatctgaaggggtcacatatatttatcaagctagcaagcagtgtctgctgagcctatgagtcagatgacaagcagacaggatatggcttgttctctcgggaacttcaggctggctggggagaccgagaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaaggcccctgtaaggtgaaacaggccccttccatcccaggtggaaacgtggtggctgcccattgaggccatcgctctctttttaaagaaccaaagtgggtgactgtgtggtattggtgtccatatcgtctttctgtgctgctgatgtcgtgtctgcactcacctggtcatgtgtcctggtgtgcggtagtggctcccccgccatgcctggccgccccgccctgtgaggccccgcagtgggggcttgatggaaggacagcaggagcaggggtaggggtgaggatggagggtaggggccaccggccgtggcctcccaaagcttgcatggcttttcccacaggggccaagttccccatcaagtggacagccccggaagccatccacttcggggtcttcaccatcaaagcagacgtgtggtcgtttggagtcctcctgatggaagttgtcacttatgggcgggtgccatacccaggtaggtggctcaccccgcagctcgcggctccctgctttcccggccggccctgatggcaggtcgcctgtgcttggtgcctgtggctgccctgttcttttcagagtgagtcccagagcgaagacggagacccaggcatggcatctggggtggagctctgccccctgcatcactattgctctgggccacagggctgtgtctccttcctccagcagaggtcaaatgagtccctcaaactgaaatcaagacaaagggcacatccgaactcaagtttactcccagtggcttgttctcagttgaggacaggttgtgcctaccttggctttgcacccatagtggattccccaaagccccttcctgtgtggccagaatcgtggacgacagcccccagccccagtcgaagggctccagccacttggcccccacaggtgggcaggctccgggtcacctgctgctgtgtgcacctggcagctgcccatgagtgatgggcttggctgtgcccctggtggtcacaggtaatcaagagagggagggtcccatcttcagaggacctgccccgtactcaggagaaaatctacagcctcatttctaggcattccccaggcaataaaaagtaaataaagggctgtttagagaccgggcagccaggcaacgcacgaggctggagaagtggtctgggactgtgggcactgctgtcccttgcctgggcccactgtgccccgcgggacgctcagggccccccacccaccgaggaccccagcccctcacccccgcttgcggtctcctctgccgcagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcagccccagcctaggctgcgctccagcactgcggggcttttctgcaataaagtcacgagcgttcga
